(12) United States Patent
Meissner et al.

(10) Patent No.: US 11,492,591 B2
(45) Date of Patent: *Nov. 8, 2022

(54) UNIVERSAL DONOR STEM CELLS AND RELATED METHODS

(71) Applicant: President and Fellows of Harvard College, Cambridge, MA (US)

(72) Inventors: Torsten B. Meissner, Somerville, MA (US); Leonardo M. R. Ferreira, San Francisco, CA (US); Jack L. Strominger, Cambridge, MA (US); Chad A. Cowan, Boston, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/497,927

(22) Filed: Oct. 9, 2021

(65) Prior Publication Data

US 2022/0112459 A1    Apr. 14, 2022

Related U.S. Application Data

(60) Continuation of application No. 17/148,556, filed on Jan. 13, 2021, which is a division of application No. 15/572,776, filed as application No. PCT/US2016/031551 on May 9, 2016, now Pat. No. 10,968,426.

(60) Provisional application No. 62/158,999, filed on May 8, 2015.

(51) Int. Cl.
*C12N 5/0735* (2010.01)
*C12N 5/074* (2010.01)
*C12N 15/86* (2006.01)
*C12N 15/90* (2006.01)
*A61K 39/00* (2006.01)

(52) U.S. Cl.
CPC .......... *C12N 5/0606* (2013.01); *A61K 39/001* (2013.01); *C12N 5/0696* (2013.01); *C12N 15/86* (2013.01); *C12N 15/907* (2013.01); *C12N 2310/20* (2017.05); *C12N 2501/50* (2013.01); *C12N 2501/599* (2013.01); *C12N 2501/998* (2013.01); *C12N 2510/00* (2013.01)

(58) Field of Classification Search
CPC .................................................. C12N 5/0636
See application file for complete search history.

(56) References Cited

U.S. PATENT DOCUMENTS

| | | | |
|---|---|---|---|
| 5,272,082 A | 12/1993 | Santoli et al. | |
| 6,986,887 B2 | 1/2006 | Lawman et al. | |
| 8,105,831 B2 | 1/2012 | Russell et al. | |
| 8,420,395 B2 | 4/2013 | Calos | |
| 9,181,527 B2 | 11/2015 | Sentman | |
| 9,273,283 B2 | 3/2016 | Sentman | |
| 9,597,357 B2 | 3/2017 | Gregory et al. | |
| 9,822,370 B2 | 11/2017 | Musunuru et al. | |
| 10,968,426 B2 * | 4/2021 | Meissner | A61K 39/001 |
| 2002/0012660 A1 | 1/2002 | Colman et al. | |
| 2002/0188963 A1 | 12/2002 | Loring | |
| 2007/0283452 A1 | 12/2007 | Liu et al. | |
| 2008/0182328 A1 | 7/2008 | Snyder et al. | |
| 2012/0321667 A1 | 12/2012 | Sentman | |
| 2013/0177577 A1 | 7/2013 | Kobayashi et al. | |
| 2014/0030240 A1 | 1/2014 | Gregory et al. | |
| 2014/0065667 A1 | 3/2014 | Guschin et al. | |
| 2014/0106449 A1 | 4/2014 | June et al. | |
| 2014/0120622 A1 | 5/2014 | Gregory et al. | |
| 2014/0134195 A1 | 5/2014 | Russell | |
| 2014/0301990 A1 | 10/2014 | Gregory et al. | |
| 2015/0017136 A1 | 1/2015 | Galetto et al. | |
| 2015/0056225 A1 | 2/2015 | Russell | |
| 2015/0110760 A1 | 4/2015 | Zhang et al. | |
| 2015/0139994 A1 | 5/2015 | Xu | |
| 2015/0152436 A1 | 6/2015 | Musunuru et al. | |
| 2015/0176013 A1 | 6/2015 | Musunuru et al. | |
| 2015/0283178 A1 | 10/2015 | June et al. | |
| 2016/0046724 A1 | 2/2016 | Brogdon et al. | |

(Continued)

FOREIGN PATENT DOCUMENTS

JP      2016/520308 A    7/2016
WO     WO-2005/113805 A2    12/2005

(Continued)

OTHER PUBLICATIONS

Timmermans et al. (2009, J. Immunology, vol. 182, pp. 6879-6888). (Year: 2009).*

(Continued)

*Primary Examiner* — Peter Paras, Jr.
*Assistant Examiner* — David A Montanari
(74) *Attorney, Agent, or Firm* — Morse, Barnes-Brown & Pendleton, P.C.; Lisa M. Warren, Esq.; Erin E. Bryan, Esq.

(57) ABSTRACT

Disclosed herein are universal donor stem cells and related methods of their use and production. The universal donor stem cells disclosed herein are useful for overcoming the immune rejection in cell-based transplantation therapies. In certain embodiments, the universal donor stem cells disclosed herein do not express one or more MHC-I and MHC-II human leukocyte antigens. Similarly, in certain embodiments, the universal donor stem cells disclosed herein do not express one or more human leukocyte antigens (e.g., HLA-A, HLA-B and/or HLA-C) corresponding to MHC-I and MHC-II human leukocyte antigens, thereby rendering such cells hypoimmunogenic.

19 Claims, 134 Drawing Sheets
Specification includes a Sequence Listing.

(56) References Cited

U.S. PATENT DOCUMENTS

| | | |
|---|---|---|
| 2016/0185861 A1 | 6/2016 | Bedoya et al. |
| 2016/0311907 A1 | 10/2016 | Brogdon et al. |
| 2016/0348073 A1 | 12/2016 | Meissner et al. |
| 2016/0362472 A1 | 12/2016 | Bitter et al. |
| 2017/0175128 A1 | 6/2017 | Welstead et al. |
| 2018/0141992 A1 | 5/2018 | Cowan et al. |
| 2018/0155717 A1 | 6/2018 | Valamehr et al. |
| 2018/0249688 A1 | 9/2018 | Ayares et al. |
| 2018/0362975 A1 | 12/2018 | Chen et al. |
| 2019/0015487 A1 | 1/2019 | Bhoumik et al. |
| 2019/0032049 A1 | 1/2019 | Naldini et al. |
| 2019/0376045 A1 | 12/2019 | Schrepfer et al. |
| 2021/0161971 A1 | 6/2021 | Nagy et al. |
| 2021/0261916 A1 | 8/2021 | Meissner et al. |

FOREIGN PATENT DOCUMENTS

| | | |
|---|---|---|
| WO | WO-2012/145384 A1 | 10/2012 |
| WO | WO-2013/158292 A1 | 10/2013 |
| WO | WO-2014/153470 A2 | 9/2014 |
| WO | WO-2014/165825 A2 | 10/2014 |
| WO | WO-2014/184741 A1 | 11/2014 |
| WO | WO-2014/184744 A1 | 11/2014 |
| WO | WO-2015/006498 A2 | 1/2015 |
| WO | WO-2015/057976 A1 | 4/2015 |
| WO | WO-2016/057821 A2 | 4/2016 |
| WO | WO-2016/057835 A2 | 4/2016 |
| WO | WO-2016/063264 A1 | 4/2016 |
| WO | WO-2016/073955 A2 | 5/2016 |
| WO | WO-2016/112779 A1 | 7/2016 |
| WO | WO-2016/160721 A1 | 10/2016 |
| WO | WO-2016/183041 A2 | 11/2016 |
| WO | WO-2018/132783 A1 | 7/2018 |

OTHER PUBLICATIONS

Canver, et al. "Characterization of Genomic Deletion Efficiency Mediated by Clustered Regularly Interspaced Palindromic Repeats (CRISPR)/Cas9 Nuclease System in Mammalian Cells," *Journal of Biological Chemistry*, 289(31):21312-21324, (Aug. 2014).

Christianson, et al., "Enhanced Human CD4+ T Cell Engraftment in Beta2-Microglobulin-Deficient NOD-Scid Mice," Journal of Immunology, 158:3578-3586, (1997).

Cowan, Chad A. Abstract "Isogenic Human Pluripotent Stem Cell-Based Models of Human Disease Mutations." National Institutes of Health Grant No. 1R01DK097768-01 (Funding Start Date Sep. 25, 2012).

Gussow, et al., "The Human Beta 2-Microglobulin Gene. Primary Structure and Definition of the Transcriptional Unit," *Journal of Immunology*, 139(9):3132-3138, (Nov. 1, 1987).

Harrer, et al., "Generation of Stem Cell-Derived Hypoimmunnogenic b Cells That Circumvent Immune Detection," Master's Thesis. Degree Program Tissue Engineering and Regenerative Medicine University of Applied Sciences, Vienna. Sep. 2018. Retrieved from the internet <URL: https://static1.squarespace.com/static/559921a3e4b02c1d7480f8f4/t/5c790ded24a69426265feb35/1551437298166/Harrer+Jacqueline_852_.pdf>.

Hu, et al., "Generation of Hypolmmunogenic Induced Pluripotent Stem Cells for Allogeneic Cell and Tissue Transplantation," *Transplantation*, 101:5S-3: p. S2, (May 2017).

Jaiswal, et al., "CD47 is Upregulated on Circulating Hematopoietic Stem Cells and Leukemia Cells to Avoid Phagocytosis," Cell, 138:271-285, (Jul. 24, 2009).

Koller, et al., "Normal Development of Mice Deficient in ß$_2$M, MHC Class I Proteins, and CD8$^+$T Cells," *Science*, 248(4960):1227-1230, (Jun. 8, 1990).

Lloyd, et al., "Beyond the Antigen Receptor" Editing the Genome of T-Cells for Cancer Adoptive Cellular Therapies, *Frontiers in Immunology*, 4(22):1-7, (Aug. 2013).

Lloyd, et al., "Generating Hypoimmunogenic Human Embryonic Stem Cells by the Disruption of Beta 2-Microglobulin," *Stem Cell Rev.*, 9(6):806-813, (Aug. 10, 2013).

Lu, et al., "Generating Hypoimmunogenic Human Embryonic Stem Cells by the Disruption of Beta 2-Microglobulin," *Stem Cell Rev.*, 9(6):806-813, (Aug. 10, 2013).

Ma, et al., "Heritable Multiplex Genetic Engineering in Rats Using CRISPR/Cas9," *PLOS One*, 9(3):e89413:pp. 1-8, (2014).

Mandal, et al., "Efficient Ablation of Genes in Human Hematopoietic Stem and Effector Cells Using CRISPR/Cas9," *Cell Stem Cell*, 15(5):643-652, (Nov. 6, 2014).

Mattapally, et al., "Human Leukocyte Antigen Class I and II Knockout Human Induced Pluripotent Stem Cell-Derived Cells: Universal Donor for Cell Therapy," *Journal of American Heart Association*, 2018(7):1-13, (Nov. 29, 2018).

Meissner, et al., "Genome Editing for Human Gene Therapy," *Methods in Enzymology*, 546:273-295, (2014).

Meissner, et al., "The Universal Donor Stem Cell: Removing the Immune Barrier to Transplantation Using CRISPR/Cas9 (TRAN1P. 946)," *The Journal of Immunology*, pp. 1-5, (Dec. 10, 2021).

NCBI Accession No. NG_012920.1, pp. 1-6 (2013).

Rebmann, et al., "HLA-G as a Tolerogenic Molecule in Transplantation and Pregnancy," *Journal of Immunology Research*, 2014:1-16, (2014).

Riolobos, et al., "HLA Engineering of Human Pluripotent Stem Cells," *Molecular Therapy*, 21(6):1232-1241, (Jun. 2013).

Romieu-Mourez, et al., "Regulation of MHC Class II Expression and Antigen Processing in Murine and Human Mesenchymal Stromal Cells by IFN-γ, TGF-β, and Cell Density," *The Journal of Immunology*, 179:1549-1558, (2007).

Rong, et al., "An Effective Approach to Prevent Immune Rejection of Human ESC-Derived Allograts," *Cell Stem Cell*, 14(1):121-130, (Jan. 2, 2014).

Tena, et al., "Transgenic Expression of Human CD47 Markedly Increases Engraftment in a Murine Model of Pig-to-Human Hematopoietic Cell Transplantation," American Journal of Transplantation, 14:2713-2722, (2014).

Toriaki, et al., "A Foundation for Universal T-Cell Based Immunotherapy: T Cells Engineered to Express a CD19-Specific Chimeric-Antigen-Receptor and Eliminate Expression of Endogenous TCR," *Blood*, 119(24):5697-5705, (Jun. 14, 2012).

International Search Report from PCT/US2016/031551, dated Nov. 30, 2016.

International Search Report for PCT/US2016/024554, dated Aug. 25, 2016.

International Search Report from PCT/US2020/018467, dated Sep. 17, 2020.

Non-Final Office Action for U.S. Appl. No. 15/083,021, dated Apr. 2, 2018.

Non-Final Office Action for U.S. Appl. No. 15/083,021, dated Jun. 2, 2020.

Non-Final Office Action for U.S. Appl. No. 15/572,776, dated Apr. 1, 2020.

Non-Final Office Action for U.S. Appl. No. 16/908,618, dated Dec. 17, 2021.

Notice of Allowance for U.S. Appl. No. 15/572,776, dated Sep. 16, 2020.

Final Office Action for U.S. Appl. No. 15/083,021, dated Jan. 10, 2019.

Final Office Action for U.S. Appl. No. 15/083,021, dated Mar. 4, 2021.

DiTomaso, et al., "Immunobiological Characterization of Cancer Stem Cells Isolated from Glioblastoma Patients," *Human Cancer Biology*, 16(3):800-831, (Jan. 26, 2010).

Non-Final Office Action for U.S. Appl. No. 17/148,556, dated Jan. 21, 2022.

Van den Berg, et al., "Innate Immune "Self" Recognition: A Role for CD47-SIRPalpha Interactions in Hematopoietic Stem Cell Transplantation," *Trends in Immunology*, 29(5):203-206, (Apr. 3, 2008).

(56) References Cited

OTHER PUBLICATIONS

Sadelain, et al., "Safe Harbours for the Integration of new DNA in the Human Genome," *Nature Reviews Cancer*, 12:51-58, (2012).
Non-Final Office Action for U.S. Appl. No. 17/148,556, dated May 31, 2022.

\* cited by examiner

```
  1 MDKKYSIGLD IGTNSVGWAV ITDEYKVPSK KFKVLGNTDR HSIKKNLIGA LLFDSGETAE
 61 ATRLKRTARR RYTRRKNRIC YLQEIFSNEM AKVDDSFFHR LEESFLVEED KKHERHPIFG
121 NIVDEVAYHE KYPTIYHLRK KLVDSTDKAD LRLIYLALAH MIKFRGHFLI EGDLNPDNSD
181 VDKLFIQLVQ TYNQLFEENP INASGVDAKA ILSARLSKSR RLENLIAQLP GEKKNGLFGN
241 LIALSLGLTP NFKSNFDLAE DAKLQLSKDT YDDDLDNLLA QIGDQYADLF LAAKNLSDAI
301 LLSDILRVNT EITKAPLSAS MIKRYDEHHQ DLTLLKALVR QQLPEKYKEI FFDQSKNGYA
361 GYIDGGASQE EFYKFIKPIL EKMDGTEELL VKLNREDLLR KQRTFDNGSI PHQIHLGELH
421 AILRRQEDFY PFLKDNREKI EKILTFRIPY YVGPLARGNS RFAWMTRKSE ETITPWNFEE
481 VVDKGASAQS FIERMTNFDK NLPNEKVLPK HSLLYEYFTV YNELTKVKYV TEGMRKPAFL
541 SGEQKKAIVD LLFKTNRKVT VKQLKEDYFK KIECFDSVEI SGVEDRFNAS LGTYHDLLKI
601 IKDKDFLDNE ENEDILEDIV LTLTLFEDRE MIEERLKTYA HLFDDKVMKQ LKRRRYTGWG
661 RLSRKLINGI RDKQSGKTIL DFLKSDGFAN RNFMQLIHDD SLTFKEDIQK AQVSGQGDSL
721 HEHIANLAGS PAIKKGILQT VKVVDELVKV MGRHKPENIV IEMARENQTT QKGQKNSRER
781 MKRIEEGIKE LGSQILKEHP VENTQLQNEK LYLYYLQNGR DMYVDQELDI NRLSDYDVDH
841 IVPQSFLKDD SIDNKVLTRS DKNRGKSDNV PSEEVVKKMK NYWRQLLNAK LITQRKFDNL
901 TKAERGGLSE LDKAGFIKRQ LVETRQITKH VAQILDSRMN TKYDENDKLI REVKVITLKS
961 KLVSDFRKDF QFYKVREINN YHHAHDAYLN AVVGTALIKK YPKLESEFVY GDYKVYDVRK
1021 MIAKSEQEIG KATAKYFFYS NIMNFFKTEI TLANGEIRKR PLIETNGETG EIVWDKGRDF
1081 ATVRKVLSMP QVNIVKKTEV QTGGFSKESI LPKRNSDKLI ARKKDWDPKK YGGFDSPTVA
1141 YSVLVVAKVE KGKSKKLKSV KELLGITIME RSSFEKNPID FLEAKGYKEV KKDLIIKLPK
1201 YSLFELENGR KRMLASAGEL QKGNELALPS KYVNFLYLAS HYEKLKGSPE DNEQKQLFVE
1261 QHKHYLDEII EQISEFSKRV ILADANLDKV LSAYNKHRDK PIREQAENII HLFTLTNLGA
1321 PAAFKYFDTT IDRKRYTSTK EVLDATLIHQ SITGLYETRI DLSQLGGD  (SEQ ID NO: 1)
```

FIG. 12

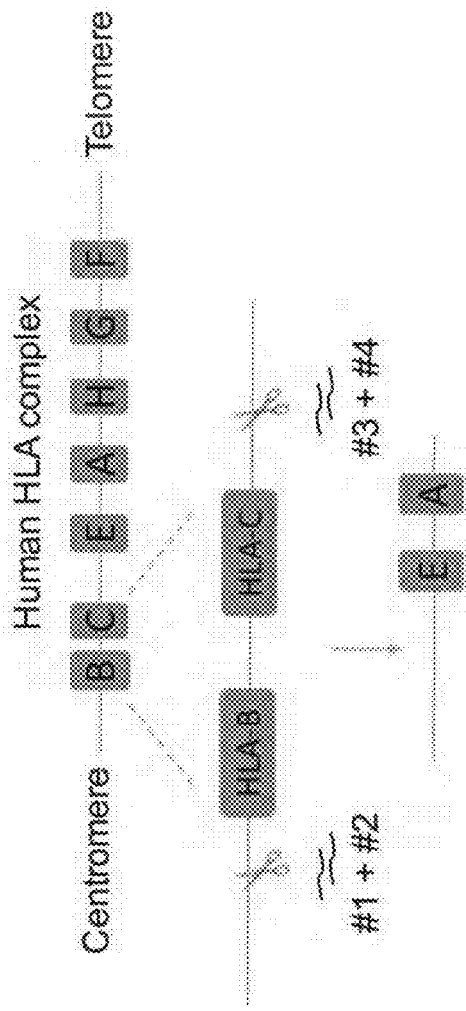

PCR screening confirms clone 1D as a homozygous knock-out clone
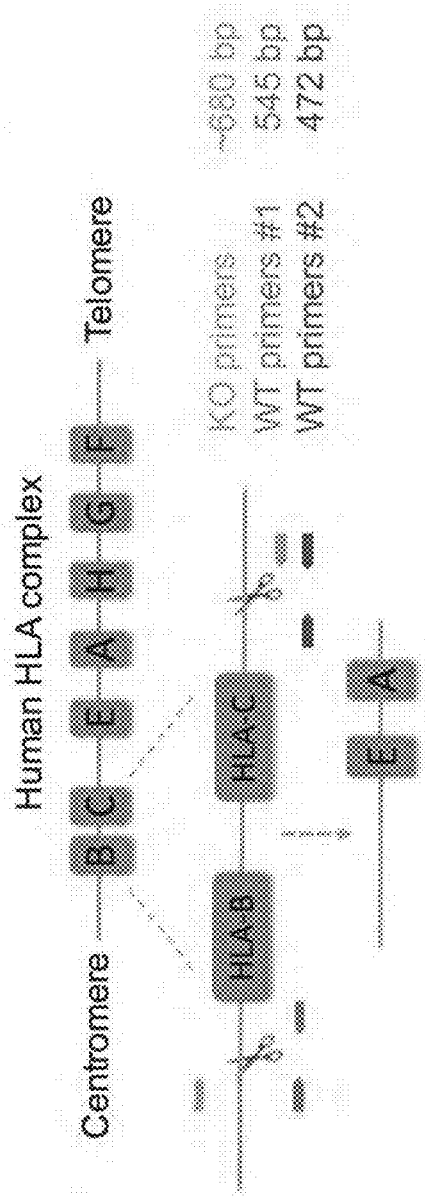
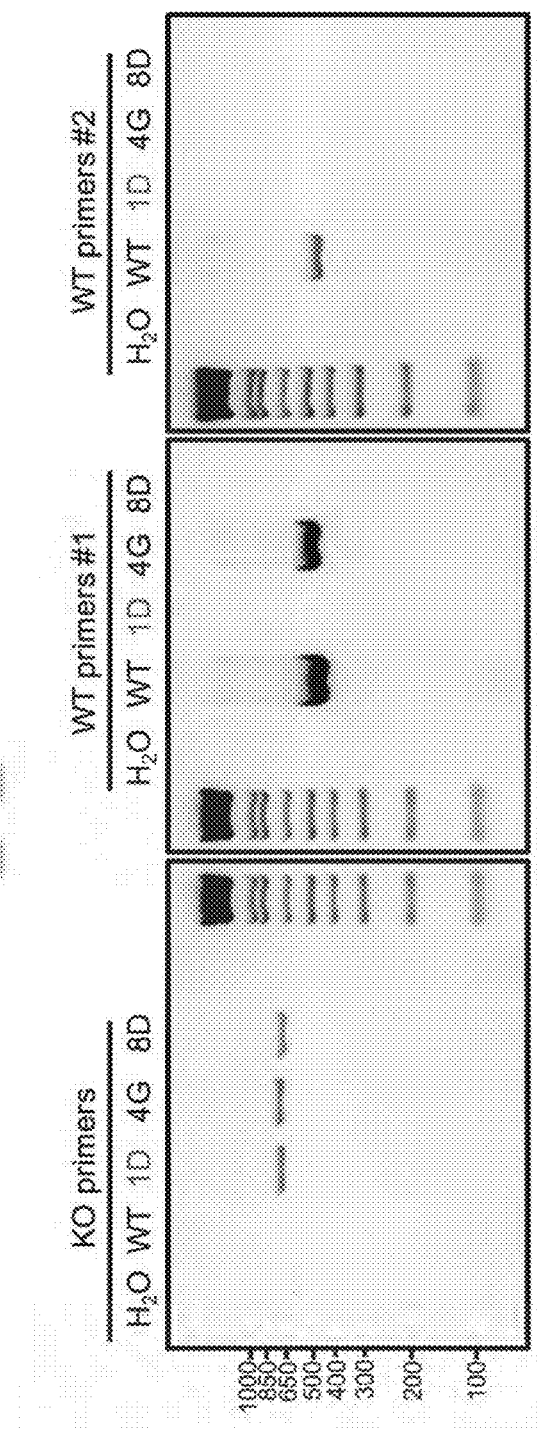
FIG. 14B

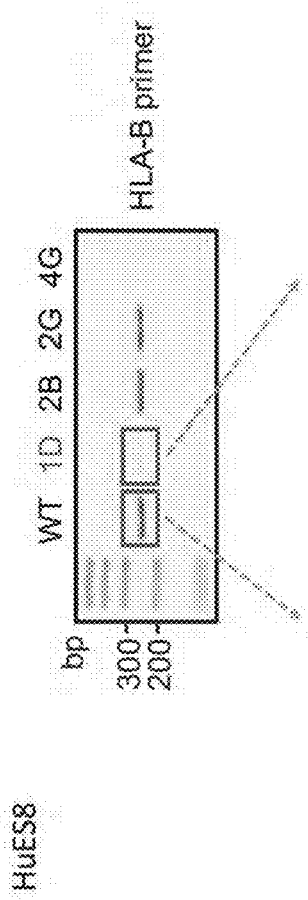

CRISPR sgRNA sequences:

sgRNA #5: AGGGCAAGTGGGAGGCGGC  SEQ ID NO: 818017
sgRNA #6: CGGCTCGTGGGCTGCATGTG  SEQ ID NO: 818018

Targeting of HuES9

NLRC5 mutations, HuES-9

| | | |
|---|---|---|
| 1F5 Δ4 | CCAGCGCTGCAGCC-----CCAAAGACCCAGAATGGCTGA | SEQ ID NO: 818058 |
| 2G7 Δ8 | CCAGCGCTGCAGCC--------AAAGACCCAGAATGGCTGA | SEQ ID NO: 818059 |
| 3E7 Δ26 | CCAG-----------------------------ACCCAGAATGGCTGA | SEQ ID NO: 818060 |
| 3F7 in1 | CCAGCGCTGCAGCCTGCAGCCCAAAGACCCAGAATGGCTGA | SEQ ID NO: 818061 |

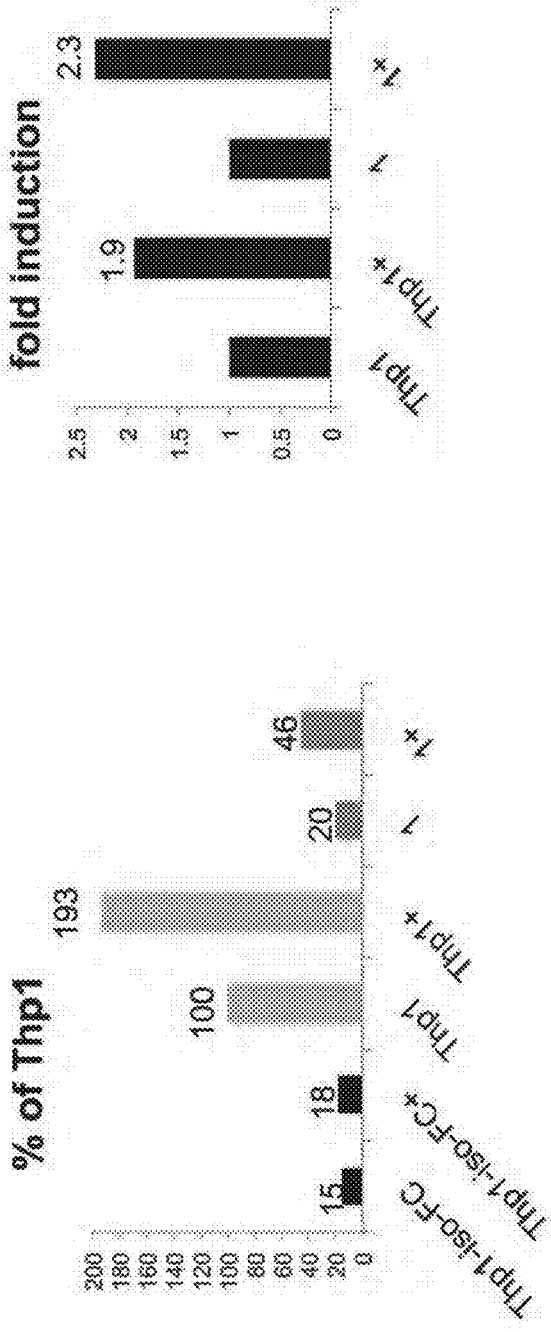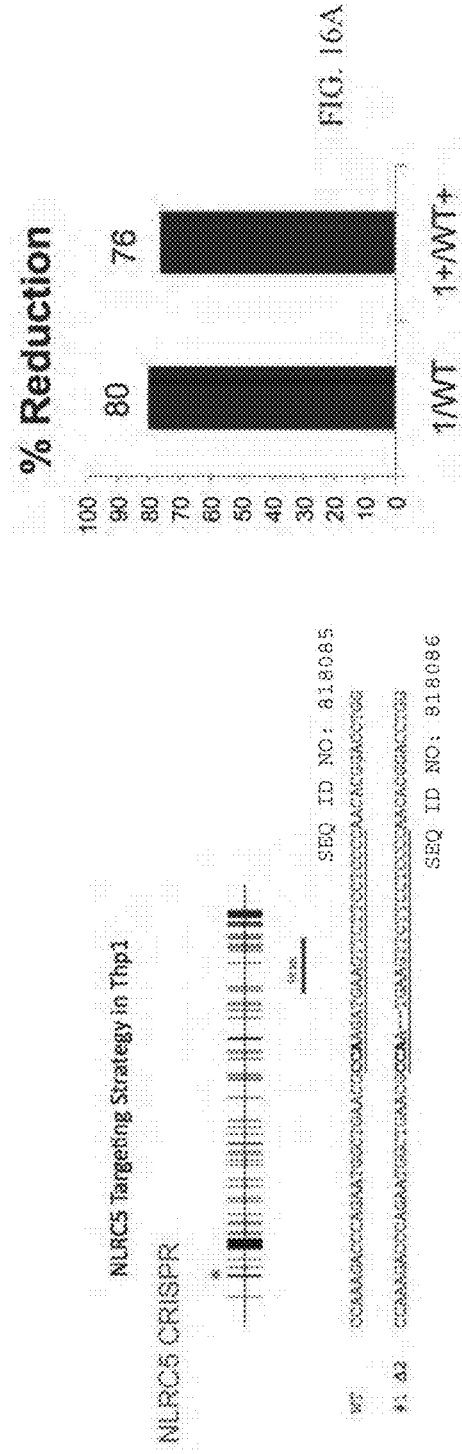
FIG. 16A

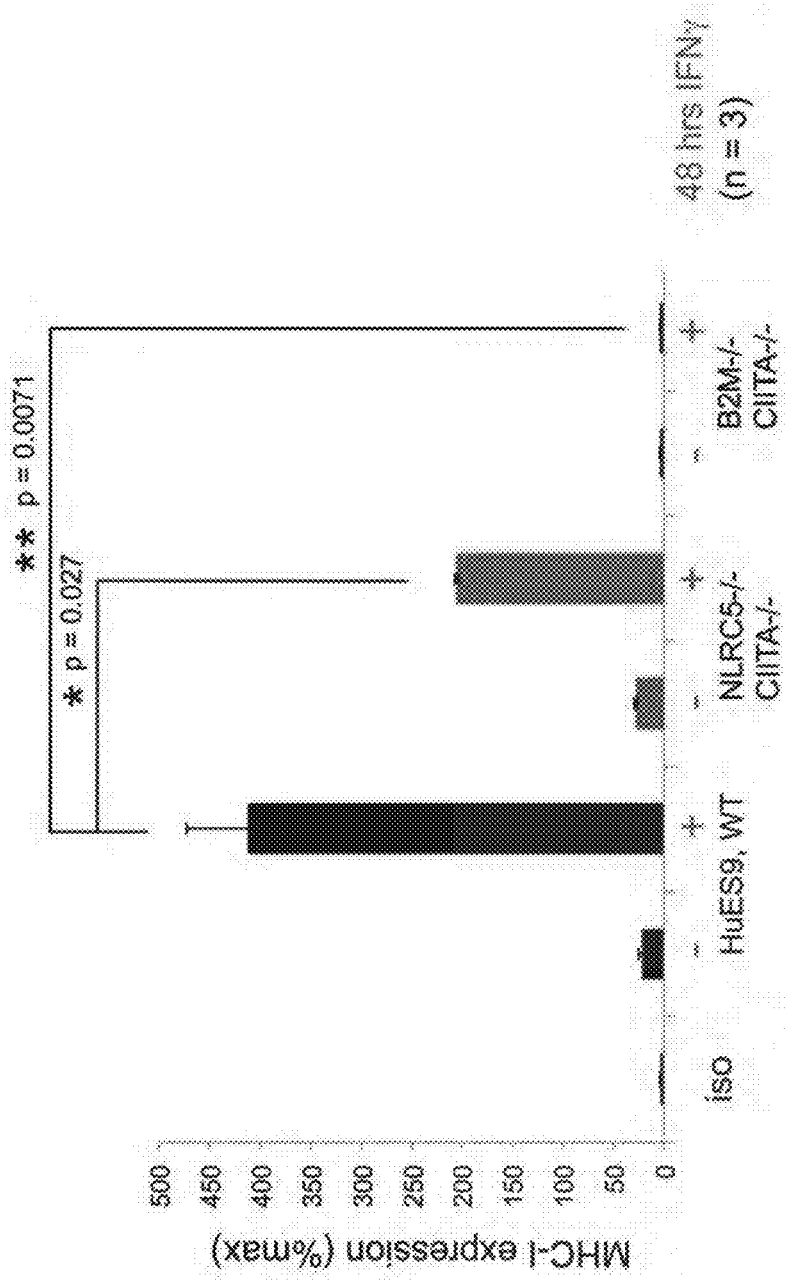

CRISPRs used for Lentiviral Transduction of Thp-1

CIITA
GGTCCATCTGGTCATAGAAG(TGG)  SEQ ID NO: 818103

NLRC5
CR1
GATGTCCAGGGTTCGGACACC(TGG)  SEQ ID NO: 818104
CR2
GATGAGGCCCTCCAGCCTAT(GGG)  SEQ ID NO: 818105

IRF1
CR1
GATGCCTGTTTGTTCCGGAGC  SEQ ID NO: 818106
CR2
GAGATGATCTTCCAGATCCCA  SEQ ID NO: 818107
CR3
GCTCGGATGGCATGAGACCC  SEQ ID NO: 818108

FIG. 16E

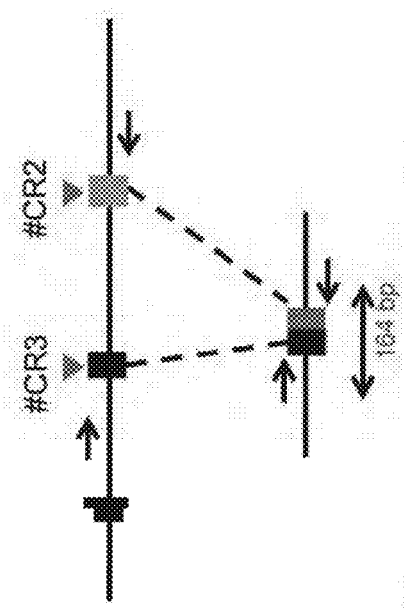
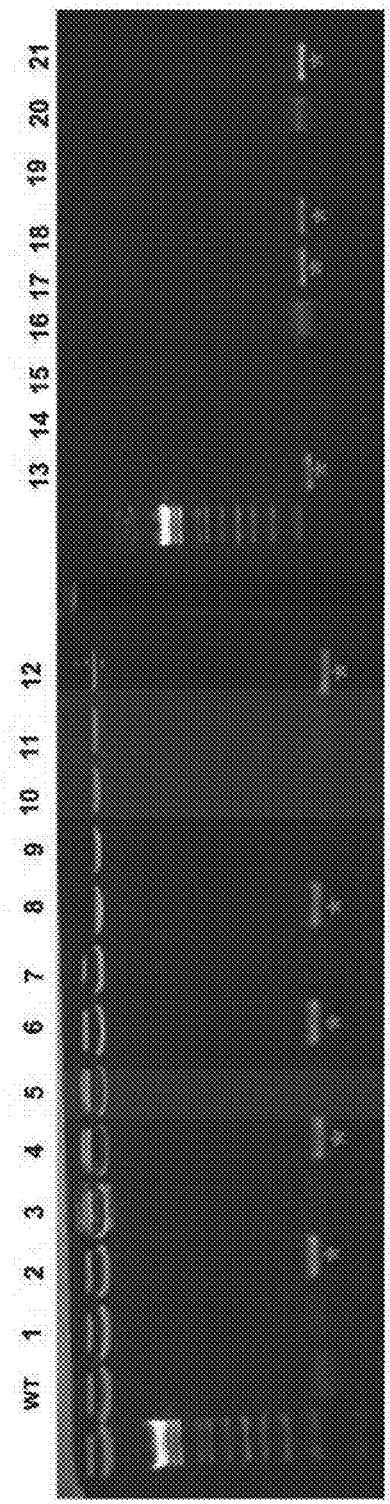
FIG. 17F

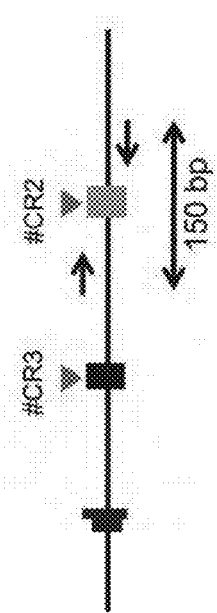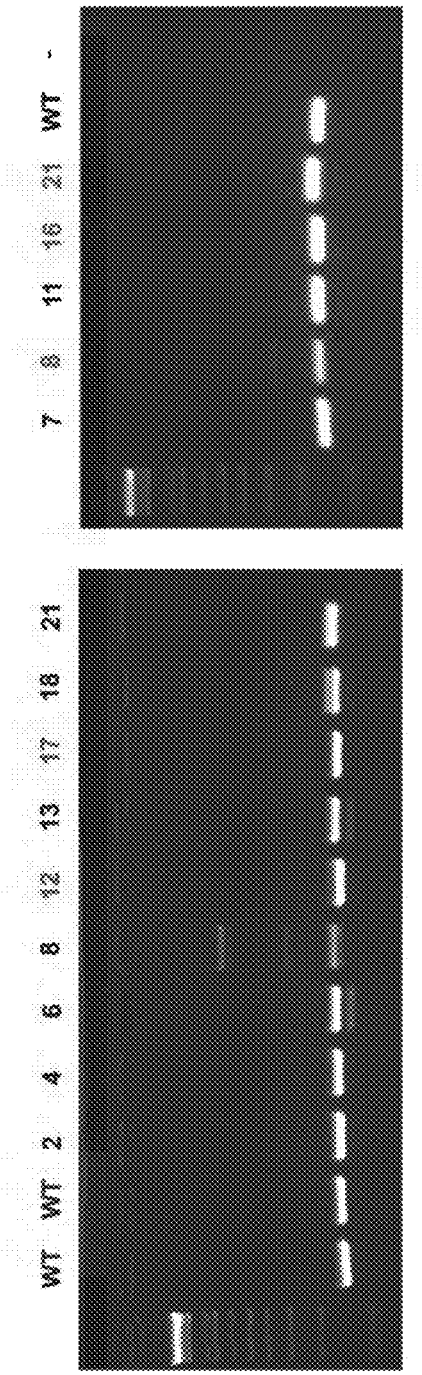
FIG. 17G

SEQ ID NO: 818124 CRISPR Pair #1: GTCTTGGGGCTCTTAGCATC
SEQ ID NO: 818125 CRISPR Pair #2: ACCCTTCTTCAGAGGCTCCG
SEQ ID NO: 818126 CRISPR Pair #3: GGGCTAGAATTGAGAGGGAC
SEQ ID NO: 818127 CRISPR Pair #4: GGAGTGCCTGGGGCCTTCT

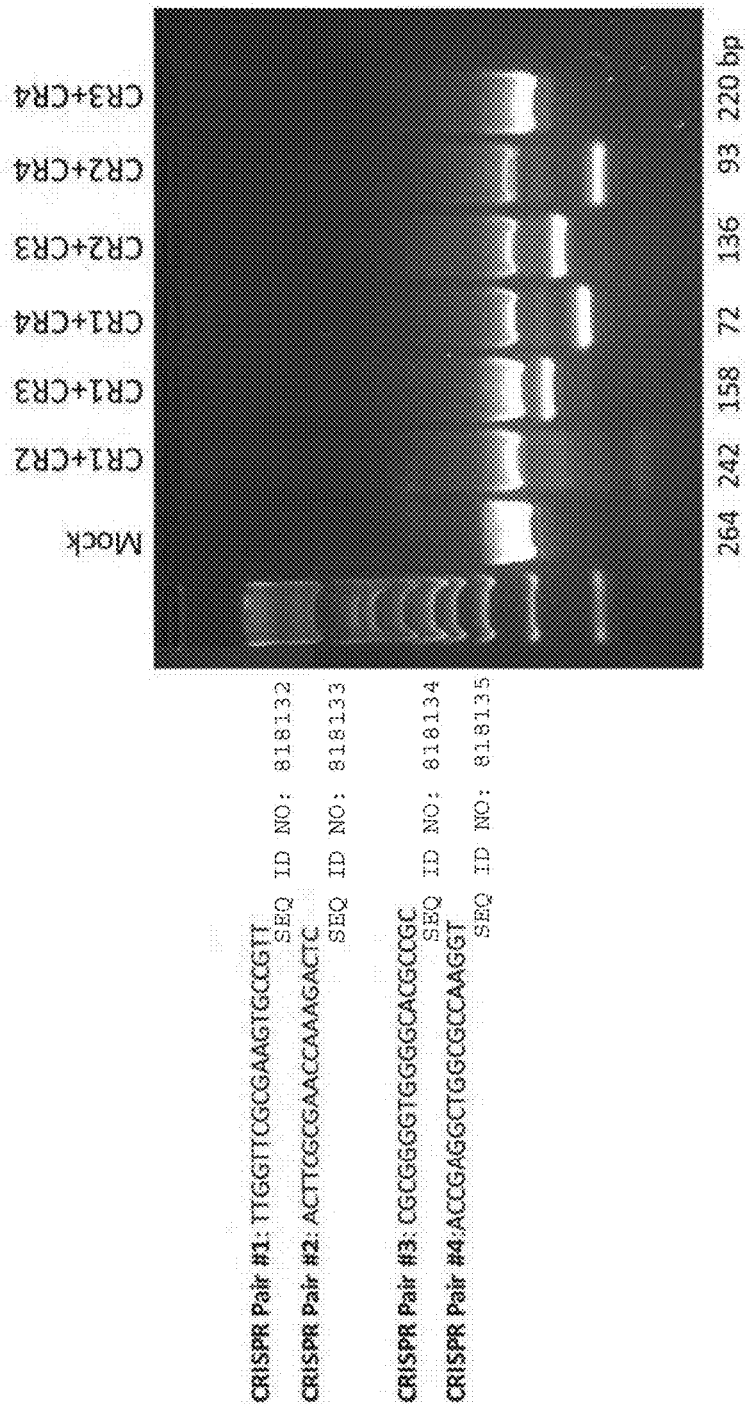

FIG. 21A

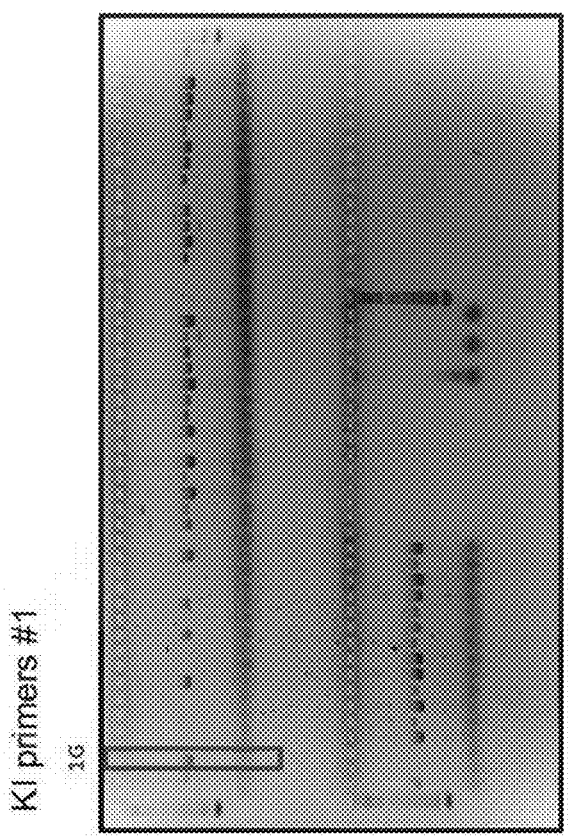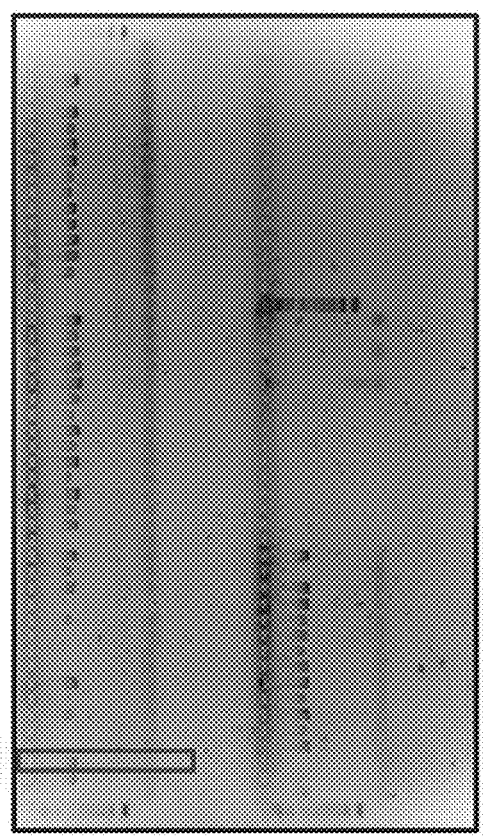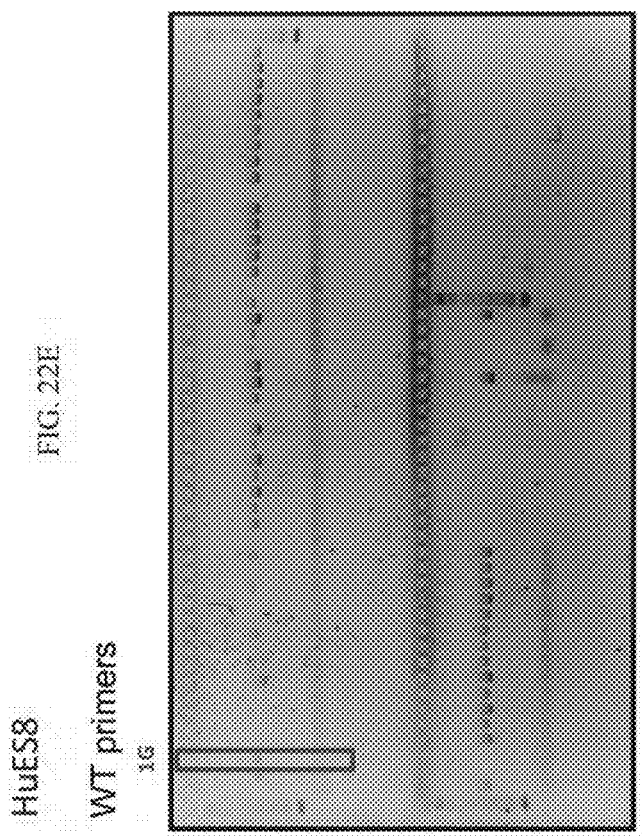
FIG. 22E
PCR screening confirms 1G as a heterozygous KI clone for PD-L1/HLA-G

Deletion of TRAC and TRBC in HuES9 to disrupt TCR Expression

|  | TCRA |  | TCRB |
|---|---|---|---|
|  | HuES9 | B2M-/-CIITA-/- | HuES9 |

TRAC          SEQ ID NO: 818164
CR1 AGACAACAGTGCTGTGGCC(TGG)
CR2 TGGAATAATGCTGTTGTTGA(AGG)
              SEQ ID NO: 818165

TRBC          SEQ ID NO: 818166
CR1 CGCTGTCAAGTCAGTTCTA(CGG)
CR2 GGCTCTCGGAGAATGACGAG(TGG)
              SEQ ID NO: 818167

**TCRA KO in HuES9
*TCRB KO in HuES9

***TCRA KO in HuES9 B2M-/- CIITA-/-. In fact this is now a triple knock-out stem cell line for B2M-/-, CIITA-/-, TCR-/-, which upon differentiation into T cells will be devoid of MHC-I and –II and no TCR surface expression; the perfect blank canvas for introducing a Chimeric Antigen Receptor (CAR). Additional modifications such as deletion of the inhibitory receptors PD-1 and CTLA4, will make this cells powerful tools for cancer immunotherapy.

CRISPR gGTAGAAAACAATTAGACC(TGG) SEQ ID NO: 818168

KO in JEG-3, a choriocarcinoma cell line and in 2 melanoma cell lines, 501 and MalMe.

CRISPRs targeting PD-L1 are very useful in breaking tolerance in cancer immunotherapy!

FIG. 25A

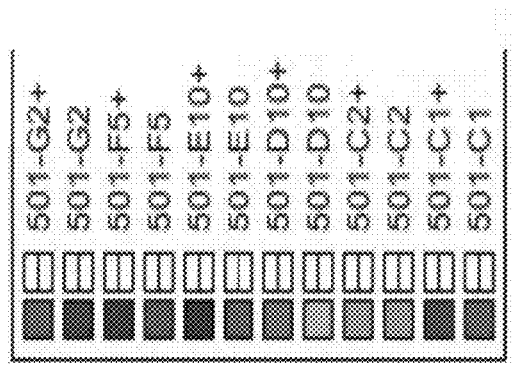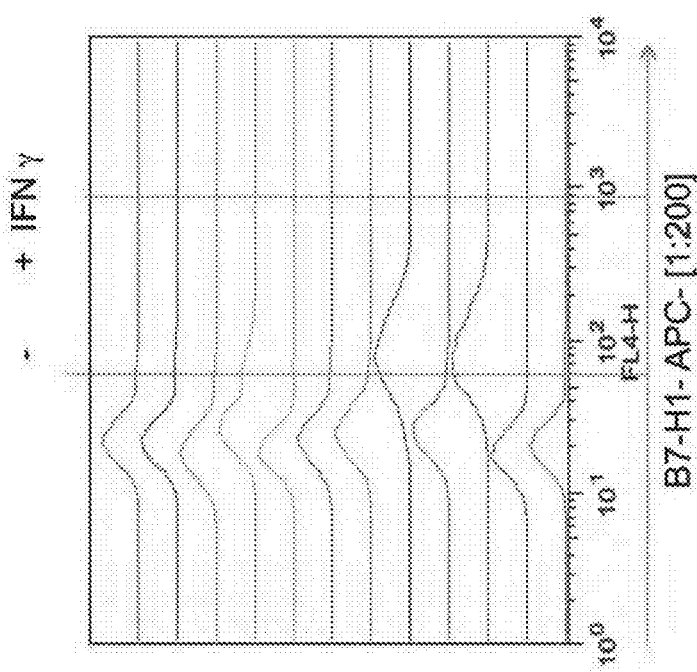
FIG. 25C

Dual Guide Targeting of OX40 in 293T Cells

CR 1, 2 and 4 work!!!

SEQ ID NO: 818189  CRISPR #1: CCTTGCGGGGTGTGGCTATA
SEQ ID NO: 818190  CRISPR #2: TGGGGCTGAGCACCGTGACG
SEQ ID NO: 818191  CRISPR #3: GCAGAGCCGCACACGGCCG
SEQ ID NO: 818192  CRISPR #4: TCTCTGCTGTCGCCAGAGTC

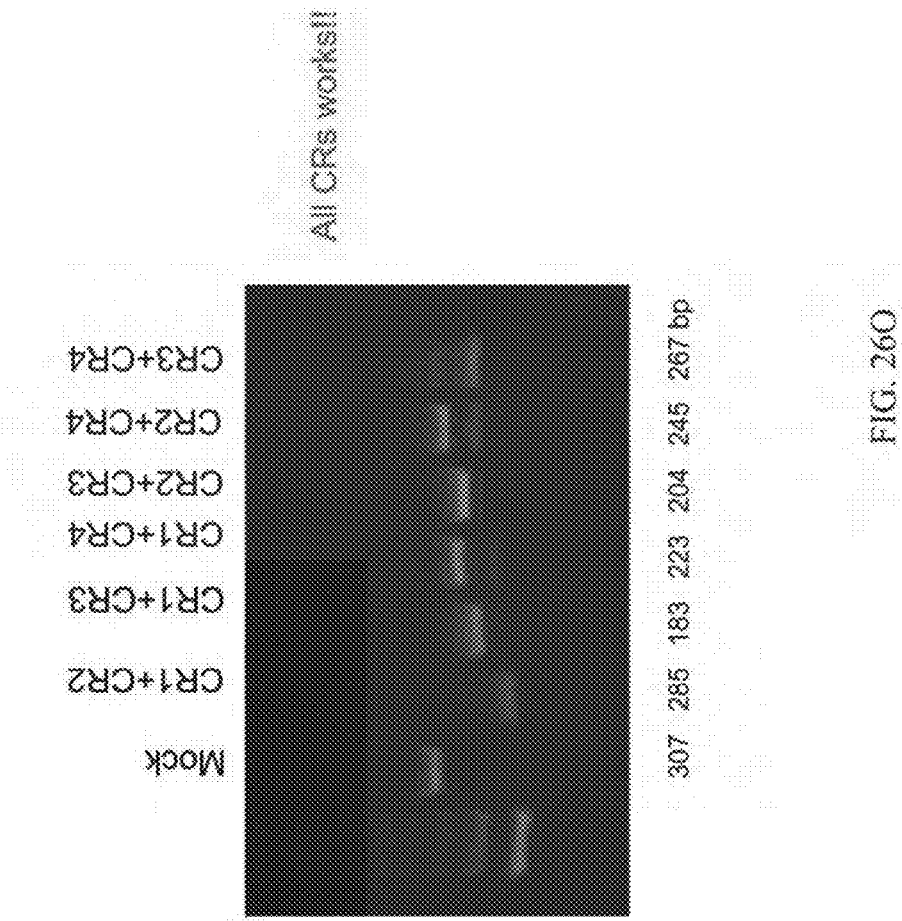

Various Cell Lines Tested

| | HLA-A | HLA-B/C | NLRC5 | CIITA | B2M | IRF1 |
|---|---|---|---|---|---|---|
| HuES8 | + | + | | | | |
| HuES9 | | | + | | + | + |
| BJ-RiPSCs | | | + | + | | |
| Thp1 | | | | + | + | + |
| Jurkat | | | | | + | + |
| Primary T cells | + | | | + | + | + |
| HEK293T | + | | | | | |

HuES8 and HuES9 are human ES cell lines
BJ-RiPSCs is an iPSC line

All other enhanceosome components (RFX and NFY) were only tested in HEK293T cells at this point

FIG. 27

Modified ES cells can be differentiated into various different cell types with reduced or absent HLA expression MPCs = Mesenchymal Progenitor Cells [Mesoderm]
ECs = Endothelial cells [Mesoderm]
Macrophages [Mesoderm]

Hepatocytes [Endoderm]
Beta-Cells [Endoderm]

NPCs = Neural progenitor cells [Ectoderm]

Representatives of all three germ layers

FIG. 28A

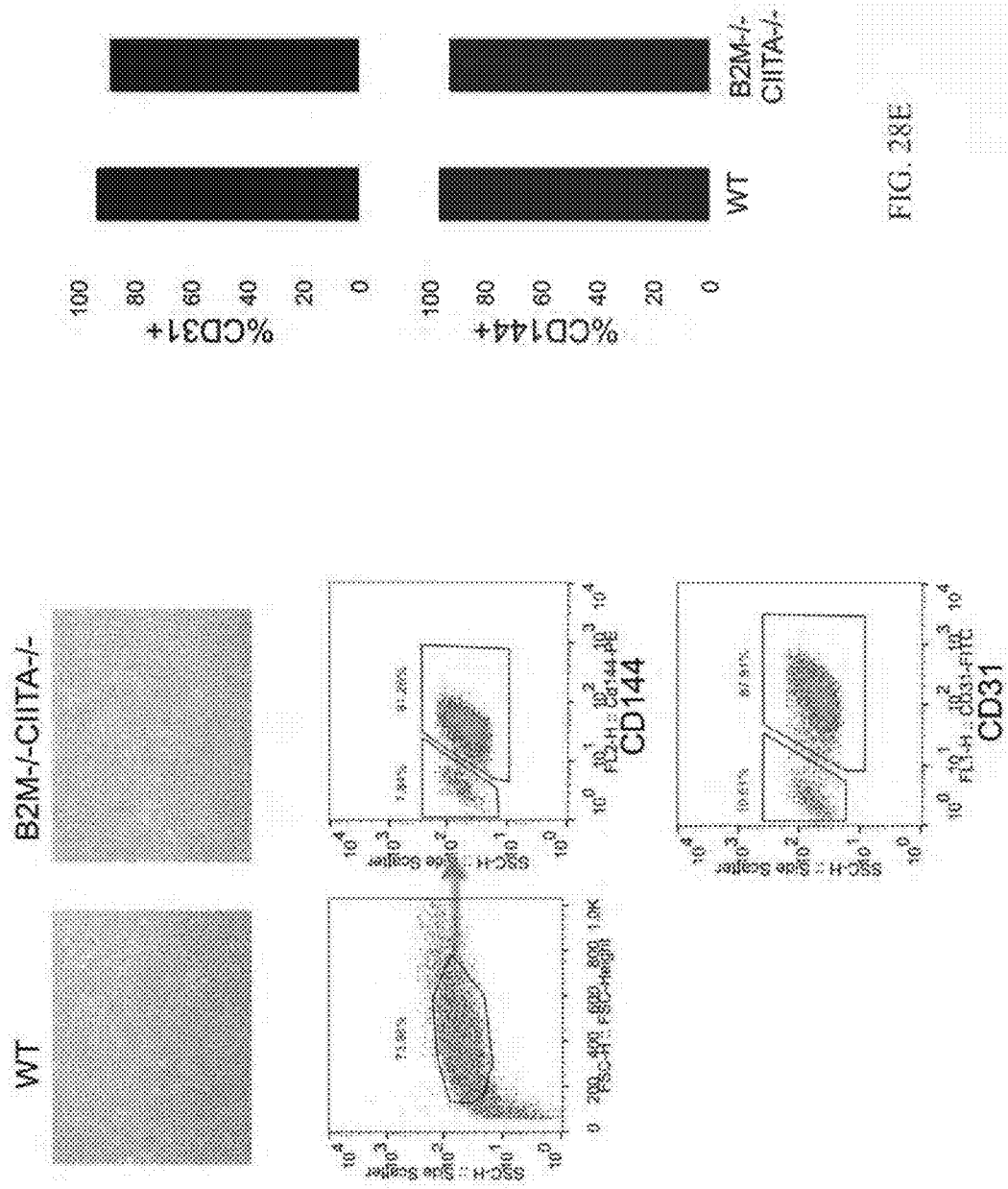

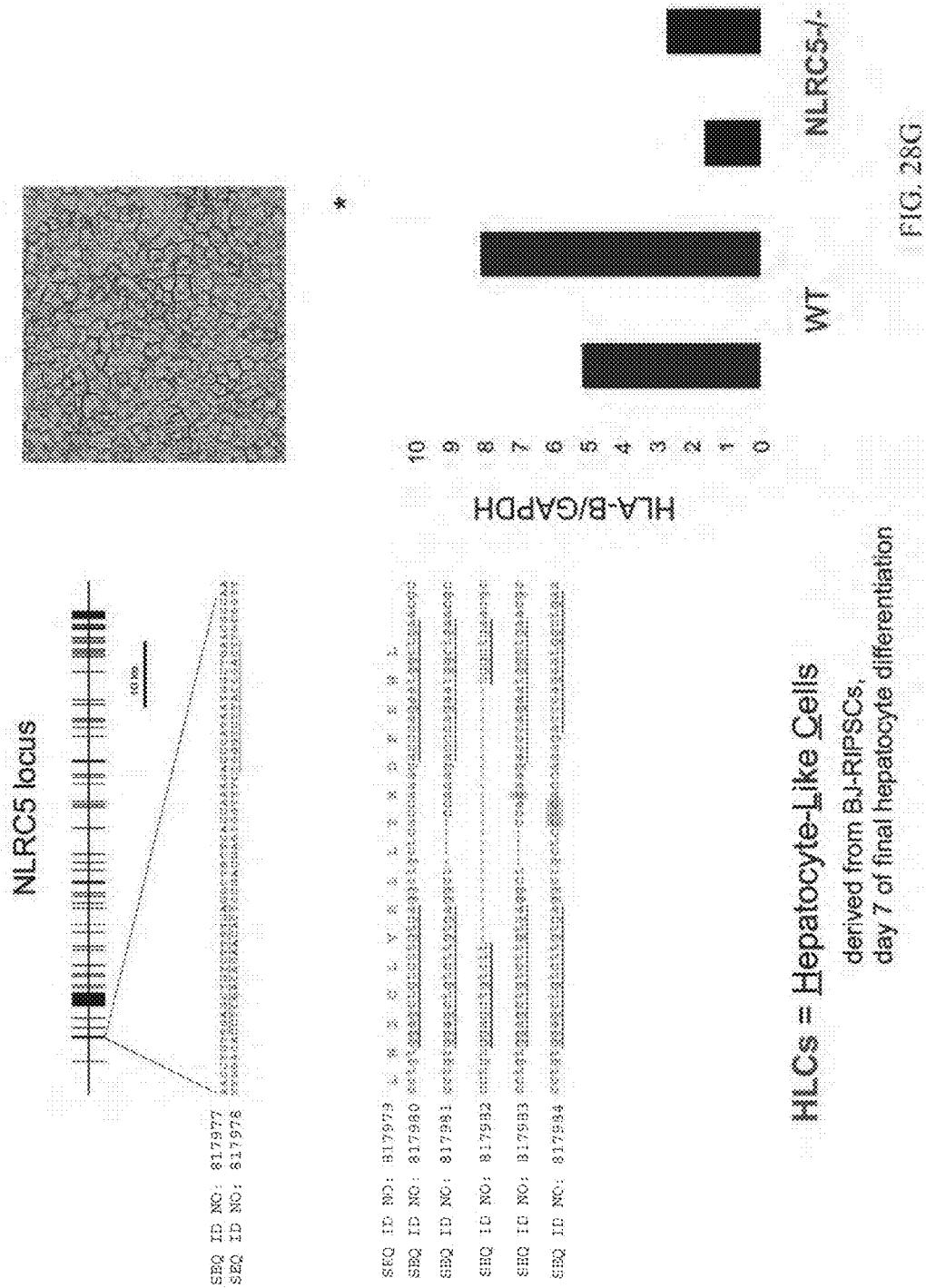

'Hypoimmunogenic' DKO Cell Lines Generated

| HuES9 | MHC-I | MHC-II |
|---|---|---|
| WT | yes | yes |
| NLRC5-/- C2TA-/- | reduced | no |
| B2M-/- C2TA-/- | no | no |

FIG. 29A

CRISPR Targeting of B7-H3 in JEG-3 cells

GCTGACAGATACCAAACAGC (TGG)  SEQ ID NO: 818229

FIG. 30A

| | | |
|---|---|---|
| WT | CACAGCTCAACCTCATCTGGCAGCTGACAGATACCAAACAGCTGGTGCACAGCTTT | SEQ ID NO: 818230 |
| C11 Δ16 | CACAGCTCAACCTNATCTGGCAG----------------AGCTGGTGCACAGCTTT | SEQ ID NO: 818231 |
| G6 Δ26 | CACAGCTCAACCTCATCTGG----TG-C----------------ACAG-----TTT | SEQ ID NO: 818232 |

FIG. 34A
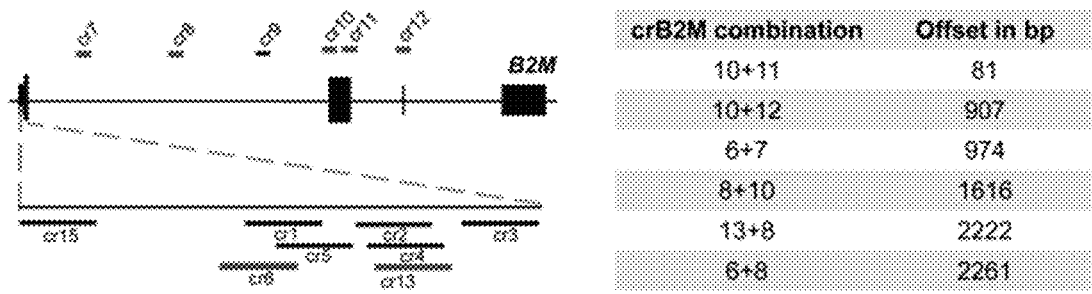
FIG. 34B
FIG. 34C
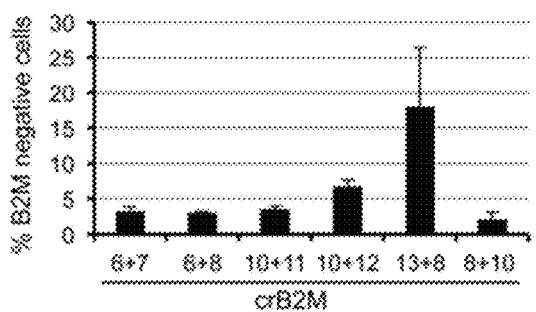
FIG. 34D
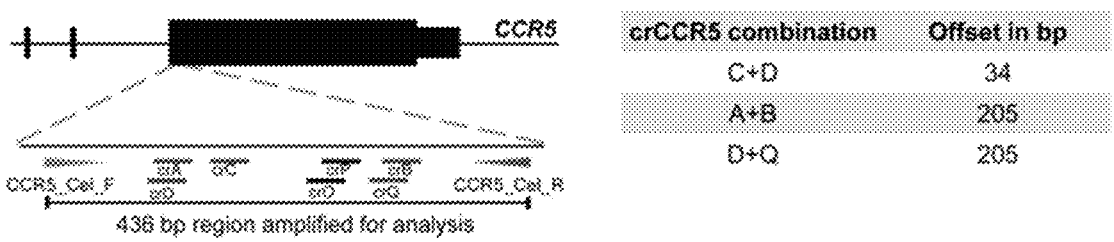
FIG. 34E
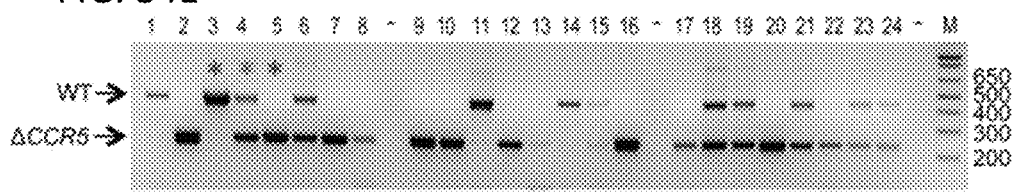

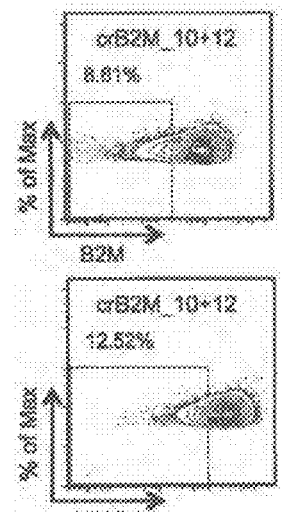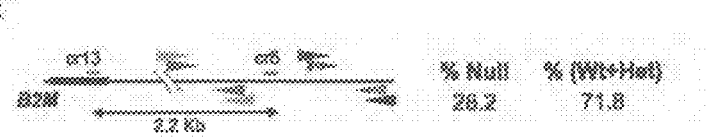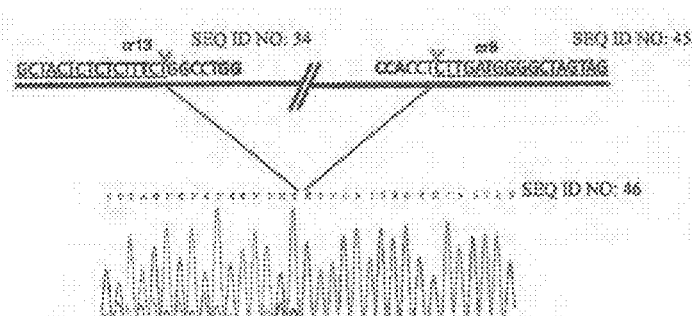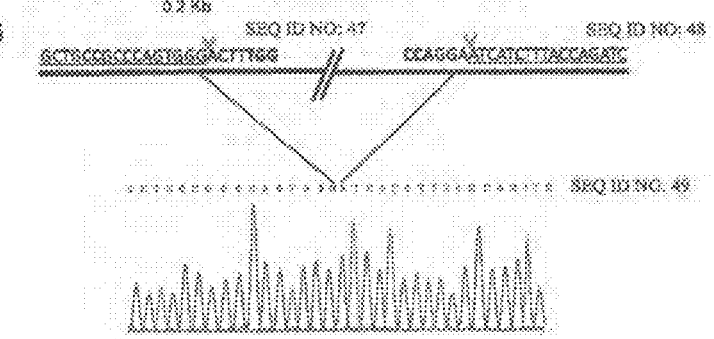
FIGS. 35A-35G

Cpf1 crRNA design and cloning

Express guides (crRNAs) as U6 promoter-direct repeat seq – 20 nt guide PCR product Fw primer (binding U6 promoter)
GAGGGCCTATTTCCCATGATTCCT (24 nt) (SEQ ID NO: 42546)

Rev primers: rev comp target seq (20 nt)-rev comp direct repeat seq-rev comp and U6 P Rev primer example: AsCpf1 DNMT1 GUIDE 4 (63 nt)
CTTTATTTAGTGAGGTAAACAATCTACACTTAGTAGAAATTACCCTATAGTGAGTCGTATTACAA
(SEQ ID NO: 42547)

Cells transfected with Cpf1 DNA (either As or Lb) and crRNA PCR product generated using Lentiguide-puro plasmid as template (for hU6 promoter) and guide specific reverse primers

FIG. 39

Design of B2M TALEN and induced mutations
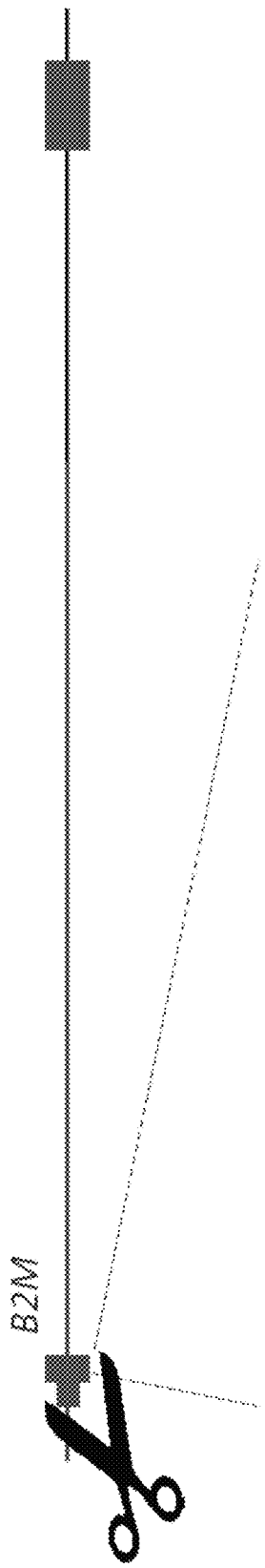
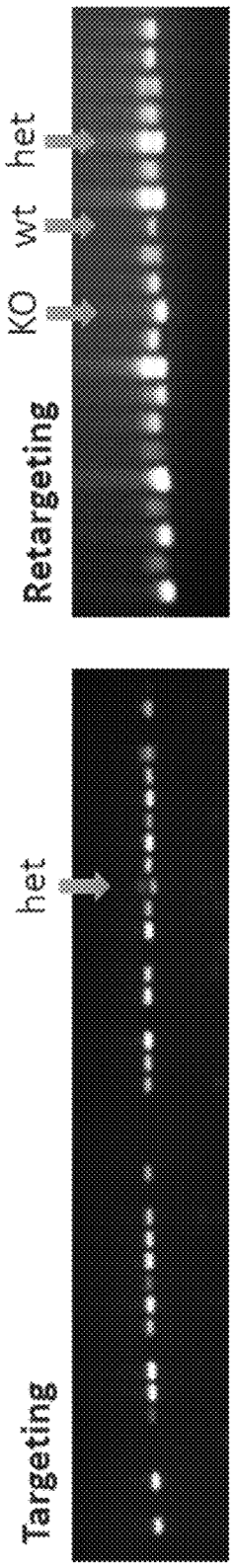
FIG. 40A

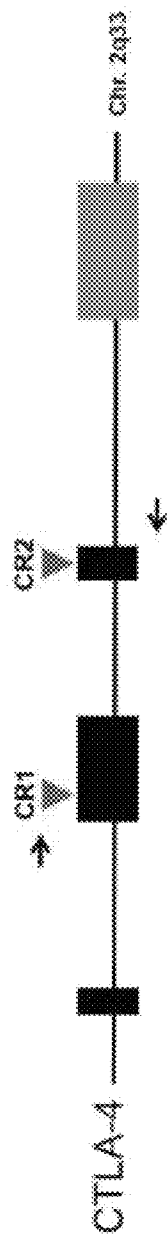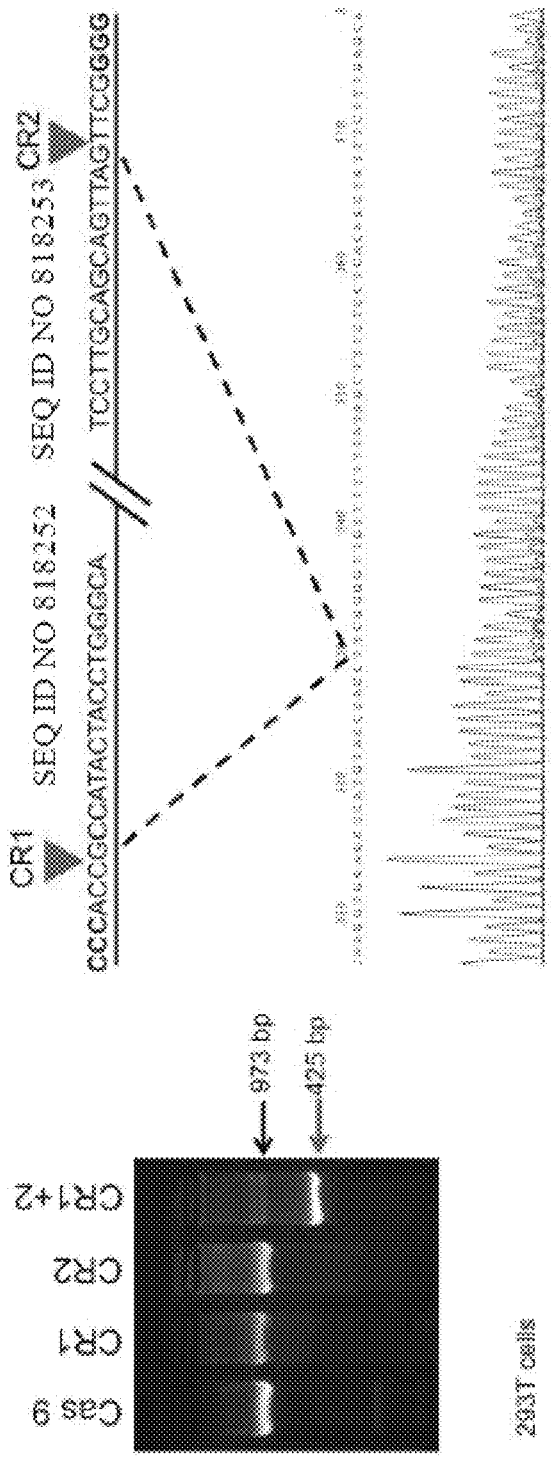
FIG. 46A
FIG. 46B
FIG. 46C

UNIVERSAL DONOR STEM CELLS AND RELATED METHODS

CROSS-REFERENCE TO RELATED APPLICATIONS

This application is a continuation application of U.S. application Ser. No. 17/148,556, filed Jan. 13, 2021, which is a divisional application of U.S. application Ser. No. 15/572,776, filed Nov. 8, 2017, which is a national stage filing under 35 U.S.C. 371 of International Application No. PCT/US2016/031551, filed May 9, 2016, which claims the benefit of U.S. Provisional Application No. 62/158,999, filed on May 8, 2015, the contents of which are hereby incorporated by reference in its entirety. International Application No. PCT/US2016/031551 was published under PCT Article 21(2) in English.

BACKGROUND OF THE INVENTION

Degenerative diseases pose a disproportionate threat to human health. Often age-related, these diseases result in the progressive deterioration of affected tissues and organs and, ultimately, disability and death of the affected subject. The promise of regenerative medicine is to replace diseased or missing cells with new healthy cells. Over the past five years, a new paradigm for regenerative medicine has emerged—the use of human pluripotent stem cells (hPSCs) to generate any adult cell type for transplantation into patients. In principle, hPSC-based cell therapies have the potential to treat most if not all degenerative illnesses, however the success of such therapies may be limited by a subject's immune response.

Strategies that have been considered to overcome the immune rejection include HLA-matching (e.g. identical twin or umbilical cord banking), the administration of immunosuppressive drugs to the subject, blocking antibodies, bone marrow suppression/mixed chimerism, HLA-matched stem cell respositories and autologous stem cell therapy. Needed are novel approaches, compositions and methods for overcoming immune rejection associated with cell replacement therapies.

SUMMARY OF THE INVENTION

Disclosed herein are efficient strategies to overcome immune rejection in cell-based transplantation therapies by the creation of universal donor stem cell lines that, as quality-controlled cell-based products, will form the base for regenerative cell therapies.

The present inventors have successfully employed genome editing tools such as a TALEN and/or CRISPR system in human pluripotent stem cells to reduce expression or knock out the highly polymorphic classical MHC-I genes (HLA-A, HLA-B and HLA-C) and/or MHC-II genes. In certain aspects, such reduced expression or knock out of the MHC-I and/or MHC-II genes is accomplished by directly and/or indirectly targeting the NLRC5, B2M and CIITA genes and other components of the MHC enhanceosome (e.g., transcriptional regulators of MHC-I or MHC-II).

Disclosed herein are methods of preparing hypoimmunogenic stem cells, the method comprising modulating expression of one or more MHC-I and MHC-II human leukocyte antigens by the stem cell and thereby preparing the hypoimmunogenic stem cell. Also disclosed are methods of modulating expression of one or more MHC-I and MHC-II human leukocyte antigens by a stem cell, comprising deleting one or more genes encoding one or more transcriptional regulators of MHC-I or MHC-II from at least one allele of the cell and thereby modulating expression of the one or more MHC-I and MHC-II human leukocyte antigens.

In certain aspects, modulating expression of the one or more MHC-I and MHC-II human leukocyte antigens comprises reducing, inhibiting and/or interfering with the expression of the one or more MHC-I and MHC-II human leukocyte antigens. In certain embodiments, modulating expression of the one or more MHC-I and MHC-II human leukocyte antigens comprises deleting one or more genes encoding one or more transcriptional regulators of MHC-I or MHC-II from at least one allele of the cell. For example, in certain embodiments such methods comprise deleting one or more genes encoding one or more of the transcriptional regulators of MHC-I or MHC-II selected from the group consisting of NLRC5, CIITA, B2M and combinations thereof.

In certain aspects, the methods disclosed herein further comprise modulating expression of one or more tolerogenic factors by the stem cell. Modulating expression of the tolerogenic factors may comprises increasing the expression of the tolerogenic factors. Such tolerogenic factors may be inserted into a safe harbor locus (e.g., the AAVS1 locus) of at least one allele of the cell. In certain embodiments, such tolerogenic factors inhibit immune rejection. In certain embodiments, such tolerogenic factors are selected from the group consisting of HLA-C, HLA-E, HLA-G, PD-L1, CTLA-4-Ig, CD47, C1-inhibitor, and IL-35.

Also disclosed herein are methods of preparing a hypoimmunogenic stem cell, the method comprising modulating expression of one or more tolerogenic factors by the stem cell and thereby preparing the hypoimmunogenic stem cell. In certain embodiments, modulating expression of the tolerogenic factors comprises increasing the expression of the tolerogenic factors. Such tolerogenic factors may be inserted into a safe harbor locus (e.g., the AAVS1 locus) of at least one allele of the cell. In certain embodiments, such tolerogenic factors are selected from the group consisting of HLA-C, HLA-E, HLA-G, PD-L1, CTLA-4-Ig, CD47, C1-inhibitor, and IL-35. In certain embodiments, such tolerogenic factors inhibit immune rejection of the stem cell or of a differentiated stem cell prepared therefrom.

In certain aspects, the methods disclosed further comprise modulating expression of one or more MHC-I and MHC-II human leukocyte antigens by the cell, for example, by deleting one or more genes encoding one or more transcriptional regulators of MHC-I or MHC-II from at least one allele of the cell. In certain embodiments, transcriptional regulators of MHC-I or MHC-II from are selected from the group consisting of NLRC5, CIITA, B2M and combinations thereof.

Also disclosed herein are human stem cells that do not express NLRC5 (e.g., a NLRC5$^{-/-}$ knockout mutant stem cell). Similarly, also disclosed are human stem cells that do not express CIITA (e.g., a CITTA$^{-/-}$ knockout mutant stem cell). Also disclosed are human stem cells that do not express B2M (e.g., a B2M$^{-/-}$ knockout mutant stem cell). In certain embodiments, also provided are human stem cells that do not express one or more of NLRC5, CIITA and B2M. In still other embodiments, also disclosed are human stem cells that do not express one or more of HLA-A, HLA-B and HLA-C.

In certain embodiments, the stem cells disclosed herein expresses one or more tolerogenic factors (e.g., one or more tolerogenic factors that inhibit immune rejection). In certain aspects, such tolerogenic factors are inserted into a safe harbor locus (e.g., the AAVS1 locus) of at least one allele of the cell. In certain embodiments, the tolerogenic factors are selected from the group consisting of HLA-C, HLA-E, HLA-G, PD-L1, CTLA-4-Ig, CD47, C1-inhibitor, and IL-35.

In some embodiments, the cell is an embryonic stem cell. In certain embodiments, the cell is a pluripotent stem cell. In certain embodiments, the stem cell is hypoimmunogenic.

In some embodiments, the cell has reduced MHC-I expression relative to the original genotype or relative to a wild-type human stem cell. In certain embodiments, the cell has reduced MHC-II expression relative to the original genotype or relative to a wild-type human stem cell. For example, such cells may have reduced expression of one or more of HLA-A, HLA-B and HLA-C relative to the original genotype or relative to a wild-type human stem cell.

Also disclosed herein are human stem cells that have been altered such that they comprise one or more tolerogenic factors inserted into a safe harbor locus (e.g., the AAVS1 locus) of at least one allele of the cell. In certain embodiments, such tolerogenic factors inhibit immune rejection. In certain embodiments, the tolerogenic factors are selected from the group consisting of HLA-C, HLA-E, HLA-G, PD-L1, CTLA-4-Ig, CD47, C1-inhibitor, and IL-35. In certain aspects, such cells do not express one or more of NLRC5, CIITA and B2M. In certain aspects, such cells do not express one or more of HLA-A, HLA-B and HLA-C. In certain embodiments, such cells have reduced expression of one or more of HLA-A, HLA-B and HLA-C relative to a wild-type human stem cell.

Also disclosed herein are methods of using the hypoimmunogenic cells disclosed herein for cell replacement therapy. For example, the universal stem cells disclosed herein may be incubated under appropriate conditions and differentiated into hypoimmunogenic cardiomyocytes, endothelial cells, hepatocytes or pancreatic beta cells.

Also disclosed herein are methods for producing hypoimmunogenic stem cells, the method comprising contacting a stem cell with a Cas protein or a nucleic acid sequence encoding the Cas protein and a first pair of ribonucleic acids having sequences selected from the group consisting of SEQ ID NOs: 36353-81239, thereby editing the NLRC5 gene to reduce or eliminate NLRC5 surface expression and/or activity in the cell.

Also disclosed are methods for producing hypoimmunogenic stem cells, the method comprising contacting a stem cell with a Cas protein or a nucleic acid sequence encoding the Cas protein and a first pair of ribonucleic acids having sequences selected from the group consisting of SEQ ID NOs: 5184-36352, thereby editing the CIITA gene to reduce or eliminate CIITA surface expression and/or activity in the cell.

Also disclosed are methods for producing hypoimmunogenic stem cells, the method comprising contacting a stem cell with a Cas protein or a nucleic acid sequence encoding the Cas protein and a first pair of ribonucleic acids having sequences selected from the group consisting of SEQ ID NOs: 81240-85644, thereby editing the B2M gene to reduce or eliminate B2M surface expression and/or activity in the cell.

Also disclosed are methods for producing a hypo-immunogenic stem cell, the method comprising: (a) contacting a stem cell with a Cas protein or a nucleic acid sequence encoding the Cas protein and a first pair of ribonucleic acids having sequences selected from the group consisting of SEQ ID NOs: 36353-81239, thereby editing the NLRC5 gene to reduce or eliminate NLRC5 surface expression and/or activity in the cell; (b) contacting a stem cell with a Cas protein or a nucleic acid sequence encoding the Cas protein and a second pair of ribonucleic acids having sequences selected from the group consisting of SEQ ID NOs: 5184-36352, thereby editing the CIITA gene to reduce or eliminate CIITA surface expression and/or activity in the cell; and/or (c) contacting a stem cell with a Cas protein or a nucleic acid sequence encoding the Cas protein and a third pair of ribonucleic acids having sequences selected from the group consisting of SEQ ID NOs: 81240-85644, thereby editing the B2M gene to reduce or eliminate B2M surface expression and/or activity in the cell.

Also disclosed are methods for producing hypoimmunogenic stem cells, the method comprising contacting a stem cell with a Cas protein or a nucleic acid sequence encoding the Cas protein and a first ribonucleic acid having a sequence selected from the group consisting of SEQ ID NOs: 36353-81239, thereby editing the NLRC5 gene to reduce or eliminate NLRC5 surface expression and/or activity in the cell.

Also disclosed are methods for producing hypoimmunogenic stem cells, the method comprising contacting a stem cell with a Cas protein or a nucleic acid sequence encoding the Cas protein and a first ribonucleic acid having a sequence selected from the group consisting of SEQ ID NOs: 5184-36352, thereby editing the CIITA gene to reduce or eliminate CIITA surface expression and/or activity in the cell.

Also disclosed are methods for producing hypoimmunogenic stem cells, the method comprising contacting a stem cell with a Cas protein or a nucleic acid sequence encoding the Cas protein and a first ribonucleic acid having a sequence selected from the group consisting of SEQ ID NOs: 81240-85644, thereby editing the B2M gene to reduce or eliminate B2M surface expression and/or activity in the cell.

Also disclosed herein are methods for producing hypoimmunogenic stem cells, the method comprising: (a) contacting a stem cell with a Cas protein or a nucleic acid sequence encoding the Cas protein and a first ribonucleic acid having a sequence selected from the group consisting of SEQ ID NOs: 36353-81239, thereby editing the NLRC5 gene to reduce or eliminate NLRC5 surface expression and/or activity in the cell; (b) contacting a stem cell with a Cas protein or a nucleic acid sequence encoding the Cas protein and a second ribonucleic acid having a sequence selected from the group consisting of SEQ ID NOs: 5184-36352, thereby editing the CIITA gene to reduce or eliminate CIITA surface expression and/or activity in the cell; and/or (c) contacting a stem cell with a Cas protein or a nucleic acid sequence encoding the Cas protein and a third ribonucleic acid having a sequence selected from the group consisting of SEQ ID NOs: 81240-85644, thereby editing the B2M gene to reduce or eliminate B2M surface expression and/or activity in the cell.

Also disclosed herein are hypoimmunogenic stem cells comprising a modified genome comprising a first genomic modification in which the NLRC5 gene has been edited to reduce or eliminate NLRC5 surface expression and/or activity in the cell by contacting the cell with a Cas protein or a nucleic acid encoding a Cas protein and a ribonucleic acid having a sequence selected from the group consisting of SEQ ID NOs: 36353-81239.

Also disclosed are hypoimmunogenic stem cells comprising a modified genome comprising a first genomic modification in which the CIITA gene has been edited to reduce or eliminate CIITA surface expression and/or activity in the cell by contacting the cell with a Cas protein or a nucleic acid encoding a Cas protein and a ribonucleic acid having a sequence selected from the group consisting of SEQ ID NOs: 5184-36352.

Also disclosed are hypoimmunogenic stem cells comprising a modified genome comprising a first genomic modification in which the B2M gene has been edited to reduce or eliminate B2M surface expression and/or activity in the cell by contacting the cell with a Cas protein or a nucleic acid encoding a Cas protein and a ribonucleic acid having a sequence selected from the group consisting of SEQ ID NOs: 81240-85644.

Also disclosed herein are hypoimmunogenic stem cells comprising a modified genome comprising: (a) a first genomic modification in which the NLRC5 gene has been edited to reduce or eliminate NLRC5 surface expression and/or activity in the cell by contacting the cell with a Cas protein or a nucleic acid encoding a Cas protein and a ribonucleic acid having a sequence selected from the group consisting of SEQ ID NOs: 36353-81239; (b) a second genomic modification in which the CIITA gene has been edited to reduce or eliminate CIITA surface expression and/or activity in the cell by contacting the cell with a Cas protein or a nucleic acid encoding a Cas protein and a ribonucleic acid having a sequence selected from the group consisting of SEQ ID NOs: 5184-36352; and/or (c) a third genomic modification in which the B2M gene has been edited to reduce or eliminate B2M surface expression and/or activity in the cell by contacting the cell with a Cas protein or a nucleic acid encoding a Cas protein and a ribonucleic acid having a sequence selected from the group consisting of SEQ ID NOs: 81240-85644.

Also disclosed are hypoimmunogenic stem cells comprising a modified genome comprising a first genomic modification in which the NLRC5 gene has been edited to delete a first contiguous stretch of genomic DNA, thereby reducing or eliminating NLRC5 surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 36353-81239.

Also disclosed are hypoimmunogenic stem cells comprising a modified genome comprising a first genomic modification in which the CIITA gene has been edited to delete a first contiguous stretch of genomic DNA, thereby reducing or eliminating CIITA surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 5184-36352.

Also disclosed are hypoimmunogenic stem cells comprising a modified genome comprising a first genomic modification in which the B2M gene has been edited to delete a first contiguous stretch of genomic DNA, thereby reducing or eliminating B2M surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 81240-85644.

Also disclosed herein are hypoimmunogenic stem cells comprising a modified genome comprising: (a) a first genomic modification in which the NLRC5 gene has been edited to delete a first contiguous stretch of genomic DNA, thereby reducing or eliminating NLRC5 surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 36353-81239; (b) a second genomic modification in which the CIITA gene has been edited to delete a first contiguous stretch of genomic DNA, thereby reducing or eliminating CIITA surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 5184-36352; and/or (c) a third genomic modification in which the B2M gene has been edited to delete a first contiguous stretch of genomic DNA, thereby reducing or eliminating B2M surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 81240-85644.

The above discussed, and many other features and attendant advantages of the present inventions will become better understood by reference to the following detailed description of the invention.

BRIEF DESCRIPTION OF THE DRAWINGS

FIG. 2A graphically illustrates MHC-I and MHC-II surface molecules that define donor compatibility during organ transplant. FIG. 2B illustrates the HLA region 6p21.1-21.3.

FIG. 3A illustrates a model of the MHC-II enhanceosome. FIG. 3B depicts a model of the NLRC5 enhanceosome at the MHC-I promoter.

FIG. 5A depicts a time line of macrophage differentiation. FIG. 5B shows a bright-field image of stem cell-derived macrophages on day 5 of M-CSF medium. FIG. 5C shows MHC-II expression in induced macrophages, as assessed by qPCR 48 hrs. post stimulation with IFNγ, and evidences reduced MHC-II expression relative to wild-type cells. As illustrated in FIG. 5C, MHC-II expression can be efficiently abrogated by targeting the first coding exon of the CIITA gene depicted in FIGS. 10A-10B.

FIGS. 8A and 8B illustrate immunostaining of teratoma-infiltrating CD3+ lymphocytes. FIG. 8C illustrates co-staining of CD8 and Ki67, which is a proliferation marker, and highlights proliferating CD8+ T cells (white arrows). Nuclear DAPI staining is shown in blue.

FIG. 9A illustrates the NLRC5 locus. FIG. 9B shows targeting of the NLRC5 locus to abrogate NLRC5 expression. FIGS. 9C-9D illustrate reduced MHC-I expression in NLTC5$^{-/-}$ HLCs.

FIG. 10A depicts the CIITA locus. FIG. 10B shows the targeting of the CIITA locus to abrogate MHC-II expression.

FIG. 12 shows an exemplary amino acid sequence of a Cas protein. Yellow highlights indicate Ruv-C-like domain. Underlining indicates HNH nuclease domain.

FIGS. 14A-14J demonstrates the targeting of HLA-A, HLA-B and HLA-C. FIG. 14A depicts an HLA-B and HLA-C knock-out strategy. Two short guide RNAs (sgRNAs) were designed upstream of the HLA-B locus and downstream of HLA-C, which allow excision of the HLA-B and HLA-C genes. sgRNA #1 and sgRNA #2 target the HLA-B upstream region, and sgRNA #3 and sgRNA #4 target HLA-C the downstream region. FIG. 14B shows that PCR screening confirms clone 1D as a homozygous knock-out clone. FIG. 14B includes a schematic showing the PCR verification strategy for successful deletion of HLA-B and HLA-C. Two pairs of wild-type (WT) primers were designed flanking each cutting site, with predicted amplicon sizes of 545 bp and 472 bp. Clone 1D was identified as a homozygous knock-out clone by the presence of about 680 bp PCR band generated with KO primers and the absence of bands using the two different sets of WT primers. Genomic DNA was isolated from the indicated targeted HuES8 clones. FIG. 14C provides a schematic showing sequence confirmation of HLA-B, HLA-C deletion in 1D KO clone. The sequencing results of 1D PCR product demonstrated successful deletion of HLA-B and HLA-C genes in HuES8. FIG. 14D shows that RT-PCR confirms the loss of HLA-B and HLA-C mRNA expression in HuES8 cells. RT-PCR with HLA-B and HLA-C specific primers demonstrated the mRNA expressions of HLA-B and HLA-C in clone 1D are eliminated. GAPDH, TOP1 and HPRT1 were used as internal controls. FIG. 14E provides a schematic showing sequence confirmation of HLA-B RT-PCR bands obtained from WT and clone 1D. WT and 1D RT-PCR products amplified with HLA-B primers were sequenced and identified as HLA-B and HLA-A mRNAs, respectively using BLAST. These results demonstrated that in the absence of the HLA-B gene, the HLA-B specific primers will amplify HLA-A mRNA in HuES8 clone 1D. FIG. 14F shows the karyotyping of HuES8 clone 1D by NanoString nCounter. HuES8 clone 1D displays a normal karyotype as assessed by NanoString nCounter set. FIG. 14G provides a schematic showing HLA-A knockout strategy using the dual sgRNA approach. The schematic shows the positions of the two sgRNAs (sgRNA #5 and sgRNA #6) that were designed to bind upstream and downstream of HLA-A. FIG. 14H shows the on-target cutting efficiency of HLA-A sgRNA using TIDE. The cutting efficiency of sgRNA #5 and sgRNA #6 was determined in 293T cells using TIDE. FIG. 14I demonstrates that PCR screening confirmed clone 4E as a heterozygous HLA-A knockout clone. PCR screening strategy confirmed deletion of HLA-A in HuES8. KO primers were designed with one primer annealing upstream and one primer annealing downstream of the cutting sites. Upon HLA-A deletion, the resulting amplicon is observed as 220 bp on a 2% agarose gel. Two pairs of WT primers were designed flanking each cutting site, with predicted amplicons sizes of 589 bp and 571 bp. Clone 4E was identified as heterozygous clone due to the presence of bands generated with KO primers and WT primers amplified from genomic DNA. FIG. 14J includes a schematic showing that sequencing confirms successful deletion of HLA-A in HuES8 cells. Sequencing of the PCR product amplified from genomic DNA of clone 4E using KO primers demonstrates successful deletion of HLA-A in HuES8.

Figure 15A:
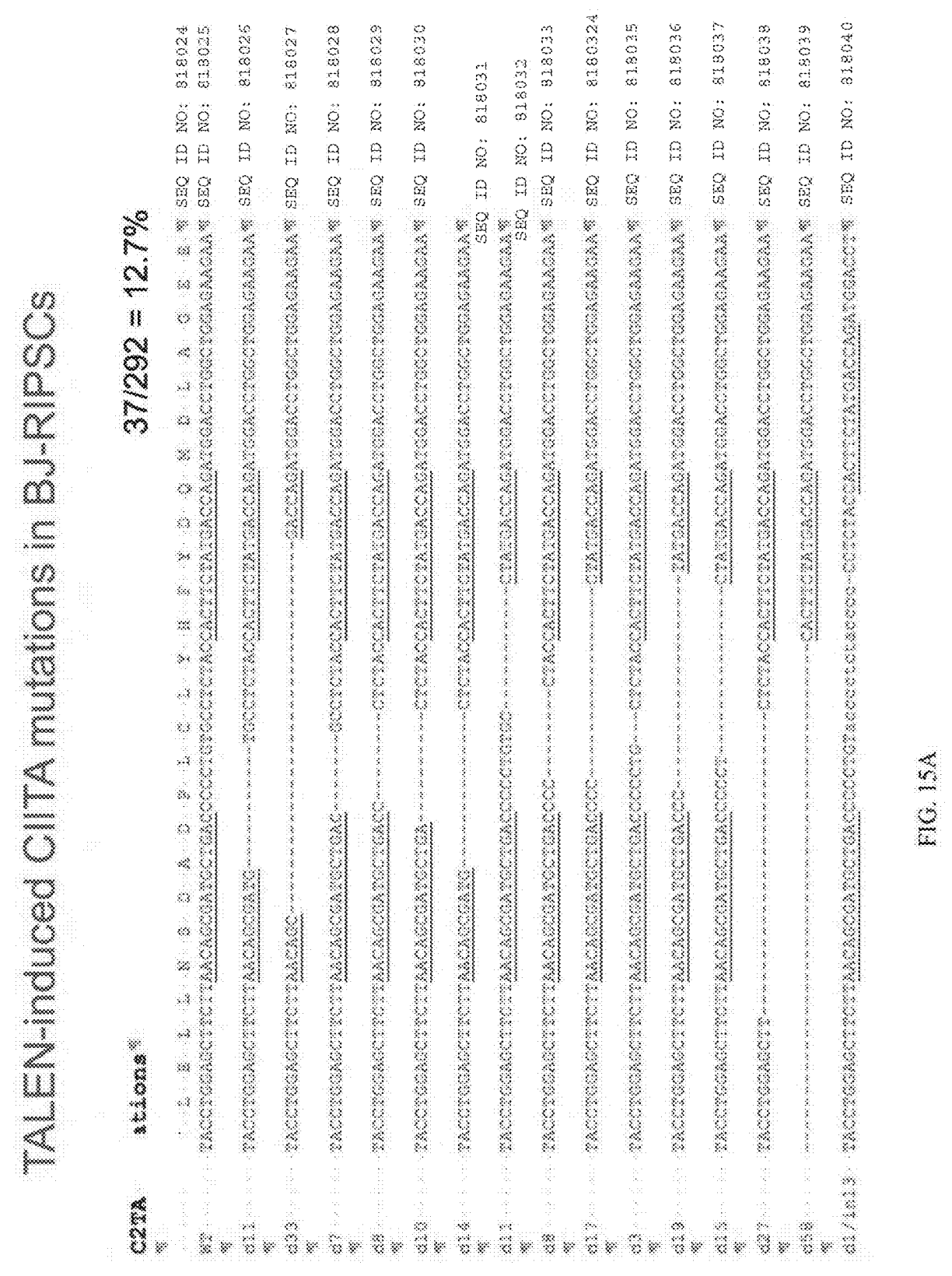
Figure 15B:
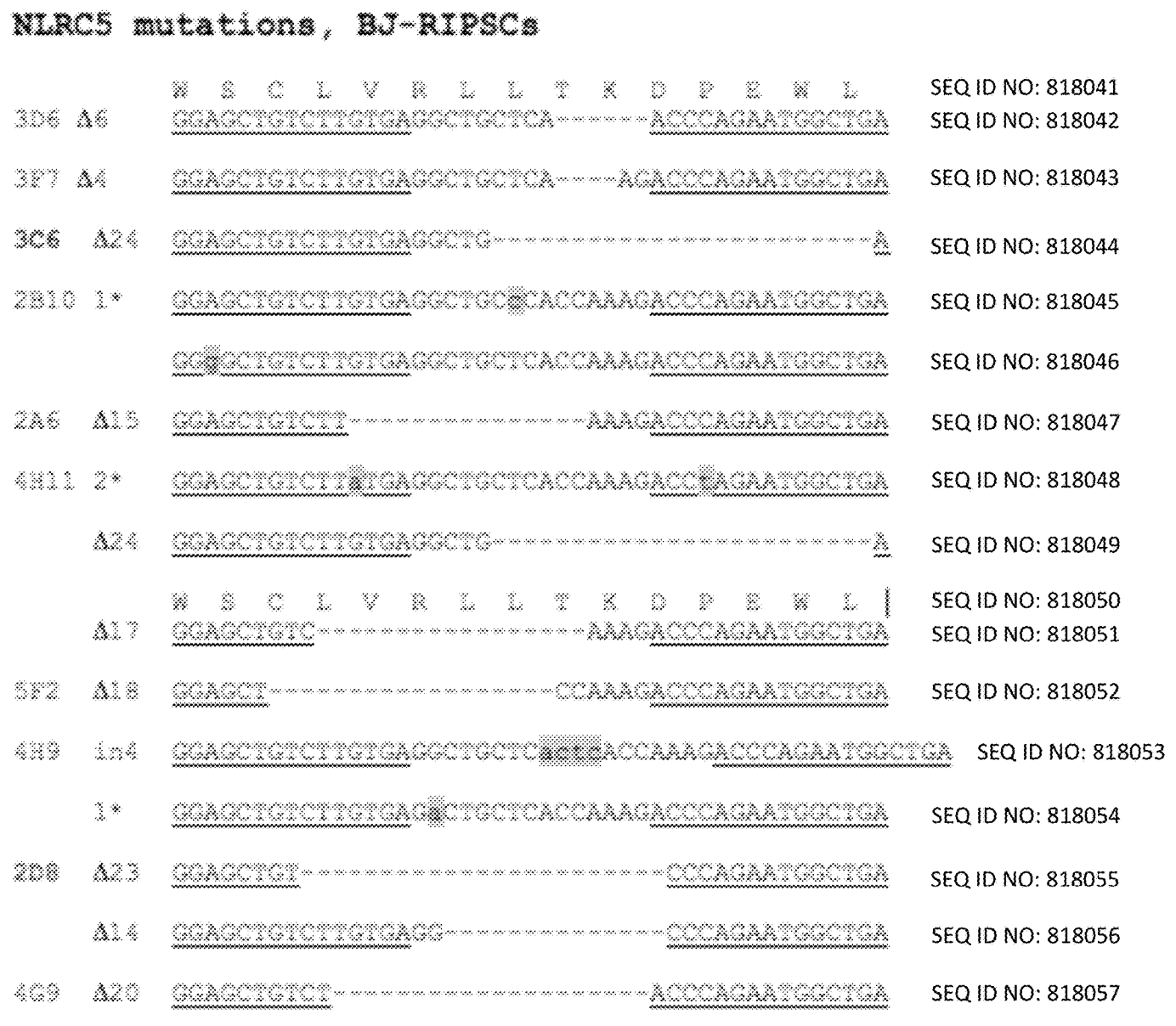
Figure 15D:
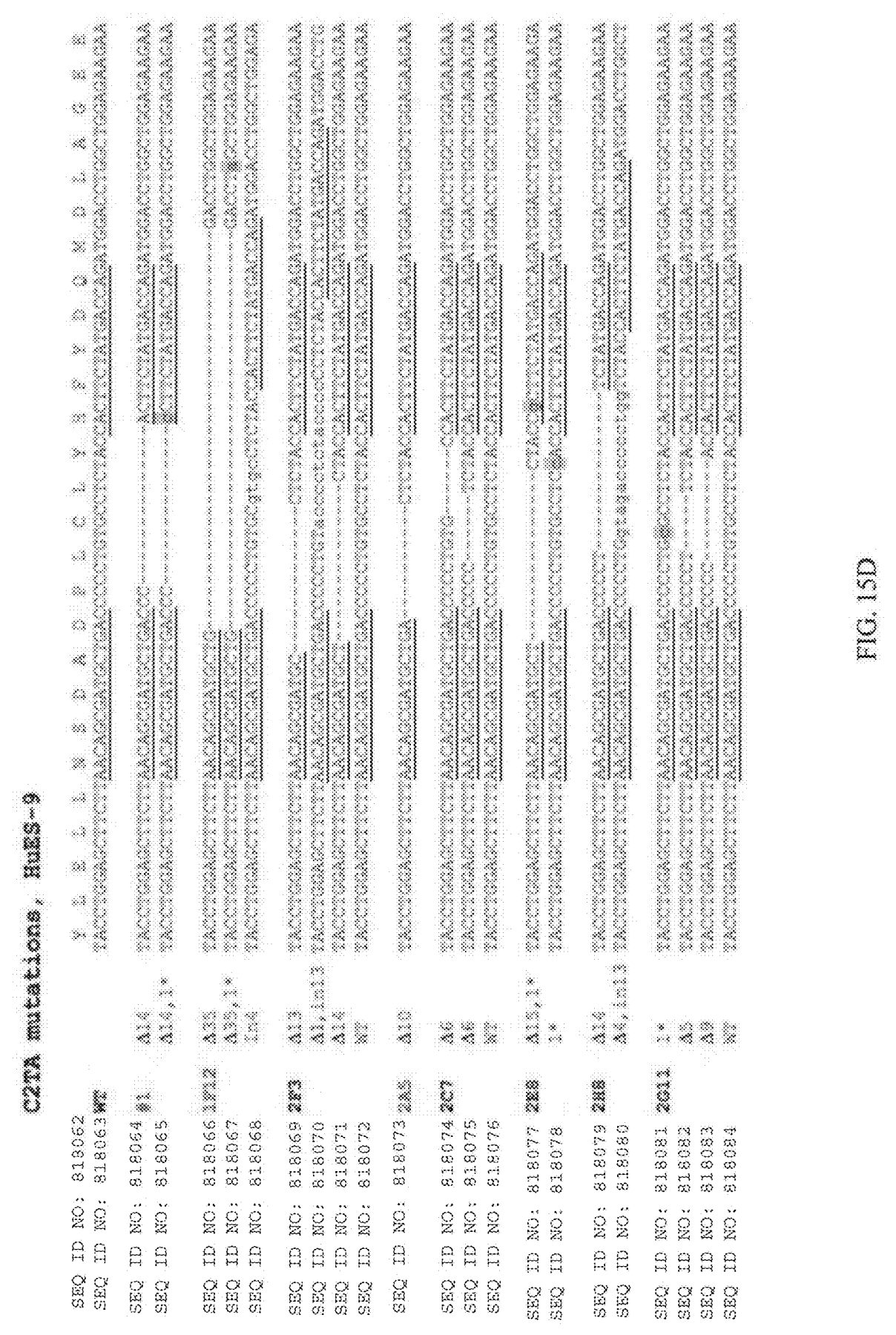

FIGS. 15A-15D show TALEN-induced CIITA and NLRC5 mutations in BJ-RIPSCs and HuES9 cells. FIG. 15A provides a schematic of TALEN-induced CIITA mutations in BJ-RIPSCs. FIG. 15B provides a schematic of TALEN-induced NLRC5 mutations in BJ-RIPSCs. FIG. 15C provides a schematic of TALEN-induced NLRC5 mutations in HuES9s. FIG. 15D provides a schematic of TALEN-induced CIITA mutations in HuES9s.

FIGS. 16A-16G demonstrate targeting of NLRC5 and CIITA utilizing a CRISPR system to achieve a reduction in MHC class I expression and complete loss of MHC class II expression. FIG. 16A shows reduced MHC-I expression in NLRC5−/− Thp1 cells, including a NLRC5 targeting strategy in Thp1 cells. The + indicates 48 hours of IFNγ stimulation. FIG. 16B provides schematics of multiple targeting strategies. FIG. 16B provides a schematic of targeting NLRC5 using CRISPR, a schematic of targeting B2M using CRISPR, a schematic of targeting CIITA using TALENs and a schematic of targeting CIITA using CRISPR. FIG. 16C shows reduced MHC class I expression in HuES9 cells following targeting with NLRC5 or B2M CRISPRs. The graph shows low basal MHC-I expression in stem cells. The MHC-I expression can be increased by IFNγ stimulation. About a 50% reduction of MHC-I expression occurs in IFNγ-treated NLRC5−/− cells. A complete loss of MHC-I surface expression is shown in B2M−/− cells. FIG. 16D shows a lentiviral transduction of Thp-1. A dual-vector lentiviral GeCKO system is used. The two component system includes Lenti-Cas9-Blasticidin, which acts to establish stable Thp-1 Cas9 cell line, and Lenti-Guide-puro, which acts to bring in the guide. FIG. 16E identifies various CRISPRs used for the lentiviral transduction of Thp-1. CRISPRs targeting CIITA, NLRC5 and IRF1 are provided. FIG. 16F shows that CIITA and NLRC5 act independently on MHC-II and MHC-I, respectively. Thp1 was transduced with lentivirus encoding NLRC5 and CIITA. A B2M CRISPR is used as a positive control. All cells were stimulated ON with 50U IFNγ to boost HLA expression. HLA-A2 1:200; DR 1:100. FIG. 16G shows targeting of IRF1 results in loss of MHC-II expression. Thp1, 10 days post CRISPR transduction. All cells were stimulated ON with 50U IFNγ. HLA-A2 1:200; DR 1:100.

FIGS. 17A-17K demonstrate targeting of IRF1 utilizing a CRISPR system to achieve reduced MHC class I expression in human pluripotent stem cells (HuES9) and Thp-1 cells. FIG. 17A shows a dual CRISPR strategy targeting the IRF1 locus. Three different CRISPRs are identified. FIG. 17B demonstrates the testing of different IRF1 guide combinations. Screening results of different guide combinations are provided. FIG. 17C demonstrates a 'dual guide strategy' for the targeted deletion of IRF1. Screening results of the dual guide strategy are provided. FIG. 17D provides a schematic showing sequence confirmation of IRF-1 CRISPR induced deletion. FIG. 17E provides the screening results of IRF-1 targeted HuES9 cells. The screening is of a dual CRISPR strategy using CRISPRs #2 and #3. The presence of the PCR band suggests successful targeting. FIG. 17F demonstrated reconfirmation of IRF-1 clones. Screening results using primers KYM07 and TM377 are provided. FIG. 17G demonstrates genotypes of IRF-1 clones. Screening results are provided. FIG. 17H provides a schematic showing sequence confirmation of IRF-1 CRISPR induced deletion in clone 12. FIG. 17I provides a schematic showing sequence confirmation of IRF-1 CRISPR induced deletion in clone 17. FIG. 17J provides a schematic showing sequence confirmation of IRF-1 CRISPR induced deletion in clone 21. FIG. 17K shows impaired MHC class I induction in IRF1−/− HuES9 clones following IFNγ treatment. P42 are WT; C7 are B2M KO; + identifies 48 hours IFNγ treatment.

FIGS. 18A-18H demonstrate targeting of RFX5, RFX-ANK and RFX-AP in 293T cells utilizing CRISPR results in reduced MHC class I expression. FIG. 18A demonstrates dual guide targeting of RFX5 in 293T cells. Combinations of four different CRISPRs were examined. FIG. 18B shows that the targeting of RFX5 results in reduced MHC class I expression. FIG. 18C demonstrates dual guide targeting of RFX-ANK in 293T cells. Combinations of four different CRISPRs were examined. FIG. 18D shows that the targeting of RFX-ANK results in reduced MHC class I expression. FIG. 18E shows that targeting RFX5 and RFX-ANK results in reduced MHC class I expression. FIG. 18F provides a bar graph showing that targeting RFX5 and RFX-ANK results in reduced MHC class I expression. FIG. 18G demonstrates dual guide targeting of RFX-AP in 293T cells. Combinations of four different CRISPRs were examined. FIG. 18H shows that the targeting of RFX-AP results in reduced MHC class I expression.

FIG. 19A demonstrates dual guide targeting of NFY-A in 293T cells. Combinations of four different CRISPRs were examined. FIG. 19B demonstrates dual guide targeting of NFY-C in 293T cells. Combinations of four different CRISPRs were examined. FIG. 19C shows that the targeting of NFY-C and NFY-A results in reduced MHC class I expression. FIG. 19D demonstrates dual guide targeting of NFY-B in 293T cells. Combinations of four different CRISPRS were examined. FIG. 19E shows that the targeting of NFY-B results in reduced MHC class I expression.

FIG. 20A shows TAP1 CRISPR expression reduces MHC-I surface expression in Jurkat T cells. Combinations of four different CRISPRs was examined. FIG. 20B demonstrates TAP1 CRISPR expression reduces MHC-I surface expression in Jurkat T cells. FIG. 20C demonstrates eliminating HLA surface expression in Jurkat (Cas9) T cells. The Jurkat cell line was established from the peripheral blood of a 14 year old having acute T cell leukemia by Schneider et al. FIG. 20D shows eliminating HLA surface expression in Jurkat (Cas9) T cells. The cells were treated with IFNγ for 48 hours.

FIGS. 21A-21D demonstrate the use of a CRISPR gRNA identified as an HLA Razor that allows simultaneous deletion of all MHC class I alleles by targeting a conserved region in the HLA genes. FIG. 21A provides a schematic showing the targeting of a conserved sequence found in all HLAs by CRISPR or TALENs using an HLA Razor. The two violet boxes indicate the binding sites for the panHLA TALEN pair. The blue arrow indicates the pan-HLA CRISPR tested; the PAM is boxed in blue. FIG. 21B shows the expression of pan-HLA TALENs in 293T and HuES9 cells 72 hours post transfection. FIG. 21C shows HLA-Razor CRISPR blunts MHC class I expression. The 293T cells were co-transfected with Cas9-GFP. The results are shown 72 hours post transfection. FIG. 21D provides a schematic showing a comparison of the activity of two different HLA Razors. Two HLA Razor guides are identified.

FIG. 22A provides a schematic showing PD-L1 and HLA-G knock-in strategy. WT primers and knock-in (KI) primers for clone screening were designed. The amplicon with WT primers is predicted as 488 bp, and the amplicons with KI primers are predicted as 403 bp and 915 bp. FIG. 22B depicts the design of the knock-in donor plasmid. The design of the knock-in donor plasmid shows that the reading frames of PD-L1 and HLA-G are linked by T2A and their expression is driven by a CAGGS promoter. Puromycin was used as a drug resistance marker following the SA-2A gene trap element. FIG. 22C demonstrates ectopic PD-L1 and HLA-G expression in 293T cells. The expression of PD-L1 and HLA-G were examined in the donor plasmid-transfected 293T cells by FACS analysis. APC-conjugated PD-L1 antibody and FITC-conjugated HLA-G antibody were used. FIG. 22D shows ectopic HLA-G expression in JEG-3 cells. Donor plasmid was transfected into an HLA-G−/−JEG-3 cell line, and ectopic HLA-G expression was examined by FACS analysis 48 hours post-transfection. A PE-conjugated HLA-G antibody (MEM/G9) was used to detect surface HLA-G surface expression. FIG. 22E provides PCR screening results that confirm clone 1G as a heterozygous KI clone for PD-L1/HLA-G. Clone 1G was identified as a heterozygous KI clone by the presence of bands using both WT primers and KI-specific primers amplified from genomic DNA of targeted HuES8 cells. FIG. 22F shows stable PD-L1 and HLA-G expression from a safe harbor locus in HuES8. The expression of PD-L1 was verified in HuES8 KI clone 1G by FACS analysis using an APC-conjugated PD-L1 antibody.

FIG. 24 demonstrates that deletion of TRAC and TRBC in HuES9 disrupts TCR expression. A dual guide RNA approach was used to introduce deletions into the TRAC and TRBC loci in HuES9 cells. TCRA wt band is 249 bp, and is 209 bp after deletion. TCRB wt band is 162 bp, and is 140 bp after deletion. Bands identified with a * are TCRB KO in HuES9 cells; bands identified with a  are TCRA KO in HuES9 cells; and bands identified with a * are TCRA KO in HuES9 B2M−/−CIITA−/− cells. TCRA KO in HuES9 B2M−/−CIITA−/− cells is a triple knock-out stem cell line for B2M−/−, CIITA−/− and TCR−/−. Upon differentiation into T cells this triple knock out stem cell line will be devoid of MHC-I, MHC-II and TCR surface expression.

FIGS. 25A-25D demonstrate targeting of CD274/B7-H1/PD-L1 in a variety of cell lines. FIG. 25A identifies an example of a CRISPR guide sequence that may be used when targeting CD274/B7-H1/PD-L1. CD274/B7-H1/PD-L1 knock out cell lines are identified. FIG. 25B shows the screening of targeted B7-H1 colonies in JEG-3 cells. The screening identified a CRISPR cutting efficiency of 22/265 or about 8.3%. FIG. 25C demonstrates the reconfirmation of 501 melanoma knock-out clones. FIG. 25D demonstrates the reconfirmation of MalMe melanoma knock-out clones.

FIG. 26A shows co-stimulatory/co-inhibitory molecules and their receptors on T cells. FIG. 26F demonstrates dual guide targeting of CD28 in 293T cells. CRISPRs #1, #2 and #3 were found to work. FIG. 26O demonstrates dual guide targeting of ST2 in 293T cells. All four CRISPRs were found to work. FIG. 26P demonstrates dual guide targeting of GITR in 293T cells. CRISPRs #1 and #3 were found to work.

FIG. 27 depicts various cell lines tested and with which targets the cells lines were tested. HuES8 and HuES9 are human ES cell lines. BJ-RiPSCs is an iPSC line. All other enhanceosome components not shown in the table (e.g., RFX and NFY) were only tested in HEK293T cells.

FIGS. 28A-28J provides that modified ES cells can be differentiated into various different cell types with reduced or absent HLA expression. FIG. 28A provides that the modified ES call can be differentiated into Mesenchymal Progenitor Cells (MPCs), endothelial cells (ECs), macrophages, hepatocytes, beta-cells and neural progenitor cells (NPCs). FIG. 28B shows reduced MHC-I expression in NLRC5−/− human ES cells. There is low basal MHC-I expression in stem cells. The expression can be increased by IFNγ stimulation. About a 50% reduction in MHC-I expression occurs in IFNγ-treated NLRC5−/− cells. FIG. 28C shows reduced MHC-I expression in NLRC5−/− human mesenchymal progenitor cells (MPCs). A comparison is provided of HuES9 cells and MPCs. FIG. 28D shows reduced MHC-I expression in stem cell-derived NLRC5−/− endothelial cells (ECs). FIG. 28E demonstrates that ECs exhibit similar differentiation efficiency. FIG. 28F shows loss of HLA expression in B2M−/−CIITA−/−ECs. N=3, 48 hours of IFNγ treatment. FIG. 28G demonstrates reduced MHC class I expression in NLRC5−/− hepatocyte-like cells. A schematic is included demonstrating the targeting strategy and CRISPR design. The HLCs are derived from BJ-RiPSCs, day 7 of final hepatocyte differentiation. FIG. 28H demonstrates that mutation of CIITA abrogates MHC class II expression in hESC-derived macrophages. A schematic is included demonstrating the targeting strategy and CRISPR design. The HuES9-derived iMΦs, day 5 M-CSF. FIG. 28I shows neural progenitor cell (NPC) differentiation. B2M−/−CIITA−/−HuES9 form Nestin+ neural rosettes (white arrow). FIG. 28J demonstrates the adaptation of stem cells to spin culture for beta-cell differentiation. This is the first step in the beta-cell differentiation protocol.

FIG. 29A-29B provide in vivo data in a teratoma model. FIG. 29A provides that 'hypoimmunogenic' DKO cell lines were generated. The cell lines generated include WT HuES9, NLRC5−/−CIITA−/−HuES9 and B2M−/−CIITA−/−HuES9. The WT cell lines exhibited MHC-I and MHC-II expression. The NLRC5−/−CIITA−/− cells lines exhibited reduced MHC-I expression and no MHC-II expression. The B2M−/−CIITA−/− cell lines exhibited no MHC-I and MHC-II expression. FIG. 29B shows improved engraftment of genome-edited stem cells in humanized mice. The three cell lines tested were WT HuES9, NLRC5−/−CIITA−/− HuES9 and B2M−/− CIITA−/− HuES9.

FIGS. 30A-30D demonstrates CRISPR targeting of B7-H3 in JEG-3 cells. FIG. 30A provides a CRISPR guide sequence for targeting B7-H3. FIG. 30B shows a screening of targeted B7-H3 colonies in JEG-3 cells. The CRISPR cutting efficiency is shown to be 15/80 or about 18.7%. FIG. 30C shows confirmation of B7-H3 knock-outs through sequencing. FIG. 30D demonstrates loss of B7-H3 surface expression in targeted JEG3 clones.

FIG. 32A is a schematic of gRNAs targeting B2M. FIG. 32B is a histogram of B2M surface expression in HEK293T cells. FIG. 32C shows B2M deletion efficiency with various gRNAs in HEK293T cells; n=3 (mean±SEM). FIG. 32D is a schematic of gRNAs targeting CCR5. Orange and green arrows represent primer pairs used to amplify the region for analysis. FIG. 32E shows results of Surveyor assays of each gRNA targeting CCR5 in K562 cells. % InDels is indicated under each guide. FIG. 32F illustrates B2M deletion efficiency of selected gRNAs in primary CD4+ T cells in comparison to 293T cells; n=6 (mean±SEM). FIG. 32G shows results of surveyor assay of crCCR5_A and crCCR5_B targeting CCR5 in K562 cells and HSPCs. FIG. 32H illustrates clonal deletion efficiency of crCCR5_A and crCCR5_B targeting of CCR5 in HSPCs (n=2) as determined by Sanger sequencing. (Note: crB2M_14 is not depicted in panel A schematic, as it is located 20 Kb downstream of coding sequence).

FIG. 33A shows B2M deletion efficiency for all gRNAs targeting B2M locus in HEK293T cells as measured by flow cytometry. Pooled data from 3 independent experiments shown as mean±SEM. FIG. 33B shows B2M deletion efficiencies of selected guides in HEK293T cells, measured as % InDels by CEL Surveyor assay. FIG. 33C is a comparison of B2M surface expression in HEK293T cells and primary CD4+ T cells when transfected with Cas9 and guide crB2M_13. FIG. 33D shows B2M deletion efficiency for selected guides targeting the B2M locus in primary CD4+ T-cells, as measured by flow cytometry. FIG. 33E shows B2M deletion efficiencies of selected guides in primary CD4+ T cells, measured as % InDels by CEL Surveyor assay.

FIGS. 34A-34E depict a dual gRNA approach for CRISPR/Cas9 genome editing in primary human hematopoietic stem and effector cells. FIG. 34A is a schematic of dual gRNA approach for targeting the B2M locus. gRNA pairs are in red. The offset in base pairs between Cas9 sites for each gRNA combination (right panel). FIG. 34B shows B2M deletion efficiency in CD4+ T cells for 6 dual gRNA combinations (n=3; mean±SEM). FIG. 34C is a FACS plots showing loss of B2M expression of either crB2M_13 or crB2M_8 alone or in combination in primary CD4+ T cells. FIG. 34D is a schematic of dual gRNA approach for targeting CCR5. gRNA pairs are shown in red. Orange and green arrowheads represent primer pairs used to amplify the region. The offset between the Cas9 sites of each gRNA pair (right panel). FIG. 34E is a gel electrophoresis image of CD34+ HSPCs derived clones targeted with crCCR5_D+Q analyzed by PCR. Note the deletion of the 205 bp region between the two gRNA cutting sites (top panel; WT: wild type; ΔCCR5: deleted; green * denotes a WT clone; orange * denotes a heterozygous clone; and red * denotes a homozygous deleted clone). Clonal deletion efficiency for three dual gRNA combinations targeting CCR5 in CD34+ HSPCs (n=4; % mean±SEM; bottom panel).

FIGS. 35A-35G demonstrate the targeting efficiency of dual gRNA combinations. FIG. 35A shows B2M deletion efficiency for 6 dual gRNA combinations from three independent donors as measured by flow cytometry. FIG. 35B are FACS plots showing loss of MHC class I surface expression (bottom panel) following B2M deletion (top panel). FIG. 35C is a schematic of the single cell nested PCR strategy for the B2M locus (left panel), black and gray arrowheads: control primer pairs, orange and green arrowheads: primer pairs flanking targeting region. % B2M null single cells is shown (right panel, n=301). FIG. 35D is a Sanger sequencing chromatogram showing predicted deletion of targeted region at B2M locus. FIG. 35E shows clonal CCR5 deletion efficiency for three dual gRNA combinations in CD34+ HSPC-mPB obtained from multiple donors. DNA isolated from individual colony was analyzed by PCR and gel electrophoresis. FIG. 35F is a schematic of the single cell nested PCR strategy (left panel) for determining deletion of CCR5 in primary CD4+ T cells. % CCR5 null single cells is shown (right panel, n=363). FIG. 35G shows Sanger sequencing chromatogram shows predicted deletion at targeted region.

FIG. 39 depicts Cpf1 crRNA design and cloning information.

FIGS. 40A-40G demonstrate generation and characterization of B2M KO JEG3 cells using TALENs. FIG. 40A depicts a design of B2M TALEN and induced mutations. FIG. 40B depicts an analysis of B2M at the transcript and protein levels. FIG. 40C demonstrates an analysis of B2M at the surface expression level. FIG. 40D demonstrates that AB2M clones are devoid of MHC-I surface expression. FIG. 40E demonstrates that AB2M clones are devoid of HLA-G surface expression. FIG. 40F demonstrates that AB2M clones are devoid of HLA-C surface expression. FIG. 40G demonstrates that AB2M clones are devoid of HLA-E surface expression.

FIG. 41 is a schematic illustration depicting the location of the CRISPR gRNAs targeting the first coding exons of the TCRalpha and TCRbeta chains, respectively.

FIG. 42A depicts the results of a FACS analysis employing an anti-CD3 antibody, which reveals successful TCR deletion in Jurkat T cells that stably express the Cas9 nuclease. FIG. 42B shows the results of a SURVEYOR™ assay confirming cutting at the TCRa and TCRb loci.

FIG. 43A shows the results of a SURVEYOR™ assay demonstrating CRISPR cutting at the TCRa and TCRb loci in CD3+ T cells obtained from two independent donors. FIG. 43B shows the loss of TCR surface expression demonstrated by FACS analysis.

FIG. 44A is a schematic representation of the PD-1 targeting strategy. FIG. 44B demonstrates that the double CRISPR strategy results in cutting by both CRISPRs targeting the PD-1 locus in HEK293T cells. FIG. 44C is a schematic representation of sequencing, which confirmed the predicted deletion in the PD-1 locus after transfection of two CRISPRs targeting the PD-1 gene (PDCD1).

FIGS. 45A-35B demonstrate the loss of PD-1 expression in Jurkat T cells. FIG. 45A shows the results of FACS analysis, demonstrating the loss of PD-1 expression in activated Jurkat T cells. FIG. 45B shows the results of a SURVEYOR™ assay confirming cutting at the PD-1 locus.

FIGS. 46A-46C demonstrate an exemplary CTLA4 locus targeting strategy of the present invention. FIG. 46A is a schematic representation of the CTLA4 targeting strategy. FIG. 46B demonstrates that the double CRISPR strategy results in cutting by both CRISPRs targeting the CTLA4 locus in HEK293T cells. FIG. 46C is a schematic representation of sequencing, which confirmed the predicted deletion in the CTLA4 locus after transfection of two CRISPRs targeting the CTLA4 gene (CTLA4).

FIG. 47A demonstrates that the double CRISPR strategy results in cutting by both CRISPRs targeting the CTLA4 locus in Jurkat T cells. FIG. 47B shows the results of a SURVEYOR™ assay, demonstrating successful cutting by both CTLA4 CRISPRs in Jurkat T cells.

Figure 1:
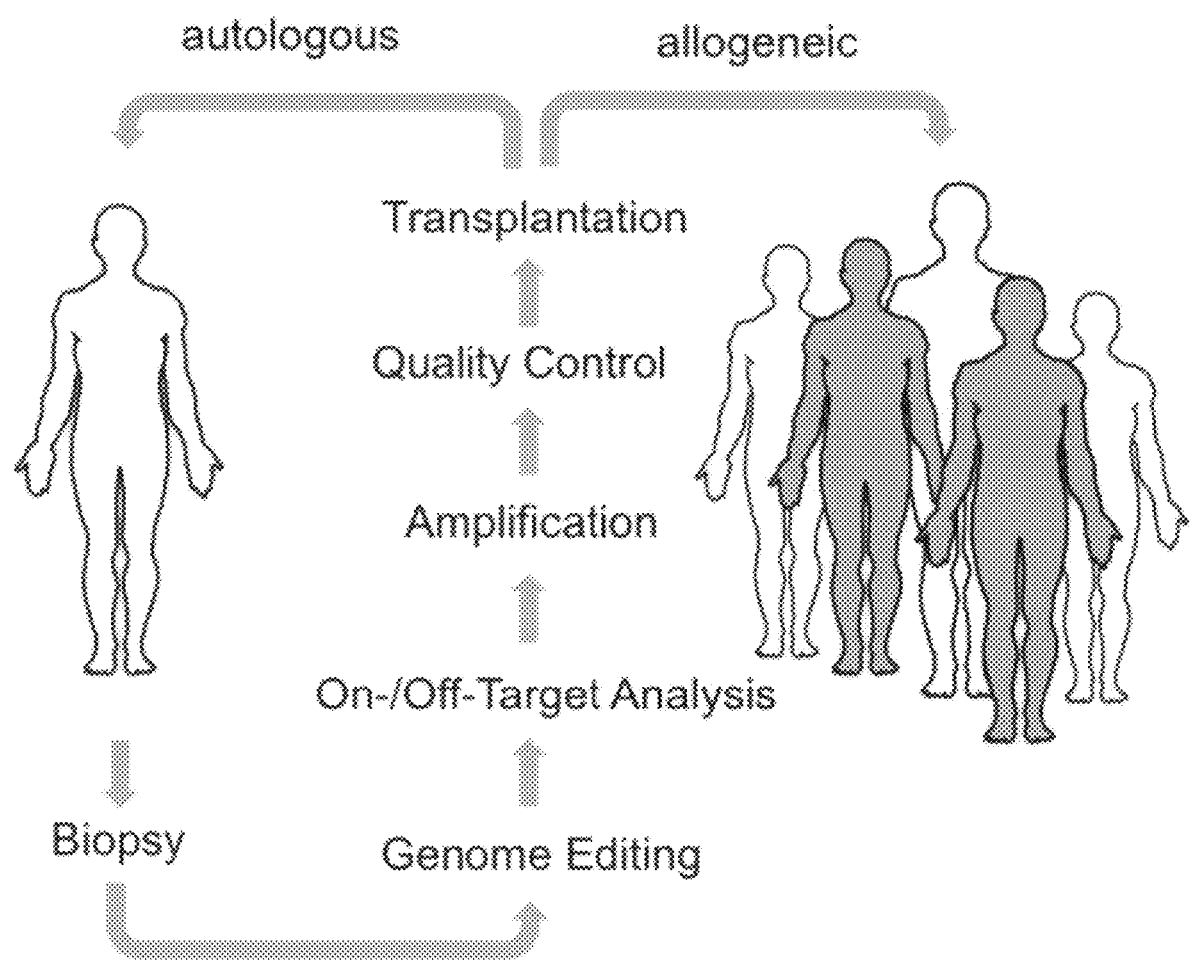
FIG. 1 illustrates the promise of regenerative medicine.

The following Tables 8-54 are submitted herewith as Appendices 1-47, respectively:

Table 8—exemplary gRNA sequences useful for targeting HLA-A;

Table 9—exemplary gRNA sequences useful for targeting HLA-B;

Table 10—exemplary gRNA sequences useful for targeting HLA-C;

Table 11—exemplary gRNA sequences useful for targeting RFX-ANK;
Table 12—exemplary gRNA sequences useful for targeting CIITA;
Table 13—exemplary gRNA sequences useful for targeting NFY-A;
Table 14—exemplary gRNA sequences useful for targeting NLRC5;
Table 15—exemplary gRNA sequences useful for targeting B2M;
Table 16—exemplary gRNA sequences useful for targeting RFX5;
Table 17—exemplary gRNA sequences useful for targeting RFX-AP;
Table 18—exemplary gRNA sequences useful for targeting HLA-G;
Table 19—exemplary gRNA sequences useful for targeting HLA-E;
Table 20—exemplary gRNA sequences useful for targeting NFY-B;
Table 21—exemplary gRNA sequences useful for targeting PD-L1;
Table 22—exemplary gRNA sequences useful for targeting NFY-C;
Table 23—exemplary gRNA sequences useful for targeting IRF1;
Table 24—exemplary gRNA sequences useful for targeting TAP1;
Table 25—exemplary gRNA sequences useful for targeting GITR;
Table 26—exemplary gRNA sequences useful for targeting 41BB;
Table 27—exemplary gRNA sequences useful for targeting CD28;
Table 28—exemplary gRNA sequences useful for targeting B7-1
Table 29—exemplary gRNA sequences useful for targeting CD47;
Table 30—exemplary gRNA sequences useful for targeting B7-2;
Table 31—exemplary gRNA sequences useful for targeting OX40;
Table 32—exemplary gRNA sequences useful for targeting CD27;
Table 33—exemplary gRNA sequences useful for targeting HVEM;
Table 34—exemplary gRNA sequences useful for targeting SLAM;
Table 35—exemplary gRNA sequences useful for targeting CD226;
Table 36—exemplary gRNA sequences useful for targeting ICOS;
Table 37—exemplary gRNA sequences useful for targeting LAG3;
Table 38—exemplary gRNA sequences useful for targeting TIGIT;
Table 39—exemplary gRNA sequences useful for targeting TIM3;
Table 40—exemplary gRNA sequences useful for targeting CD160;
Table 41—exemplary gRNA sequences useful for targeting BTLA;
Table 42—exemplary gRNA sequences useful for targeting CD244;
Table 43—exemplary gRNA sequences useful for targeting LFA-1;
Table 44—exemplary gRNA sequences useful for targeting ST2;
Table 45—exemplary gRNA sequences useful for targeting HLA-F;
Table 46—exemplary gRNA sequences useful for targeting CD30;
Table 47—exemplary gRNA sequences useful for targeting B7-H3;
Table 48—exemplary gRNA sequences useful for targeting VISTA;
Table 49—exemplary gRNA sequences useful for targeting TLT;
Table 50—exemplary gRNA sequences useful for targeting PD-L2;
Table 51—exemplary gRNA sequences useful for targeting FOXP3;
Table 52—exemplary gRNA sequences useful for targeting CD58;
Table 53—exemplary gRNA sequences useful for targeting CD2; and
Table 54—exemplary gRNA sequences useful for targeting HELIOS.

The material submitted herewith in electronic (.txt) form and comprising Appendices 1-47 (Tables 8-54, respectively) is incorporated herein by reference, specifically:
Appendix 1 (file name: Table8.txt; date created: May 9, 2016; file size: 223,026 bytes);
Appendix 2 (file name: Table9.txt; date created: May 9, 2016; file size: 327,895 bytes);
Appendix 3 (file name: Table10.txt; date created: May 9, 2016; file size: 280,849 bytes);
Appendix 4 (file name: Table11.txt; date created: May 9, 2016; file size: 998,046 bytes);
Appendix 5 (file name: Table12.txt; date created: May 9, 2016; file size 4,717,823 bytes);
Appendix 6 (file name: Table13.txt; date created: May 9, 2016; file size 2,813,407 bytes);
Appendix 7 (file name: Table14.txt; date created: May 9, 2016; file size: 6,568,742 bytes);
Appendix 8 (file name: Table15.txt; date created: May 9, 2016; file size 728,685 bytes);
Appendix 9 (file name: Table16.txt; date created: May 9, 2016; file size 766,106 bytes);
Appendix 10 (file name: Table17.txt; date created: May 9, 2016; file size 874,435 bytes);
Appendix 11 (file name: Table18.txt; date created: May 9, 2016; file size: 232,536 bytes);
Appendix 12 (file name: Table19.txt; date created: May 9, 2016; file size 539,932 bytes);
Appendix 13 (file name: Table20.txt; date created: May 9, 2016; file size 2,256,084 bytes);
Appendix 14 (file name: Table21.txt; date created: May 9, 2016; file size 1,303,081 bytes);
Appendix 15 (file name: Table22.txt; date created: May 9, 2016; file size 6,821,299 bytes);
Appendix 16 (file name: Table23.txt; date created: May 9, 2016; file size 1,095,386 bytes);
Appendix 17 (file name: Table24.txt; date created: May 9, 2016; file size 941,281 bytes);
Appendix 18 (file name: Table25.txt; date created: May 9, 2016; file size 378,368 bytes);
Appendix 19 (file name: Table26.txt; date created: May 9, 2016; file size 2,706,509 bytes);
Appendix 20 (file name: Table27.txt; date created: May 9, 2016; file size 3,578,977 bytes);
Appendix 21 (file name: Table28.txt; date created: May 9, 2016; file size 3,638,039 bytes);

Appendix 22 (file name: Table29.txt; date created: May 9, 2016; file size 5,083,645 bytes);

Appendix 23 (file name: Table30.txt; date created: May 9, 2016; file size 4,481,092 bytes);

Appendix 24 (file name: Table31.txt; date created: May 9, 2016; file size 393,567 bytes);

Appendix 25 (file name: Table32.txt; date created: May 9, 2016; file size 675,503 bytes);

Appendix 26 (file name: Table33.txt; date created: May 9, 2016; file size 1,002,258 bytes);

Appendix 27 (file name: Table34.txt; date created: May 9, 2016; file size 454,540 bytes);

Appendix 28 (file name: Table35.txt; date created: May 9, 2016; file size 10,463,522 bytes);

Appendix 29 (file name: Table36.txt; date created: May 9, 2016; file size 2,755,910 bytes);

Appendix 30 (file name: Table37.txt; date created: May 9, 2016; file size 733,191 bytes);

Appendix 31 (file name: Table38.txt; date created: May 9, 2016; file size 1,674,331 bytes);

Appendix 32 (file name: Table39.txt; date created: May 9, 2016; file size 2,622,419 bytes);

Appendix 33 (file name: Table40.txt; date created: May 9, 2016; file size 2,049,613 bytes);

Appendix 34 (file name: Table41.txt; date created: May 9, 2016; file size 4,016,813 bytes);

Appendix 35 (file name: Table42.txt; date created: May 9, 2016; file size 4,177,884 bytes);

Appendix 36 (file name: Table43.txt; date created: May 9, 2016; file size 4,326,759 bytes);

Appendix 37 (file name: Table44.txt; date created: May 9, 2016; file size 1,007,674 bytes);

Appendix 38 (file name: Table45.txt; date created: May 9, 2016; file size 1,690,144 bytes);

Appendix 39 (file name: Table46.txt; date created: May 9, 2016; file size 5,427,706 bytes);

Appendix 40 (file name: Table47.txt; date created: May 9, 2016; file size 3,510,941 bytes);

Appendix 41 (file name: Table48.txt; date created: May 9, 2016; file size 3,043,135 bytes);

Appendix 42 (file name: Table49.txt; date created: May 9, 2016; file size 274,899,026 bytes);

Appendix 43 (file name: Table50.txt; date created: May 9, 2016; file size 7,273,026 bytes);

Appendix 44 (file name: Table51.txt; date created: May 9, 2016; file size 2,336,524 bytes);

Appendix 45 (file name: Table52.txt; date created: May 9, 2016; file size 274,899,026 bytes);

Appendix 46 (file name: Table53.txt; date created: May 9, 2016; file size 1,820,108 bytes); and Appendix 47 (file name: Table54.txt; date created: May 9, 2016; file size 17,165,777 bytes).

DETAILED DESCRIPTION OF THE INVENTION

Recent advances in stem cell biology have made it possible to contemplate the use of a subject's own cells as an unlimited source for transplantation, as generally depicted, for example, in FIG. 1. Unfortunately, genome editing and the generation of induced pluripotent stem cells (iPSCs) followed by the differentiation of such iPSCs remains a costly, time consuming and highly variable process, with regards to pluripotency, epigenetic status, capacity for differentiation, and genomic stability. Moreover, changes occurring during genome editing and prolonged culturing have been found to trigger an adaptive immune response, resulting in immune rejection of even autologous stem cell-derived transplants. To overcome the problem of a subject's immune rejection of stem cell-derived transplants, the present inventors have developed and disclose herein a universal donor stem cell that represents a viable source for any transplantable cell type. Advantageously, the universal stem cells disclosed herein are not rejected by the recipient subject's immune system, regardless of the subject's genetic make-up.

The inventions disclosed herein employ genome editing technologies (e.g., the CRISPR/Cas or TALEN systems) to reduce or eliminate expression of critical immune genes (e.g., by deleting genomic DNA of critical immune genes) or, in certain instances, insert tolerance-inducing factors, in human ES cells and iPSCs, rendering them and the differentiated cells prepared therefrom hypoimmunogenic and less prone to immune rejection by a subject into which such cells are transplanted. As used herein to characterize a cell, the term "hypoimmunogenic" generally means that such cell is less prone to immune rejection by a subject into which such cells are transplanted. For example, relative to an unaltered wild-type cell, such a hypoimmunogenic cell may be about 2.5%, 5%, 10%, 20%, 30%, 40%, 50%, 60%, 70%, 80%, 90%, 95%, 97.5%, 99% or more less prone to immune rejection by a subject into which such cells are transplanted. In some aspects, genome editing technologies (e.g., the CRISPR/Cas or TALEN systems) are used to modulate (e.g., reduce or eliminate) the expression of MHC-I and MHC-II genes.

In certain embodiments, the inventions disclosed herein relate to a stem cell, the genome of which has been altered to reduce or delete critical components of HLA expression. Similarly, in certain embodiments, the inventions disclosed herein relate to a stem cell, the genome of which has been altered to insert one or more tolerance inducing factors. The present invention contemplates altering target polynucleotide sequences in any manner which is available to the skilled artisan, for example, utilizing a TALEN or a CRISPR/Cas system. Such CRISPR/Cas systems can employ a variety of Cas proteins (Haft et al. PLoS Comput Biol. 2005; 1(6)e60). In some embodiments, the CRISPR/Cas system is a CRISPR type I system. In some embodiments, the CRISPR/Cas system is a CRISPR type II system. In some embodiments, the CRISPR/Cas system is a CRISPR type V system. It should be understood that although examples of methods utilizing CRISPR/Cas (e.g., Cas9 and Cpf1) and TALEN are described in detail herein, the invention is not limited to the use of these methods/systems. Other methods of targeting polynucleotide sequences to reduce or ablate expression in target cells known to the skilled artisan can be utilized herein.

The present inventions contemplate altering, e.g., modifying or cleaving, target polynucleotide sequences in a cell for any purpose, but particularly such that the expression or activity of the encoded product is reduced or eliminated. For example, CRISPR/Cas systems may be used to target transcriptional regulators of antigen presentation to produce a hypoimmunogenic stem cell. In some embodiments, the target polynucleotide sequence in a cell (e.g., ES cells or iPSCs) is altered to produce a mutant cell. As used herein, a "mutant cell" generally refers to a cell with a resulting genotype that differs from its original genotype or the wild-type cell. In some instances, a "mutant cell" exhibits a mutant phenotype, for example when a normally functioning stem gene is altered using the CRISPR/Cas systems. In some embodiments, the target polynucleotide sequence in a cell is altered to correct or repair a genetic mutation (e.g., to restore a normal phenotype to the cell). In some embodiments, the target polynucleotide sequence in a cell is altered to induce a genetic mutation (e.g., to disrupt the function of a gene or genomic element).

In some embodiments, the alteration is an indel. As used herein, "indel" refers to a mutation resulting from an insertion, deletion, or a combination thereof. As will be appreciated by those skilled in the art, an indel in a coding region of a genomic sequence will result in a frameshift mutation, unless the length of the indel is a multiple of three. In some embodiments, the alteration is a point mutation. As used herein, "point mutation" refers to a substitution that replaces one of the nucleotides. A CRISPR/Cas system can be used to induce an indel of any length or a point mutation in a target polynucleotide sequence.

In some embodiments, the alteration results in a knock out of the target polynucleotide sequence or a portion thereof. For example, knocking out a target polynucleotide sequence in a cell can be performed in vitro, in vivo or ex vivo for both therapeutic and research purposes. Knocking out a target polynucleotide sequence in a cell can be useful for treating or preventing a disorder associated with expression of the target polynucleotide sequence (e.g., by knocking out a mutant allele in a cell ex vivo and introducing those cells comprising the knocked out mutant allele into a subject).

As used herein, "knock out" includes deleting all or a portion of the target polynucleotide sequence in a way that interferes with the function of the target polynucleotide sequence or its expression product.

In some embodiments, the alteration results in reduced expression of the target polynucleotide sequence. The terms "decrease," "reduced," "reduction," and "decrease" are all used herein generally to mean a decrease by a statistically significant amount. However, for avoidance of doubt, "decreased," "reduced," "reduction," "decrease" includes a decrease by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (i.e. absent level as compared to a reference sample), or any decrease between 10-100% as compared to a reference level.

The terms "increased," "increase" or "enhance" or "activate" are all used herein to generally mean an increase by a statically significant amount; for the avoidance of any doubt, the terms "increased", "increase" or "enhance" or "activate" means an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level.

The term "statistically significant" or "significantly" refers to statistical significance and generally means a two standard deviation (2SD) below normal, or lower, concentration of the marker. The term refers to statistical evidence that there is a difference. It is defined as the probability of making a decision to reject the null hypothesis when the null hypothesis is actually true. The decision is often made using the p-value.

In some embodiments, the alteration is a homozygous alteration. In some embodiments, the alteration is a heterozygous alteration.

In some embodiments, the alteration results in correction of the target polynucleotide sequence from an undesired sequence to a desired sequence. CRISPR/Cas systems can be used to correct any type of mutation or error in a target polynucleotide sequence. For example, CRISPR/Cas systems can be used to insert a nucleotide sequence that is missing from a target polynucleotide sequence due to a deletion. CRISPR/Cas systems can also be used to delete or excise a nucleotide sequence from a target polynucleotide sequence due to an insertion mutation. In some instances, CRISPR/Cas systems can be used to replace an incorrect nucleotide sequence with a correct nucleotide sequence (e.g., to restore function to a target polynucleotide sequence that is impaired due to a loss of function mutation).

CRISPR/Cas systems can alter target polynucleotides with surprisingly high efficiency. In certain embodiments, the efficiency of alteration is at least about 5%. In certain embodiments, the efficiency of alteration is at least about 10%. In certain embodiments, the efficiency of alteration is from about 10% to about 80%. In certain embodiments, the efficiency of alteration is from about 30% to about 80%. In certain embodiments, the efficiency of alteration is from about 50% to about 80%. In some embodiments, the efficiency of alteration is greater than or equal to about 80%. In some embodiments, the efficiency of alteration is greater than or equal to about 85%. In some embodiments, the efficiency of alteration is greater than or equal to about 90%, about 91%, about 92%, about 93%, about 94%, about 95%, about 96%, about 97%, about 98%, or about 99%. In some embodiments, the efficiency of alteration is equal to about 100%.

In some embodiments, the target polynucleotide sequence is a genomic sequence. In some embodiments, the target polynucleotide sequence is a human genomic sequence. In some embodiments, the target polynucleotide sequence is a mammalian genomic sequence. In some embodiments, the target polynucleotide sequence is a vertebrate genomic sequence.

In some embodiments, CRISPR/Cas systems include a Cas protein or a nucleic acid sequence encoding the Cas protein and at least one to two ribonucleic acids (e.g., gRNAs) that are capable of directing the Cas protein to and hybridizing to a target motif of a target polynucleotide sequence. In some embodiments, CRISPR/Cas systems include a Cas protein or a nucleic acid sequence encoding the Cas protein and a single ribonucleic acid or at least one pair of ribonucleic acids (e.g., gRNAs) that are capable of directing the Cas protein to and hybridizing to a target motif of a target polynucleotide sequence. As used herein, "protein" and "polypeptide" are used interchangeably to refer to a series of amino acid residues joined by peptide bonds (i.e., a polymer of amino acids) and include modified amino acids (e.g., phosphorylated, glycated, glycosolated, etc.) and amino acid analogs. Exemplary polypeptides or proteins include gene products, naturally occurring proteins, homologs, paralogs, fragments and other equivalents, variants, and analogs of the above.

In some embodiments, a Cas protein comprises one or more amino acid substitutions or modifications. In some embodiments, the one or more amino acid substitutions comprise a conservative amino acid substitution. In some instances, substitutions and/or modifications can prevent or reduce proteolytic degradation and/or extend the half-life of the polypeptide in a cell. In some embodiments, the Cas protein can comprise a peptide bond replacement (e.g., urea, thiourea, carbamate, sulfonyl urea, etc.). In some embodiments, the Cas protein can comprise a naturally occurring amino acid. In some embodiments, the Cas protein can comprise an alternative amino acid (e.g., D-amino acids, beta-amino acids, homocysteine, phosphoserine, etc.). In some embodiments, a Cas protein can comprise a modification to include a moiety (e.g., PEGylation, glycosylation, lipidation, acetylation, end-capping, etc.).

In some embodiments, a Cas protein comprises a core Cas protein. Exemplary Cas core proteins include, but are not limited to Cas1, Cas2, Cas3, Cas4, Cas5, Cas6, Cas7, Cas8 and Cas9. In some embodiments, a Cas protein comprises a Cas protein of an E. coli subtype (also known as CASS2). Exemplary Cas proteins of the *E. Coli* subtype include, but are not limited to Cse1, Cse2, Cse3, Cse4, and Cas5e. In some embodiments, a Cas protein comprises a Cas protein of the Ypest subtype (also known as CASS3). Exemplary Cas proteins of the Ypest subtype include, but are not limited to Csy1, Csy2, Csy3, and Csy4. In some embodiments, a Cas protein comprises a Cas protein of the Nmeni subtype (also known as CASS4). Exemplary Cas proteins of the Nmeni subtype include, but are not limited to Csn1 and Csn2. In some embodiments, a Cas protein comprises a Cas protein of the Dvulg subtype (also known as CASS1). Exemplary Cas proteins of the Dvulg subtype include Csd1, Csd2, and Cas5d. In some embodiments, a Cas protein comprises a Cas protein of the Tneap subtype (also known as CASS7). Exemplary Cas proteins of the Tneap subtype include, but are not limited to, Cst1, Cst2, Cas5t. In some embodiments, a Cas protein comprises a Cas protein of the Hmari subtype. Exemplary Cas proteins of the Hmari subtype include, but are not limited to Csh1, Csh2, and Cas5h. In some embodiments, a Cas protein comprises a Cas protein of the Apern subtype (also known as CASS5). Exemplary Cas proteins of the Apern subtype include, but are not limited to Csa1, Csa2, Csa3, Csa4, Csa5, and Cas5a. In some embodiments, a Cas protein comprises a Cas protein of the Mtube subtype (also known as CASS6). Exemplary Cas proteins of the Mtube subtype include, but are not limited to Csm1, Csm2, Csm3, Csm4, and Csm5. In some embodiments, a Cas protein comprises a RAMP module Cas protein. Exemplary RAMP module Cas proteins include, but are not limited to, Cmr1, Cmr2, Cmr3, Cmr4, Cmr5, and Cmr6.

In some embodiments, the Cas protein is a *Streptococcus pyogenes* Cas9 protein or a functional portion thereof. In some embodiments, the Cas protein is a *Staphylococcus aureus* Cas9 protein or a functional portion thereof. In some embodiments, the Cas protein is a *Streptococcus thermophilus* Cas9 protein or a functional portion thereof. In some embodiments, the Cas protein is a *Neisseria meningitides* Cas9 protein or a functional portion thereof. In some embodiments, the Cas protein is a *Treponema denticola* Cas9 protein or a functional portion thereof. In some embodiments, the Cas protein is Cas9 protein from any bacterial species or functional portion thereof. Cas9 protein is a member of the type II CRISPR systems which typically include a trans-coded small RNA (tracrRNA), endogenous ribonuclease 3 (rnc) and a Cas protein. Cas 9 protein (also known as CRISPR-associated endonuclease Cas9/Csn1) is a polypeptide comprising 1368 amino acids. An exemplary amino acid sequence of a Cas9 protein (SEQ ID NO: 1) is shown in FIG. 12. Cas 9 contains 2 enconclease domains, including an RuvC-like domain (residues 7-22, 759-766 and 982-989) which cleaves target DNA that is noncomplementary to crRNA, and an HNH nuclease domain (residues 810-872) which cleave target DNA complementary to crRNA. In FIG. 12, the RuvC-like domain is highlighted in yellow and the HNH nuclease domain is underlined.

In some embodiments, the Cas protein is Cpf1 protein or a functional portion thereof. In some embodiments, the Cas protein is Cpf1 from any bacterial species or functional portion thereof. In some aspects, Cpf1 is a *Francisella novicida* U112 protein or a functional portion thereof. In some aspects, Cpf1 is a *Acidaminococcus* sp. BV3L6 protein or a functional portion thereof. In some aspects, Cpf1 is a *Lachnospiraceae bacterium* ND2006 protein or a function portion thereof. Cpf1 protein is a member of the type V CRISPR systems. Cpf1 protein is a polypeptide comprising about 1300 amino acids. Cpf1 contains a RuvC-like endonuclease domain. Cpf1 cleaves target DNA in a staggered pattern using a single ribonuclease domain. The staggered DNA double-stranded break results in a 4 or 5-nt 5' overhang.

As used herein, "functional portion" refers to a portion of a peptide which retains its ability to complex with at least one ribonucleic acid (e.g., guide RNA (gRNA)) and cleave a target polynucleotide sequence. In some embodiments, the functional portion comprises a combination of operably linked Cas9 protein functional domains selected from the group consisting of a DNA binding domain, at least one RNA binding domain, a helicase domain, and an endonuclease domain. In some embodiments, the functional portion comprises a combination of operably linked Cpf1 protein functional domains selected from the group consisting of a DNA binding domain, at least one RNA binding domain, a helicase domain, and an endonuclease domain. In some embodiments, the functional domains form a complex. In some embodiments, a functional portion of the Cas9 protein comprises a functional portion of a RuvC-like domain. In some embodiments, a functional portion of the Cas9 protein comprises a functional portion of the HNH nuclease domain. In some embodiments, a functional portion of the Cpf1 protein comprises a functional portion of a RuvC-like domain.

It should be appreciated that the present invention contemplates various ways of contacting a target polynucleotide sequence with a Cas protein (e.g., Cas9). In some embodiments, exogenous Cas protein can be introduced into the cell in polypeptide form. In certain embodiments, Cas proteins can be conjugated to or fused to a cell-penetrating polypeptide or cell-penetrating peptide. As used herein, "cell-penetrating polypeptide" and "cell-penetrating peptide" refers to a polypeptide or peptide, respectively, which facilitates the uptake of molecule into a cell. The cell-penetrating polypeptides can contain a detectable label.

In certain embodiments, Cas proteins can be conjugated to or fused to a charged protein (e.g., that carries a positive, negative or overall neutral electric charge). Such linkage may be covalent. In some embodiments, the Cas protein can be fused to a superpositively charged GFP to significantly increase the ability of the Cas protein to penetrate a cell (Cronican et al. ACS Chem Biol. 2010; 5(8):747-52). In certain embodiments, the Cas protein can be fused to a protein transduction domain (PTD) to facilitate its entry into a cell. Exemplary PTDs include Tat, oligoarginine, and penetratin. In some embodiments, the Cas9 protein comprises a Cas9 polypeptide fused to a cell-penetrating peptide. In some embodiments, the Cas9 protein comprises a Cas9 polypeptide fused to a PTD. In some embodiments, the Cas9 protein comprises a Cas9 polypeptide fused to a tat domain. In some embodiments, the Cas9 protein comprises a Cas9 polypeptide fused to an oligoarginine domain. In some embodiments, the Cas9 protein comprises a Cas9 polypeptide fused to a penetratin domain. In some embodiments, the Cas9 protein comprises a Cas9 polypeptide fused to a superpositively charged GFP. In some embodiments, the Cpf1 protein comprises a Cpf1 polypeptide fused to a cell-penetrating peptide. In some embodiments, the Cpf1 protein comprises a Cpf1 polypeptide fused to a PTD. In some embodiments, the Cpf1 protein comprises a Cpf1 polypeptide fused to a tat domain. In some embodiments, the Cpf1 protein comprises a Cpf1 polypeptide fused to an oligoarginine domain. In some embodiments, the Cpf1 protein comprises a Cpf1 polypeptide fused to a penetratin domain. In some embodiments, the Cpf1 protein comprises a Cpf1 polypeptide fused to a superpositively charged GFP.

In some embodiments, the Cas protein can be introduced into a cell containing the target polynucleotide sequence in the form of a nucleic acid encoding the Cas protein (e.g., Cas9 or Cpf1). The process of introducing the nucleic acids into cells can be achieved by any suitable technique. Suitable techniques include calcium phosphate or lipid-mediated transfection, electroporation, and transduction or infection using a viral vector. In some embodiments, the nucleic acid comprises DNA. In some embodiments, the nucleic acid comprises a modified DNA, as described herein. In some embodiments, the nucleic acid comprises mRNA. In some embodiments, the nucleic acid comprises a modified mRNA, as described herein (e.g., a synthetic, modified mRNA).

In some embodiments, nucleic acids encoding Cas protein and nucleic acids encoding the at least one to two ribonucleic acids are introduced into a cell via viral transduction (e.g., lentiviral transduction).

In some embodiments, the Cas protein is complexed with one to two ribonucleic acids. In some embodiments, the Cas protein is complexed with two ribonucleic acids. In some embodiments, the Cas protein is complexed with one ribonucleic acid. In some embodiments, the Cas protein is encoded by a modified nucleic acid, as described herein (e.g., a synthetic, modified mRNA).

The methods of the present invention contemplate the use of any ribonucleic acid that is capable of directing a Cas protein to and hybridizing to a target motif of a target polynucleotide sequence. In some embodiments, at least one of the ribonucleic acids comprises tracrRNA. In some embodiments, at least one of the ribonucleic acids comprises CRISPR RNA (crRNA). In some embodiments, a single ribonucleic acid comprises a guide RNA that directs the Cas protein to and hybridizes to a target motif of the target polynucleotide sequence in a cell. In some embodiments, at least one of the ribonucleic acids comprises a guide RNA that directs the Cas protein to and hybridizes to a target motif of the target polynucleotide sequence in a cell. In some embodiments, both of the one to two ribonucleic acids comprise a guide RNA that directs the Cas protein to and hybridizes to a target motif of the target polynucleotide sequence in a cell. The ribonucleic acids of the present invention can be selected to hybridize to a variety of different target motifs, depending on the particular CRISPR/Cas system employed, and the sequence of the target polynucleotide, as will be appreciated by those skilled in the art. The one to two ribonucleic acids can also be selected to minimize hybridization with nucleic acid sequences other than the target polynucleotide sequence. In some embodiments, the one to two ribonucleic acids hybridize to a target motif that contains at least two mismatches when compared with all other genomic nucleotide sequences in the cell. In some embodiments, the one to two ribonucleic acids hybridize to a target motif that contains at least one mismatch when compared with all other genomic nucleotide sequences in the cell. In some embodiments, the one to two ribonucleic acids are designed to hybridize to a target motif immediately adjacent to a deoxyribonucleic acid motif recognized by the Cas protein. In some embodiments, each of the one to two ribonucleic acids are designed to hybridize to target motifs immediately adjacent to deoxyribonucleic acid motifs recognized by the Cas protein which flank a mutant allele located between the target motifs.

In some embodiments, at least one of the one to two ribonucleic acids comprises a sequence selected from the group consisting of the ribonucleic acid sequences of SEQ ID NOs: 2-817976. In some embodiments, at least one ribonucleic acid comprises a sequence selected from the group consisting of the ribonucleic acid sequences of SEQ ID NOs: 2-817976.

In some embodiments, at least one of the one to two ribonucleic acids comprises a sequence with a single nucleotide mismatch to a sequence selected from the group consisting of the ribonucleic acid sequences of SEQ ID NOs: 2-817976. In some embodiments, at least one ribonucleic acid comprises a sequence with a single nucleotide mismatch to a sequence selected from the group consisting of the ribonucleic acid sequences of SEQ ID NOs: 2-817976.

In some embodiments, each of the one to two ribonucleic acids comprises guide RNAs that directs the Cas protein to and hybridizes to a target motif of the target polynucleotide sequence in a cell. In some embodiments, one or two ribonucleic acids (e.g., guide RNAs) are complementary to and/or hybridize to sequences on the same strand of a target polynucleotide sequence. In some embodiments, one or two ribonucleic acids (e.g., guide RNAs) are complementary to and/or hybridize to sequences on the opposite strands of a target polynucleotide sequence. In some embodiments, the one or two ribonucleic acids (e.g., guide RNAs) are not complementary to and/or do not hybridize to sequences on the opposite strands of a target polynucleotide sequence. In some embodiments, the one or two ribonucleic acids (e.g., guide RNAs) are complementary to and/or hybridize to overlapping target motifs of a target polynucleotide sequence. In some embodiments, the one or two ribonucleic acids (e.g., guide RNAs) are complementary to and/or hybridize to offset target motifs of a target polynucleotide sequence.

In some embodiments, the target motif is a 17 to 23 nucleotide DNA sequence. In some embodiments, the target motif is at least 20 nucleotides in length. In some embodiments, the target motif is a 20-nucleotide DNA sequence. In some embodiments, the target motif is a 17 to 23-nucleotide DNA sequence and immediately precedes an NRG motif. In some aspects, the NRG motif is NGG or NAG. In some embodiments, the target motif is a 20-nucleotide DNA sequence and immediately precedes an NGG motif recognized by the Cas protein. In some embodiments, the target motif is a 20-nucleotide DNA sequence and immediately precedes an NAG motif recognized by the Cas protein. In some embodiments, the target motif is a 20-nucleotide DNA sequence beginning with G and immediately precedes an NGG motif recognized by the Cas protein. In some embodiments, the target motif is G(N)19NGG. In some embodiments, the target motif is (N)20NGG.

In some embodiments, the target motif is a 17 to 23-nucleotide DNA sequence and immediately precedes an NNGRRT motif. In some embodiments, the target motif is a 20 nucleotide DNA sequence and immediately precedes an NNGRRT motif. In some embodiments, the target motif is a 17 to 23-nucleotide DNA sequence and immediately precedes an NNNRRT motif. In some embodiments, the target motif is a 20 nucleotide DNA sequence and immediately precedes an NNNRRT motif. In some embodiments, the target motif is a 17 to 23-nucleotide DNA sequence and immediately precedes an NNAGAAW motif. In some embodiments, the target motif is a 20 nucleotide DNA sequence and immediately precedes an NNAGAAW motif. In some embodiments, the target motif is a 17 to 23-nucleotide DNA sequence and immediately precedes an NNNNGATT motif. In some embodiments, the target motif is a 20 nucleotide DNA sequence and immediately precedes an NNNNGATT motif. In some embodiments, the target motif is a 17 to 23-nucleotide DNA sequence and immediately precedes an NAAAAC motif. In some embodiments, the target motif is a 20 nucleotide DNA sequence and immediately precedes an NAAAAC motif. In some embodiments, the target motif is a 17 to 23-nucleotide DNA sequence having a 5' T-rich region (e.g., TTTN motif). In some embodiments, the target motif is a 20 nucleotide DNA sequence having a 5' T-rich region (e.g., TTTN motif).

In some embodiments, the target motif is a 17 to 23-nucleotide DNA sequence and immediately precedes an NRG motif (e.g., NGG or NAG) recognized by a *S. pyogenes* Cas9 protein. In some embodiments, the target motif is a 17 to 23-nucleotide DNA sequence and immediately precedes an NNGRRT motif recognized by a *S. aureus* Cas9 protein. In some embodiments, the target motif is a 17 to 23-nucleotide DNA sequence and immediately precedes an NNNRRT motif recognized by a *S. aureus* Cas9 protein. In some embodiments, the target motif is a 17 to 23-nucleotide DNA sequence and immediately precedes an NNAGAAW motif recognized by a *S. thermophilus* Cas9 protein. In some embodiments, the target motif is a 17 to 23-nucleotide DNA sequence and immediately precedes an NNNNGATT motif recognized by *N. meningitides* Cas9 protein. In some embodiments, the target motif is a 17 to 23-nucleotide DNA sequence and immediately precedes an NAAAAC motif recognized by *T. denticola* Cas9 protein. In some embodiments, the target motif is a 17 to 23-nucleotide DNA sequence having a 5' T-rich region (e.g., TTTN motif) recognized by *Acidaminococcus* or *Lachnospiraceae* Cpf1 protein.

In some embodiments, the one to two ribonucleic acids hybridize to a target motif that contains at least two mismatches when compared with all other genomic nucleotide sequences in the cell. In some embodiments, the one to two ribonucleic acids hybridize to a target motif that contains at least one mismatch when compared with all other genomic nucleotide sequences in the cell. Those skilled in the art will appreciate that a variety of techniques can be used to select suitable target motifs for minimizing off-target effects (e.g., bioinformatics analyses). In some embodiments, the one to two ribonucleic acids are designed to hybridize to a target motif immediately adjacent to a deoxyribonucleic acid motif recognized by the Cas protein. In some embodiments, each of the one to two ribonucleic acids are designed to hybridize to target motifs immediately adjacent to deoxyribonucleic acid motifs recognized by the Cas protein which flank a mutant allele located between the target motifs.

In some aspects, the target polynucleotide sequence in a cell is altered to reduce or eliminate expression and/or activity of one or more critical immune genes in the cell using a genetic editing system (e.g., TALENs, CRISPR/Cas, etc.). In some embodiments, the present disclosure provides that the target polynucleotide sequence in a cell is altered to delete a contiguous stretch of genomic DNA (e.g., delete one or more critical immune genes) from one or both alleles of the cell (e.g., using a CRISPR/Cas system). In some embodiments, the target polynucleotide sequence in a cell is altered to insert a genetic mutation in one or both alleles of the cell (e.g., using a CRISPR/Cas system). In still other embodiments, the universal stem cells disclosed herein may be subject to complementary genome editing approaches (e.g., using a CRISPR/Cas system), whereby such stem cells are modified to both delete contiguous stretches of genomic DNA (e.g., critical immune genes) from one or both alleles of the cell, as well as to insert one or more tolerance-inducing factors, such as HLA-G or PD-L1, into one or both alleles of the cells to locally suppress the immune system and improve transplant engraftment.

The universal stem cells disclosed herein may be differentiated into relevant cell types to assess HLA expression, as well as the evaluation of immunogenicity of the universal stem cell lines, for example, in a pre-clinical humanized mouse model. For example, the universal stem cells disclosed herein may be incubated under appropriate conditions and differentiated into mesenchymal progenitors cells (MPCs), hypoimmunogenic cardiomyocytes, endothelial cells (ECs), macrophages, hepatocytes, beta cells (e.g., pancreatic beta cells), or neural progenitor cells (NPCs).

The universal stem cells and methods disclosed herein will have an enormous impact on regenerative medicine by leading the way to rigorously tested universal donor stem cell lines that could be grown up and differentiated into a very large numbers of cells, made widely available to all medical institutions, and used on demand to treat patients suffering from degenerative illnesses, and thereby make it unnecessary to use a patient's own cells on a case-by-case basis as a source for autologous transplantation. Moreover, as the resulting cell products will be protected from immune attack, they will represent a new form of treatment for autoimmune diseases such as MS (multiple sclerosis) and diabetes, where autologous cells would still be prone to immune attack. Immunoprivileged universal donor stem cell-derived cell products, however, will be protected from autoimmune rejection.

The universal stem cells disclosed herein may be used, for example, to diagnose, monitor, treat and/or cure the presence or progression of a disease or condition in a subject. As used herein, a "subject" means a human or animal. In certain embodiments, the subject is a human. In certain embodiments, the subject is an adolescent. In certain embodiments, the subject is treated in vivo, in vitro and/or in utero. In certain aspects, a subject in need of treatment in accordance with the methods disclosed herein has a condition or is suspected or at increased risk of developing such condition.

Figure 2A:
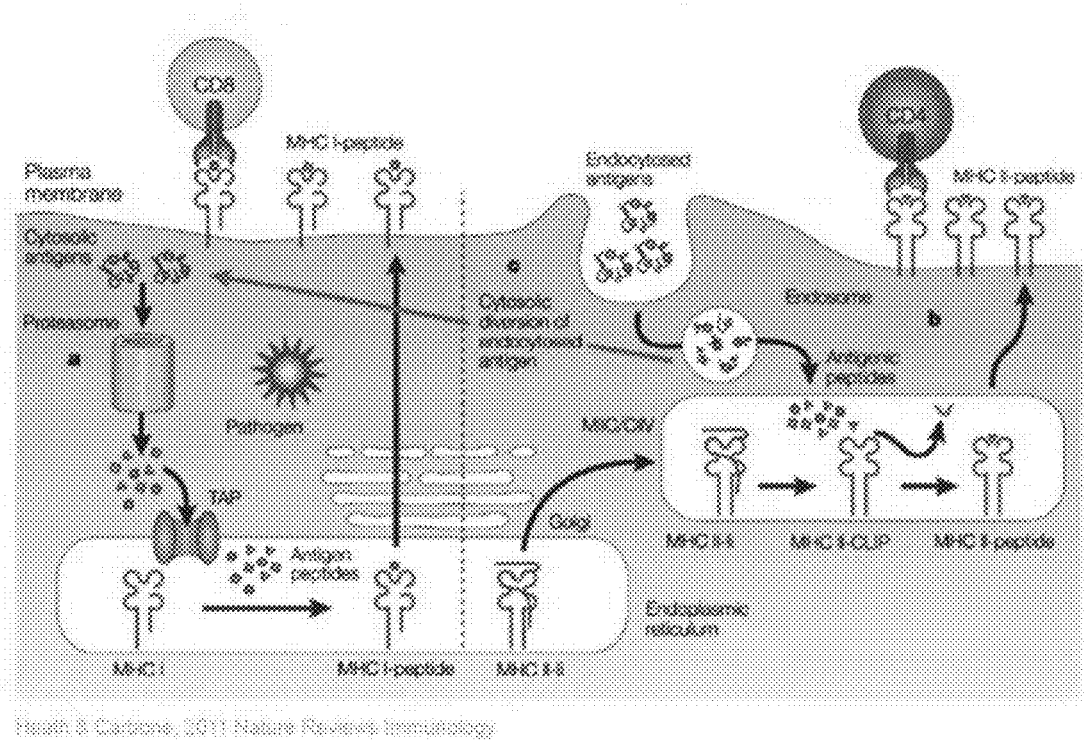
FIGS. 2A-2B graphically depict the HLA barrier in transplantation.
Figure 2B:
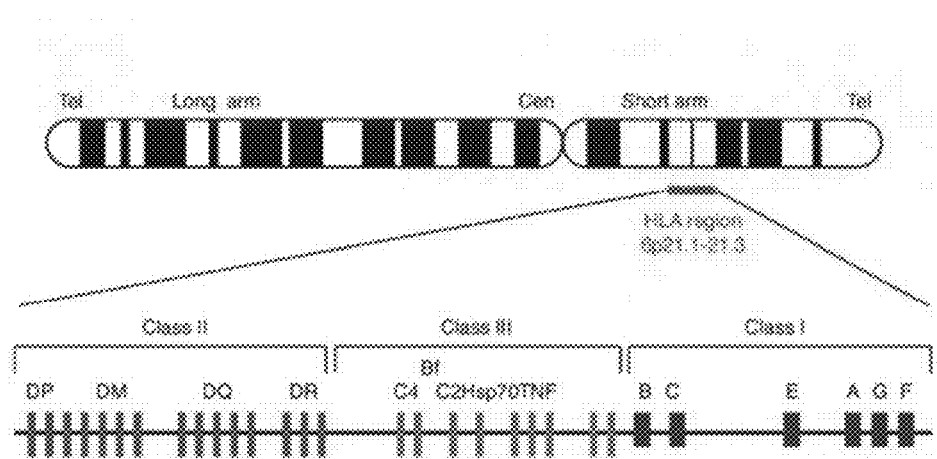
Figure 13:
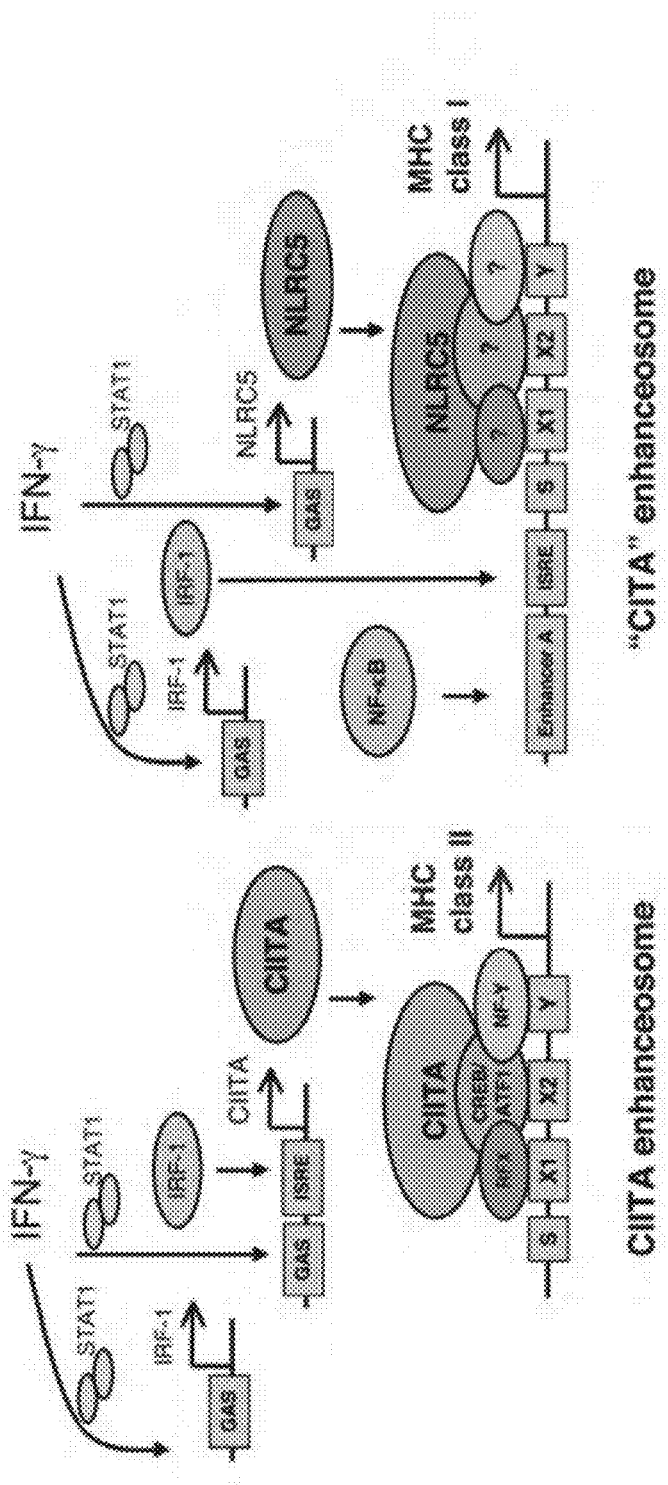
FIG. 13 illustrates a comparison of the MHC-II and MHC-I enhanceosomes.

As depicted in FIG. 2A, HLA represents an immunologic barrier to the successful transplantation of stem cells or differentiated stem cells in a subject. Disclosed herein are novel compositions, cells and related methods that are useful for overcoming the HLA immunologic barrier to transplantation. As illustrated in FIG. 2B, major histocompatibility complex (MHC) is a locus on human Chr. 6p21, which encodes a highly polymorphic gene family of surface molecules that define donor compatibility during organ transplantation. MHC class I (MHC-I) and MHC class II (MHC-II) play essential roles in the activation of adaptive immune responses by presenting antigens to T lymphocytes. A comparison of the MHC-II and MHC-I enhanceosomes is provided in FIG. 13. Humans have three classical MHC-Ia molecules (HLA-A, HLA-B, and HLA-C), which are vital to the detection and elimination of viruses, cancerous cells, and transplanted cells. In addition, there are three non-classical MHC-Ib molecules (HLA-E, HLA-F, and HLA-G), which have immune regulatory functions. While MHC's serve a vital cellular function, in certain contexts, such as cell-based transplantation therapies, they may also contribute to immune rejection. Provided herein are novel cells, compositions and methods that are useful for addressing such HLA-based immune rejection of transplanted cells.

Knock-Outs

In certain aspects, the inventions disclosed herein relate to genomic modifications of one or more targeted polynucleotide sequences of the stem cell genome that regulates the expression of MHC-I and/or MHC-II. In some aspects, a genetic editing system is used to modify one or more targeted polynucleotide sequences. In some aspects, a CRISPR/Cas system is used to delete the one or more targeted polynucleotide sequences. MHC-I molecules are composed of MHC-encoded heavy chains and the invariant subunit β2-microglobulin (B2M). Antigen-derived peptides are presented by MHC-I-B2M complexes at the cell surface to CD8 T cells carrying an antigen-specific T cell receptor. Peptides are mostly produced from the degradation of cytoplasmic proteins by a specialized proteasome or immunoproteasome, which is optimized to generate MHC class I peptides and contains several IFN-γ-inducible subunits. Unlike MHC-II, which is found mainly in antigen-presenting cells, MHC-Ia is ubiquitously expressed in almost all nucleated cells (Pamer, et al., Annu Rev Immunol (1998) 16:323-358). Both MHC-I and MHC-II genes are highly inducible by IFN-γ stimulation.

The efficient removal of the HLA barrier can be accomplished by one or more of the following: (1) targeting the polymorphic HLA alleles (HLA-A, -B, -C) and MHC-II genes directly; (2) removal of B2M, which will prevent surface trafficking of all MHC-I molecules; and/or (3) deletion of components of the MHC enhanceosomes, such as NLRC5, RFX-5, -ANK, and -AP, IRF1, NF-Y, and CIITA that are critical for HLA expression.

In certain embodiments, HLA expression is interfered with. In some aspects, HLA expression is interfered with by targeting individual HLAs (e.g., knocking out expression of HLA-A, HLA-B and/or HLA-C), targeting transcriptional regulators of HLA expression (e.g., knocking out expression of NLRC5, CIITA, RFX5, RFXAP, RFXANK, NFY-A, NFY-B, NFY-C and/or IRF-1), blocking surface trafficking of MHC class I molecules (e.g., knocking out expression of B2M and/or TAP1), and/or targeting HLA-Razor.

In certain aspects, the stem cells disclosed herein do not express one or more human leukocyte antigens (e.g., HLA-A, HLA-B and/or HLA-C) corresponding to MHC-I and/or MHC-II and are thus characterized as being hypoimmunogenic. For example, in certain aspects, the stem cells disclosed herein have been modified such that the stem cell or a differentiated stem cell prepared therefrom do not express or exhibit reduced expression of one or more of the following MHC-I molecules: HLA-A, HLA-B and HLA-C. In some aspects, one or more of HLA-A, HLA-B and HLA-C may be "knocked-out" of a cell. A cell that has a knocked-out HLA-A gene, HLA-B gene, and/or HLA-C gene may exhibit reduced or eliminated expression of each knocked-out gene. See FIGS. 13A-J.

In some aspects, the present disclosure provides a stem cell (e.g., hypoimmunogenic stem cell) or population thereof comprising a genome in which the HLA-A gene has been edited to delete a contiguous stretch of genomic DNA, thereby reducing or eliminating surface expression of MHC class I molecules in the cell or population thereof. The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 2-1418.

In certain aspects, the present disclosure provides a method for altering a target HLA-A sequence in a cell comprising contacting the HLA-A sequence with a clustered regularly interspaced short palindromic repeats-associated (Cas) protein and at least one ribonucleic acid or at least one pair of ribonucleic acids, wherein the ribonucleic acids direct Cas protein to and hybridize to a target motif of the target HLA-A polynucleotide sequence, wherein the target HLA-A polynucleotide sequence is cleaved, and wherein the at least one ribonucleic acid or the at least one pair of ribonucleic acids is selected from the group consisting of SEQ ID NOs: 2-1418.

In some aspects, the present disclosure provides a stem cell (e.g., hypoimmunogenic stem cell) or population thereof comprising a genome in which the HLA-B gene has been edited to delete a contiguous stretch of genomic DNA, thereby reducing or eliminating surface expression of MHC class I molecules in the cell or population thereof. The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 1419-3277.

In certain aspects, the present disclosure provides a method for altering a target HLA-B sequence in a cell comprising contacting the HLA-B sequence with a clustered regularly interspaced short palindromic repeats-associated (Cas) protein and at least one ribonucleic acid or at least one pair of ribonucleic acids, wherein the ribonucleic acids direct Cas protein to and hybridize to a target motif of the target HLA-B polynucleotide sequence, wherein the target HLA-B polynucleotide sequence is cleaved, and wherein the at least one ribonucleic acid or the at least one pair of ribonucleic acids is selected from the group consisting of SEQ ID NOs: 1419-3277.

In some aspects, the present disclosure provides a stem cell (e.g., hypoimmunogenic stem cell) or population thereof comprising a genome in which the HLA-C gene has been edited to delete a contiguous stretch of genomic DNA, thereby reducing or eliminating surface expression of MHC class I molecules in the cell or population thereof. The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 3278-5183.

In certain aspects, the present disclosure provides a method for altering a target HLA-C sequence in a cell comprising contacting the HLA-C sequence with a clustered regularly interspaced short palindromic repeats-associated (Cas) protein and at least one ribonucleic acid or at least one pair of ribonucleic acids, wherein the ribonucleic acids direct Cas protein to and hybridize to a target motif of the target HLA-C polynucleotide sequence, wherein the target HLA-C polynucleotide sequence is cleaved, and wherein the at least one ribonucleic acid or the at least one pair of ribonucleic acids is selected from the group consisting of SEQ ID NOs: 3278-5183.

In certain embodiments, the expression of MHC-I or MHC-II is modulated by targeting and deleting a contiguous stretch of genomic DNA thereby reducing or eliminating expression of a target gene, for example, NLRC5. As used herein, the term "modulate" is used consistently with its use in the art, i.e., meaning to cause or facilitate a qualitative or quantitative change, alteration, or modification in a process, pathway, or phenomenon of interest. Without limitation, such change may be an increase, decrease, or change in relative strength or activity of different components or branches of the process, pathway, or phenomenon. In certain aspects, the target gene is NLRC5, CIITA, RFX5, RFXAP, RFXANK, NFY-A, NFY-B, NFY-C or IRF-1.

In certain aspects, the inventions disclosed herein modulate (e.g., reduce or eliminate) the expression of MHC-II genes by targeting and modulating (e.g., reducing or eliminating) Class II transactivator (CIITA) expression. In some aspects, the modulation occurs using a CRISPR/Cas system. CIITA is a member of the NLR or nucleotide binding domain (NBD) leucine-rich repeat (LRR) family of proteins and regulates the transcription of MHC-II by associating with the MHC enhanceosome. The expression of CIITA is induced in B cells and dendritic cells as a function of developmental stage and is inducible by IFN-γ in most cell types. Aside from CIITA, NLR proteins are localized in the cytoplasm and contribute to the innate immune response by recognizing microbial products and exogenous danger signals, leading to inflammation and/or cell death.

In some aspects, the present disclosure provides a stem cell (e.g., hypoimmunogenic stem cell) or population thereof comprising a genome in which the Class II transactivator (CIITA) gene has been edited to delete a contiguous stretch of genomic DNA, thereby reducing or eliminating surface expression of MHC class II molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 5184-36352.

The present invention contemplates genomically editing human cells to cleave CIITA gene sequences, as well as editing the genome of such cells to alter one or more additional target polynucleotide sequences (e.g., NLRC5 and/or B2M). It should be appreciated that cleaving a CIITA genomic sequence using one or more gRNAs or gRNA pairs described herein and a Cas protein could result in partial or complete deletion of the target CIITA genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the CIITA gene has been edited to delete a contiguous stretch of genomic DNA, thereby reducing or eliminating MHC Class II molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 5184-36352.

In some aspects, the invention provides a method for altering a target CIITA polynucleotide sequence in a cell comprising contacting the CIITA polynucleotide sequence with a clustered regularly interspaced short palindromic repeats-associated (Cas) protein and from one to two ribonucleic acids, wherein the ribonucleic acids direct Cas protein to and hybridize to a target motif of the target CIITA polynucleotide sequence, wherein the target CIITA polynucleotide sequence is cleaved, and wherein at least one of the one to two ribonucleic acids are selected from the group consisting of SEQ ID NOs: 5184-36352.

In some aspects, the invention provides a stem cell (e.g., hypoimmunogenic stem cell) or population thereof, each cell comprising a modified genome comprising: a genomic modification in which the CIITA gene has been edited to reduce or eliminate CIITA surface expression and/or activity in the cell by contacting the cell with a Cas protein or a nucleic acid encoding the Cas protein and at least one ribonucleic acid having a sequence selected from the group consisting of SEQ ID NOs: 5184-36352.

In some aspects, the invention provides a method for altering a target CIITA polynucleotide sequence in a cell comprising contacting the CIITA polynucleotide sequence with a clustered regularly interspaced short palindromic repeats-associated (Cas) protein and at least one ribonucleic acid, wherein the ribonucleic acid directs Cas protein to and hybridizes to a target motif of the target CIITA polynucleotide sequence, wherein the target CIITA polynucleotide sequence is cleaved, and wherein the at least one ribonucleic acid is selected from the group consisting of SEQ ID NOs: 5184-36352.

In certain aspects, the inventions disclosed herein modulate (e.g., reduce or eliminate) the expression of MHC-I genes by targeting and modulating (e.g., reducing or eliminating) expression of the NLR family, CARD domain containing 5/NOD27/CLR16.1 (NLRC5). In some aspects, the modulation occurs using a CRISPR/Cas system. NLRC5 is a critical regulator of MHC-I-mediated immune responses and, similar to CIITA, NLRC5 is highly inducible by IFN-γ and can translocate into the nucleus. NLRC5 activates the promoters of MHC-I genes and induces the transcription of MHC-I as well as related genes involved in MHC-I antigen presentation.

In some aspects, the present disclosure provides a stem cell (e.g., hypoimmunogenic stem cell) or population thereof comprising a genome in which the NLRC5 gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 36353-81239.

The present invention contemplates genomically editing human cells to cleave NLRC5 gene sequences, as well as editing the genome of such cells to alter one or more additional target polynucleotide sequences (e.g., CIITA and/or B2M). It should be appreciated that cleaving a NLRC5 genomic sequence using one or more gRNAs or gRNA pairs described herein and a Cas protein could result in partial or complete deletion of the target NLRC5 genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the NLRC5 gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 36353-81239.

In some aspects, the invention provides a method for altering a target NLRC5 polynucleotide sequence in a cell comprising contacting the NLRC5 polynucleotide sequence with a clustered regularly interspaced short palindromic repeats-associated (Cas) protein and from one to two ribonucleic acids, wherein the ribonucleic acids direct Cas protein to and hybridize to a target motif of the target NLRC5 polynucleotide sequence, wherein the target NLRC5 polynucleotide sequence is cleaved, and wherein at least one of the one to two ribonucleic acids are selected from the group consisting of SEQ ID NOs: 36353-81239.

In some aspects, the invention provides a stem cell (e.g., hypoimmunogenic stem cell) or population thereof, each cell comprising a modified genome comprising: a genomic modification in which the NLRC5 gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 36353-81239.

In some aspects, the invention provides a method for altering a target NLRC5 polynucleotide sequence in a cell comprising contacting the NLRC5 polynucleotide sequence with a clustered regularly interspaced short palindromic repeats-associated (Cas) protein and at least one ribonucleic acid, wherein the ribonucleic acid directs Cas protein to and hybridizes to a target motif of the target NLRC5 polynucleotide sequence, wherein the target NLRC5 polynucleotide sequence is cleaved, and wherein the at least one ribonucleic acid is selected from the group consisting of SEQ ID NOs: 36353-81239.

In certain embodiments, the inventions disclosed herein modulate (e.g., reduce or eliminate) the expression of MHC-I genes by targeting and modulating (e.g., reducing or eliminating) expression of the accessory chain B2M. In some aspects, the modulation occurs using a CRISPR/Cas system. By modulating (e.g., reducing or deleting) expression of B2M, surface trafficking of MHC-I molecules is blocked and the cell rendered hypoimmunogenic.

In some aspects, the present disclosure provides a stem cell (e.g., hypoimmunogenic stem cell) or population thereof comprising a genome in which the 32-microglobulin (B2M) gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 81240-85644.

The present invention contemplates genomically editing human cells to cleave B2M gene sequences, as well as editing the genome of such cells to alter one or more additional target polynucleotide sequences (e.g., NLRC5 and/or CIITA). It should be appreciated that cleaving a B2M genomic sequence using one or more gRNAs or gRNA pairs described herein and a Cas protein could result in partial or complete deletion of the target B2M genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the B2M gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 81240-85644.

In some aspects, the invention provides a method for altering a target B2M polynucleotide sequence in a cell comprising contacting the B2M polynucleotide sequence with a clustered regularly interspaced short palindromic repeats-associated (Cas) protein and from one to two ribonucleic acids, wherein the ribonucleic acids direct Cas protein to and hybridize to a target motif of the target B2M polynucleotide sequence, wherein the target B2M polynucleotide sequence is cleaved, and wherein at least one of the one to two ribonucleic acids are selected from the group consisting of SEQ ID NOs: 81240-85644.

In some aspects, the invention provides a stem cell (e.g., hypoimmunogenic stem cell) or population thereof, each cell comprising a modified genome comprising: a genomic modification in which the B2M gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 81240-85644.

In some aspects, the invention provides a method for altering a target B2M polynucleotide sequence in a cell comprising contacting the B2M polynucleotide sequence with a clustered regularly interspaced short palindromic repeats-associated (Cas) protein and at least one ribonucleic acid, wherein the ribonucleic acid directs Cas protein to and hybridizes to a target motif of the target B2M polynucleotide sequence, wherein the target B2M polynucleotide sequence is cleaved, and wherein the at least one ribonucleic acid is selected from the group consisting of SEQ ID NOs:

In certain aspects, the inventions disclosed herein modulate (e.g., reduce or eliminate) the expression of MHC-I genes by targeting and modulating (e.g., reducing or eliminating) expression of one or more of RFX5. In some aspects, the modulation occurs using a CRISPR/Cas system.

In some aspects, the present disclosure provides a stem cell (e.g., hypoimmunogenic stem cell) or population thereof comprising a genome in which the RFX5 gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 85645-90115.

The present invention contemplates genomically editing human cells to cleave RFX5 gene sequences, as well as editing the genome of such cells to alter one or more additional target polynucleotide sequences. It should be appreciated that cleaving a RFX5 genomic sequence using one or more gRNAs or gRNA pairs described herein and a Cas protein could result in partial or complete deletion of the target RFX5 genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the RFX5 gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 85645-90115.

In some aspects, the invention provides a method for altering a target RFX5 polynucleotide sequence in a cell comprising contacting the RFX5 polynucleotide sequence with a clustered regularly interspaced short palindromic repeats-associated (Cas) protein and from one to two ribonucleic acids, wherein the ribonucleic acids direct Cas protein to and hybridize to a target motif of the target RFX5 polynucleotide sequence, wherein the target RFX5 polynucleotide sequence is cleaved, and wherein at least one of the one to two ribonucleic acids are selected from the group consisting of SEQ ID NOs: 85645-90115.

In some aspects, the invention provides a stem cell (e.g., hypoimmunogenic stem cell) or population thereof, each cell comprising a modified genome comprising: a genomic modification in which the RFX5 gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 85645-90115.

In some aspects, the invention provides a method for altering a target RFX5 polynucleotide sequence in a cell comprising contacting the RFX5 polynucleotide sequence with a clustered regularly interspaced short palindromic repeats-associated (Cas) protein and at least one ribonucleic acid, wherein the ribonucleic acid directs Cas protein to and hybridizes to a target motif of the target RFX5 polynucleotide sequence, wherein the target RFX5 polynucleotide sequence is cleaved, and wherein the at least one ribonucleic acid is selected from the group consisting of SEQ ID NOs: 85645-90115.

In certain aspects, the inventions disclosed herein modulate (e.g., reduce or eliminate) the expression of MHC-I genes by targeting and modulating (e.g., reducing or eliminating) expression of one or more of RFXAP. In some aspects, the modulation occurs using a CRISPR/Cas system.

In some aspects, the present disclosure provides a stem cell (e.g., hypoimmunogenic stem cell) or population thereof comprising a genome in which the RFXAP gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 90116-95635.

The present invention contemplates genomically editing human cells to cleave RFXAP gene sequences, as well as editing the genome of such cells to alter one or more additional target polynucleotide sequences. It should be appreciated that cleaving a RFXAP genomic sequence using one or more gRNAs or gRNA pairs described herein and a Cas protein could result in partial or complete deletion of the target RFXAP genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the RFXAP gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 90116-95635.

In some aspects, the invention provides a method for altering a target RFXAP polynucleotide sequence in a cell comprising contacting the RFXAP polynucleotide sequence with a clustered regularly interspaced short palindromic repeats-associated (Cas) protein and from one to two ribonucleic acids, wherein the ribonucleic acids direct Cas protein to and hybridize to a target motif of the target RFXAP polynucleotide sequence, wherein the target RFXAP polynucleotide sequence is cleaved, and wherein at least one of the one to two ribonucleic acids are selected from the group consisting of SEQ ID NOs: 90116-95635.

In some aspects, the invention provides a stem cell (e.g., hypoimmunogenic stem cell) or population thereof, each cell comprising a modified genome comprising: a genomic modification in which the RFXAP gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 90116-95635.

In some aspects, the invention provides a method for altering a target RFXAP polynucleotide sequence in a cell comprising contacting the RFXAP polynucleotide sequence with a clustered regularly interspaced short palindromic repeats-associated (Cas) protein and at least one ribonucleic acid, wherein the ribonucleic acid directs Cas protein to and hybridizes to a target motif of the target RFXAP polynucleotide sequence, wherein the target RFXAP polynucleotide sequence is cleaved, and wherein the at least one ribonucleic acid is selected from the group consisting of SEQ ID NOs: 90116-95635.

In certain aspects, the inventions disclosed herein modulate (e.g., reduce or eliminate) the expression of MHC-I genes by targeting and modulating (e.g., reducing or eliminating) expression of one or more of RFXANK. In some aspects, the modulation occurs using a CRISPR/Cas system.

In some aspects, the present disclosure provides a stem cell (e.g., hypoimmunogenic stem cell) or population thereof comprising a genome in which the RFXANK gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 95636-102318.

The present invention contemplates genomically editing human cells to cleave RFXANK gene sequences, as well as editing the genome of such cells to alter one or more additional target polynucleotide sequences. It should be appreciated that cleaving a RFXANK genomic sequence using one or more gRNAs or gRNA pairs described herein and a Cas protein could result in partial or complete deletion of the target RFXANK genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the RFXAP gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 95636-102318.

In some aspects, the invention provides a method for altering a target RFXANK polynucleotide sequence in a cell comprising contacting the RFXANK polynucleotide sequence with a clustered regularly interspaced short palindromic repeats-associated (Cas) protein and from one to two ribonucleic acids, wherein the ribonucleic acids direct Cas protein to and hybridize to a target motif of the target RFXANK polynucleotide sequence, wherein the target RFXANK polynucleotide sequence is cleaved, and wherein at least one of the one to two ribonucleic acids are selected from the group consisting of SEQ ID NOs: 95636-102318.

In some aspects, the invention provides a stem cell (e.g., hypoimmunogenic stem cell) or population thereof, each cell comprising a modified genome comprising: a genomic modification in which the RFXANK gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 95636-102318.

In some aspects, the invention provides a method for altering a target RFXANK polynucleotide sequence in a cell comprising contacting the RFXANK polynucleotide sequence with a clustered regularly interspaced short palindromic repeats-associated (Cas) protein and at least one ribonucleic acid, wherein the ribonucleic acid directs Cas protein to and hybridizes to a target motif of the target RFXANK polynucleotide sequence, wherein the target RFXANK polynucleotide sequence is cleaved, and wherein the at least one ribonucleic acid is selected from the group consisting of SEQ ID NOs: 95636-102318.

In certain aspects, the inventions disclosed herein modulate (e.g., reduce or eliminate) the expression of MHC-I genes by targeting and modulating (e.g., reducing or eliminating) expression of one or more of NFY-A. In some aspects, the modulation occurs using a CRISPR/Cas system.

In some aspects, the present disclosure provides a stem cell (e.g., hypoimmunogenic stem cell) or population thereof comprising a genome in which the NFY-A gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 102319-121796.

The present invention contemplates genomically editing human cells to cleave NFY-A gene sequences, as well as editing the genome of such cells to alter one or more additional target polynucleotide sequences. It should be appreciated that cleaving a NFY-A genomic sequence using one or more gRNAs or gRNA pairs described herein and a Cas protein could result in partial or complete deletion of the target NFY-A genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the NFY-A gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 102319-121796.

In some aspects, the invention provides a method for altering a target NFY-A polynucleotide sequence in a cell comprising contacting the NFY-A polynucleotide sequence with a clustered regularly interspaced short palindromic repeats-associated (Cas) protein and from one to two ribonucleic acids, wherein the ribonucleic acids direct Cas protein to and hybridize to a target motif of the target NFY-A polynucleotide sequence, wherein the target NFY-A polynucleotide sequence is cleaved, and wherein at least one of the one to two ribonucleic acids are selected from the group consisting of SEQ ID NOs: 102319-121796.

In some aspects, the invention provides a stem cell (e.g., hypoimmunogenic stem cell) or population thereof, each cell comprising a modified genome comprising: a genomic modification in which the NFY-A gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 102319-121796.

In some aspects, the invention provides a method for altering a target NFY-A polynucleotide sequence in a cell comprising contacting the NFY-A polynucleotide sequence with a clustered regularly interspaced short palindromic repeats-associated (Cas) protein and at least one ribonucleic acid, wherein the ribonucleic acid directs Cas protein to and hybridizes to a target motif of the target NFY-A polynucleotide sequence, wherein the target NFY-A polynucleotide sequence is cleaved, and wherein the at least one ribonucleic acid is selected from the group consisting of SEQ ID NOs: 102319-121796.

In certain aspects, the inventions disclosed herein modulate (e.g., reduce or eliminate) the expression of MHC-I genes by targeting and modulating (e.g., reducing or eliminating) expression of one or more of NFY-B. In some aspects, the modulation occurs using a CRISPR/Cas system.

In some aspects, the present disclosure provides a stem cell (e.g., hypoimmunogenic stem cell) or population thereof comprising a genome in which the NFY-B gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 121797-135112.

The present invention contemplates genomically editing human cells to cleave NFY-B gene sequences, as well as editing the genome of such cells to alter one or more additional target polynucleotide sequences. It should be appreciated that cleaving a NFY-B genomic sequence using one or more gRNAs or gRNA pairs described herein and a Cas protein could result in partial or complete deletion of the target NFY-B genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the NFY-B gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 121797-135112.

In some aspects, the invention provides a method for altering a target NFY-B polynucleotide sequence in a cell comprising contacting the NFY-B polynucleotide sequence with a clustered regularly interspaced short palindromic repeats-associated (Cas) protein and from one to two ribonucleic acids, wherein the ribonucleic acids direct Cas protein to and hybridize to a target motif of the target NFY-B polynucleotide sequence, wherein the target NFY-B polynucleotide sequence is cleaved, and wherein at least one of the one to two ribonucleic acids are selected from the group consisting of SEQ ID NOs: 121797-135112.

In some aspects, the invention provides a stem cell (e.g., hypoimmunogenic stem cell) or population thereof, each cell comprising a modified genome comprising: a genomic modification in which the NFY-B gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 121797-135112.

In some aspects, the invention provides a method for altering a target NFY-B polynucleotide sequence in a cell comprising contacting the NFY-B polynucleotide sequence with a clustered regularly interspaced short palindromic repeats-associated (Cas) protein and at least one ribonucleic acid, wherein the ribonucleic acid directs Cas protein to and hybridizes to a target motif of the target NFY-B polynucleotide sequence, wherein the target NFY-B polynucleotide sequence is cleaved, and wherein the at least one ribonucleic acid is selected from the group consisting of SEQ ID NOs: 121797-135112.

In certain aspects, the inventions disclosed herein modulate (e.g., reduce or eliminate) the expression of MHC-I genes by targeting and modulating (e.g., reducing or eliminating) expression of one or more of NFY-C. In some aspects, the modulation occurs using a CRISPR/Cas system.

In some aspects, the present disclosure provides a stem cell (e.g., hypoimmunogenic stem cell) or population thereof comprising a genome in which the NFY-C gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 135113-176601.

The present invention contemplates genomically editing human cells to cleave NFY-C gene sequences, as well as editing the genome of such cells to alter one or more additional target polynucleotide sequences. It should be appreciated that cleaving a NFY-C genomic sequence using one or more gRNAs or gRNA pairs described herein and a Cas protein could result in partial or complete deletion of the target NFY-C genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the NFY-C gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 135113-176601.

In some aspects, the invention provides a method for altering a target NFY-C polynucleotide sequence in a cell comprising contacting the NFY-C polynucleotide sequence with a clustered regularly interspaced short palindromic repeats-associated (Cas) protein and from one to two ribonucleic acids, wherein the ribonucleic acids direct Cas protein to and hybridize to a target motif of the target NFY-C polynucleotide sequence, wherein the target NFY-C polynucleotide sequence is cleaved, and wherein at least one of the one to two ribonucleic acids are selected from the group consisting of SEQ ID NOs: 135113-176601.

In some aspects, the invention provides a stem cell (e.g., hypoimmunogenic stem cell) or population thereof, each cell comprising a modified genome comprising: a genomic modification in which the NFY-C gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 135113-176601.

In some aspects, the invention provides a method for altering a target NFY-C polynucleotide sequence in a cell comprising contacting the NFY-C polynucleotide sequence with a clustered regularly interspaced short palindromic repeats-associated (Cas) protein and at least one ribonucleic acid, wherein the ribonucleic acid directs Cas protein to and hybridizes to a target motif of the target NFY-C polynucleotide sequence, wherein the target NFY-C polynucleotide sequence is cleaved, and wherein the at least one ribonucleic acid is selected from the group consisting of SEQ ID NOs: 135113-176601.

In certain aspects, the inventions disclosed herein modulate (e.g., reduce or eliminate) the expression of MHC-I genes by targeting and modulating (e.g., reducing or eliminating) expression of one or more of IRF-1. In some aspects, the modulation occurs using a CRISPR/Cas system.

In some aspects, the present disclosure provides a stem cell (e.g., hypoimmunogenic stem cell) or population thereof comprising a genome in which the IRF-1 gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 176602-182813.

The present invention contemplates genomically editing human cells to cleave IRF-1 gene sequences, as well as editing the genome of such cells to alter one or more additional target polynucleotide sequences. It should be appreciated that cleaving a IRF-1 genomic sequence using one or more gRNAs or gRNA pairs described herein and a Cas protein could result in partial or complete deletion of the target IRF-1 genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the IRF-1 gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 176602-182813.

In some aspects, the invention provides a method for altering a target IRF-1 polynucleotide sequence in a cell comprising contacting the IRF-1 polynucleotide sequence with a clustered regularly interspaced short palindromic repeats-associated (Cas) protein and from one to two ribonucleic acids, wherein the ribonucleic acids direct Cas protein to and hybridize to a target motif of the target IRF-1 polynucleotide sequence, wherein the target IRF-1 polynucleotide sequence is cleaved, and wherein at least one of the one to two ribonucleic acids are selected from the group consisting of SEQ ID NOs: 176602-182813.

In some aspects, the invention provides a stem cell (e.g., hypoimmunogenic stem cell) or population thereof, each cell comprising a modified genome comprising: a genomic modification in which the IRF-1 gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 176602-182813.

In some aspects, the invention provides a method for altering a target IRF-1 polynucleotide sequence in a cell comprising contacting the IRF-1 polynucleotide sequence with a clustered regularly interspaced short palindromic repeats-associated (Cas) protein and at least one ribonucleic acid, wherein the ribonucleic acid directs Cas protein to and hybridizes to a target motif of the target IRF-1 polynucleotide sequence, wherein the target IRF-1 polynucleotide sequence is cleaved, and wherein the at least one ribonucleic acid is selected from the group consisting of SEQ ID NOs: 176602-182813.

In some aspects, the present disclosure provides a stem cell (e.g., hypoimmunogenic stem cell) or population thereof comprising a genome in which the TAP1 gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 182814-188371.

The present invention contemplates genomically editing human cells to cleave TAP1 gene sequences, as well as editing the genome of such cells to alter one or more additional target polynucleotide sequences. It should be appreciated that cleaving a TAP1 genomic sequence using one or more gRNAs or gRNA pairs described herein and a Cas protein could result in partial or complete deletion of the target TAP1 genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the TAP1 gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 182814-188371.

In some aspects, the invention provides a method for altering a target TAP1 polynucleotide sequence in a cell comprising contacting the TAP1 polynucleotide sequence with a clustered regularly interspaced short palindromic repeats-associated (Cas) protein and from one to two ribonucleic acids, wherein the ribonucleic acids direct Cas protein to and hybridize to a target motif of the target TAP1 polynucleotide sequence, wherein the target TAP1 polynucleotide sequence is cleaved, and wherein at least one of the one to two ribonucleic acids are selected from the group consisting of SEQ ID NOs: 182814-188371.

In some aspects, the invention provides a stem cell (e.g., hypoimmunogenic stem cell) or population thereof, each cell comprising a modified genome comprising: a genomic modification in which the TAP1 gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 182814-188371.

In some aspects, the invention provides a method for altering a target TAP1 polynucleotide sequence in a cell comprising contacting the TAP1 polynucleotide sequence with a clustered regularly interspaced short palindromic repeats-associated (Cas) protein and at least one ribonucleic acid, wherein the ribonucleic acid directs Cas protein to and hybridizes to a target motif of the target TAP1 polynucleotide sequence, wherein the target TAP1 polynucleotide sequence is cleaved, and wherein the at least one ribonucleic acid is selected from the group consisting of SEQ ID NOs: 182814-188371.

Figure 21A:
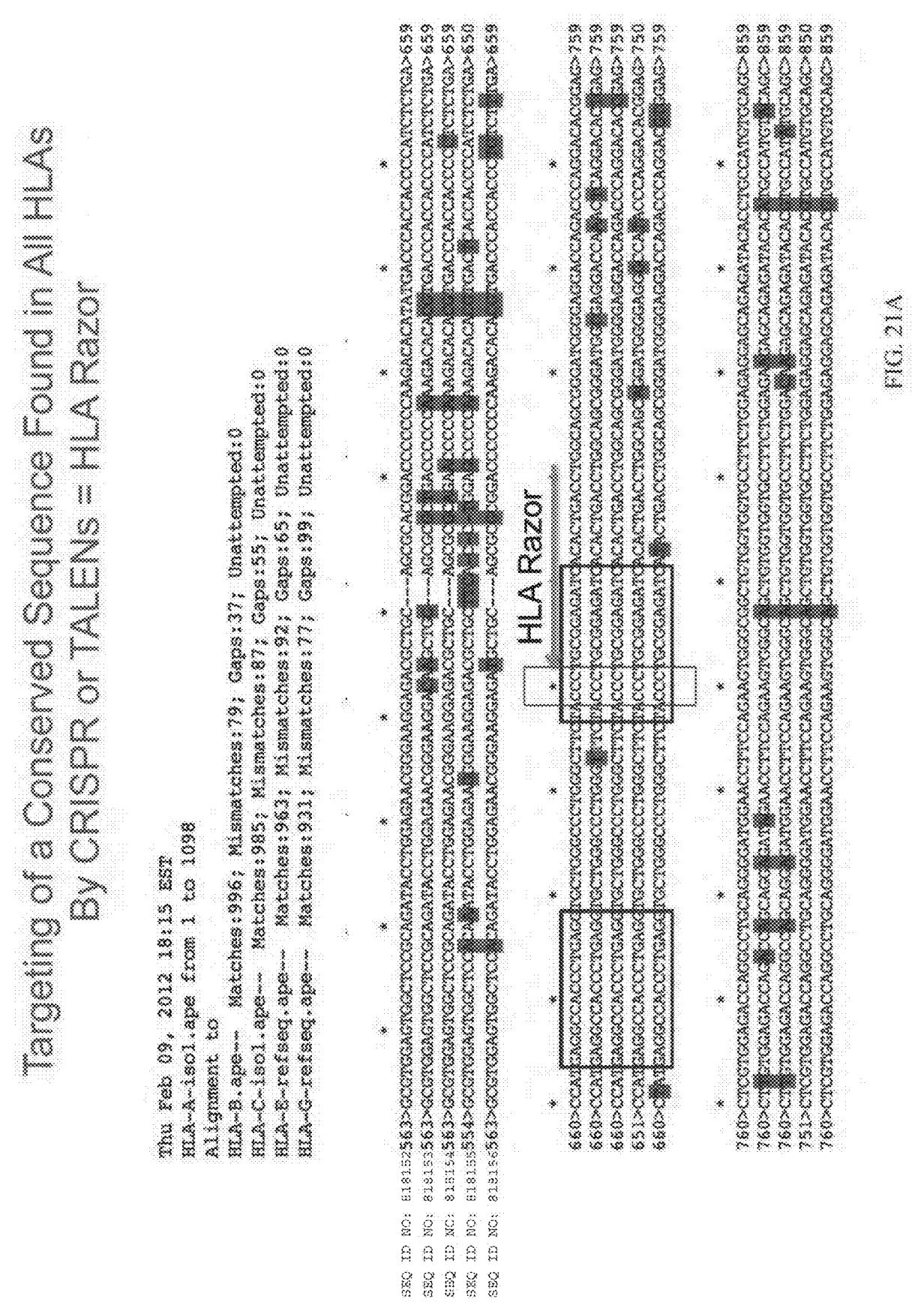
Figure 21B:
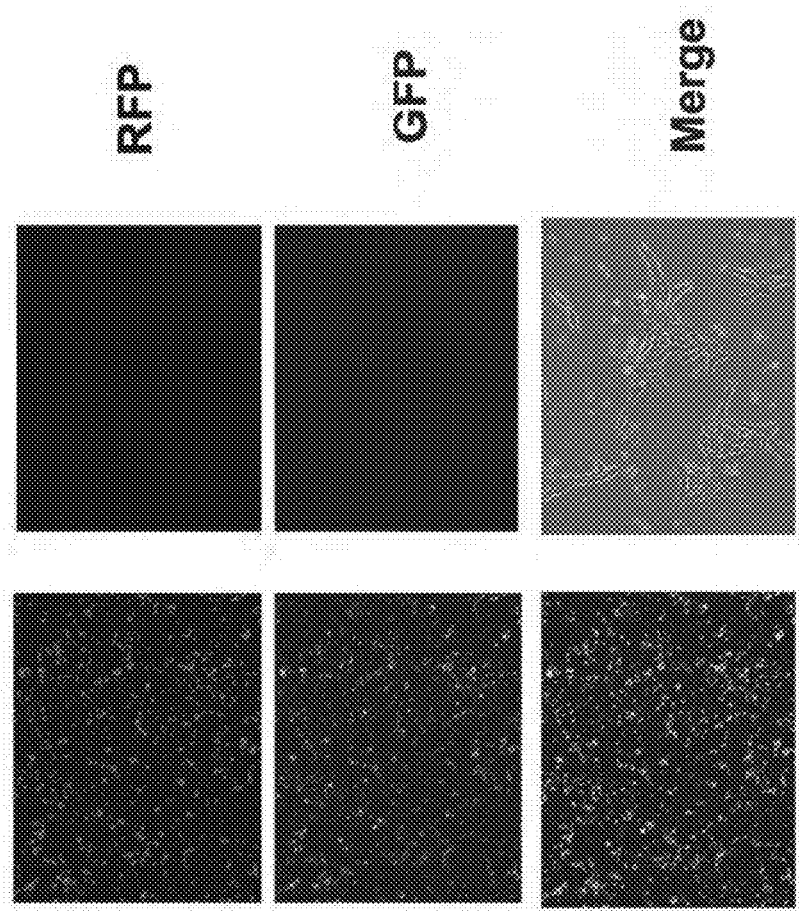

In certain embodiments, gRNAs that allow simultaneous deletion of all MHC class I alleles by targeting a conserved region in the HLA genes are identified as HLA Razors. In some aspects, the gRNAs are part of a CRISPR system. In alternative aspects, the gRNAs are part of a TALEN system. In one aspect, an HLA Razor targeting an identified conserved region in HLAs is depicted in FIG. 21A. In other aspects, multiple HLA Razors targeting identified conserved regions are utilized. It is generally understood that any guide that targets a conserved region in HLAs can act as an HLA Razor.

Knock-In

In certain embodiments, tolerogenic factors can be inserted or reinserted into genome-edited stem cell lines to create immune-privileged universal donor stem cell lines. In certain embodiments, the universal stem cells disclosed herein have been further modified to express one or more tolerogenic factors. Exemplary tolerogenic factors include, without limitation, one or more of HLA-C, HLA-E, HLA-F, HLA-G, PD-L1, CTLA-4-Ig, CD47, C1-inhibitor, and IL-35.

Figures 11A, 11B, 11C:
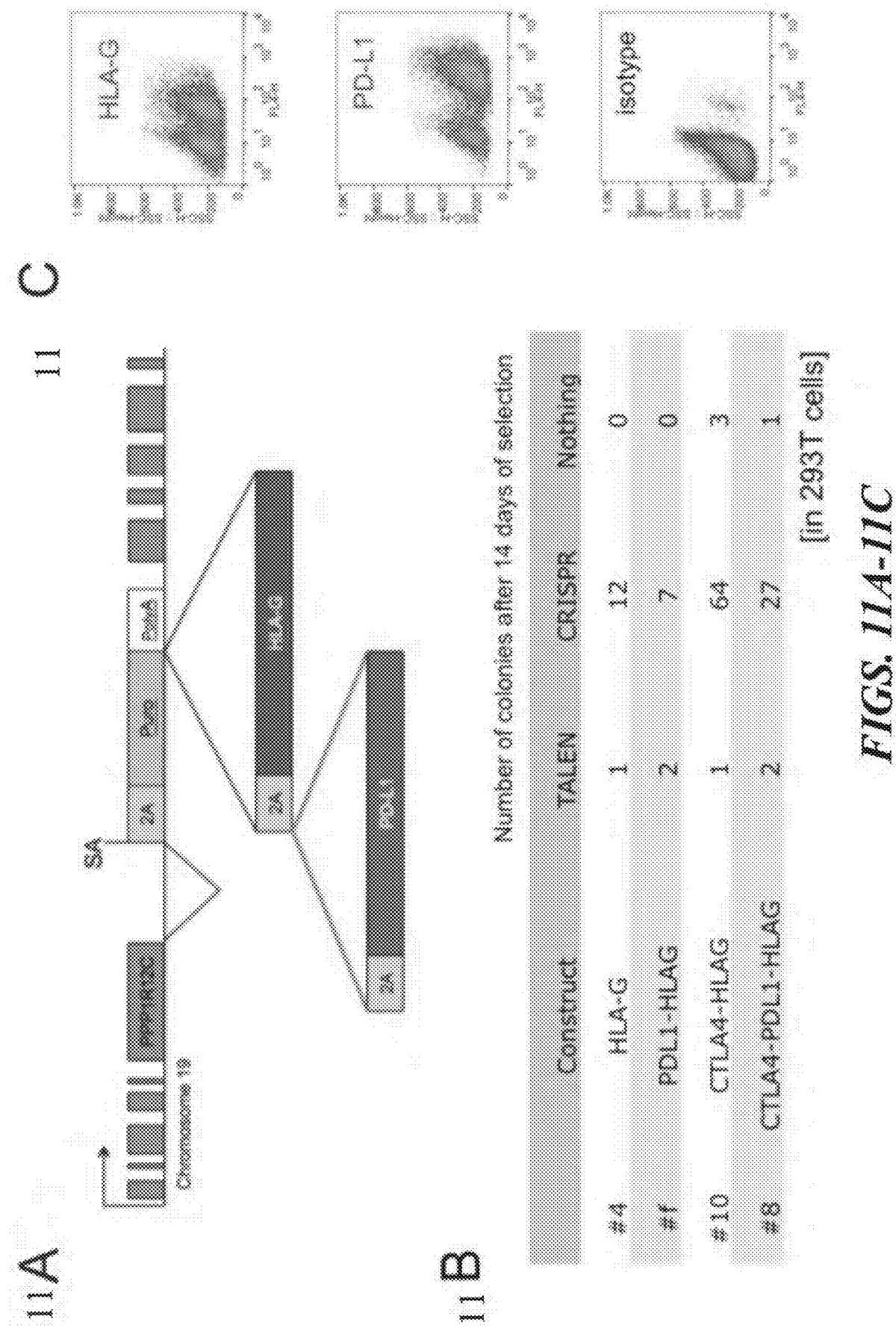
FIGS. 11A-11C demonstrate that tolerogenic factors, such as PD-L1 and HLA-G, can be expressed from a safe harbor locus.

The present inventors have used genome editing systems, such as the CRISPR/Cas system, to facilitate the insertion of tolerogenic factors, such as the tolerogenic factors shown in Table 2 below, into a safe harbor locus, such as the AAVS1 locus, to actively inhibit immune rejection. As evidenced in FIGS. 11A-11C, the present inventors have successfully expressed tolerogenic factors, such as PD-L1 and HLA-G, from a safe harbor locus.

TABLE 2

Tolerogenic factors that can be (re)introduced into genome edited stem cell lines to create immune-privileged universal donor stem cell lines.

| Gene | Receptor | Target Cell |
| --- | --- | --- |
| HLA-G* | KIR2DL4 | NK cells |
| HLA-C* | KIR2DS1/L1 | NK cells |
| HLA-E* | NKG2A/C | NK cells |
| PD-L1 | PD-1 | T cells |
| CTLA4-Ig | CD28 | APC/T cells |
| CD47 | SIRPα | Macrophages |
| C1-inhibitor | Complement | |
| IL-35 | IL35R | T reg |

*in the form of a peptide-B2M-HLA fusion construct, when (re)introduced into a B2M$^{-/-}$ cell line In some aspects, the present disclosure provides a stem cell (e.g., hypoimmunogenic stem cell) or population thereof comprising a genome in which the stem cell genome has been modified to express HLA-G. In some aspects, the present disclosure provides a method for altering a stem cell genome to express HLA-G. In certain aspects at least one ribonucleic acid or at least one pair of ribonucleic acids may be utilized to facilitate the insertion of HLA-G into a stem cell line. In certain embodiments, the at least one ribonucleic acid or the at least one pair of ribonucleic acids is selected from the group consisting of SEQ ID NOs: 188372-189858.

In some aspects, the present disclosure provides a stem cell (e.g., hypoimmunogenic stem cell) or population thereof comprising a genome in which the stem cell genome has been modified to express HLA-C. In some aspects, the present disclosure provides a method for altering a stem cell genome to express HLA-C. In certain aspects at least one ribonucleic acid or at least one pair of ribonucleic acids may be utilized to facilitate the insertion of HLA-C into a stem cell line. In certain embodiments, the at least one ribonucleic acid or the at least one pair of ribonucleic acids is selected from the group consisting of SEQ ID NOs: 3278-5183.

In some aspects, the present disclosure provides a stem cell (e.g., hypoimmunogenic stem cell) or population thereof comprising a genome in which the stem cell genome has been modified to express HLA-E. In some aspects, the present disclosure provides a method for altering a stem cell genome to express HLA-E. In certain aspects at least one ribonucleic acid or at least one pair of ribonucleic acids may be utilized to facilitate the insertion of HLA-E into a stem cell line. In certain embodiments, the at least one ribonucleic acid or the at least one pair of ribonucleic acids is selected from the group consisting of SEQ ID NOs: 189859-193183.

In some aspects, the present disclosure provides a stem cell (e.g., hypoimmunogenic stem cell) or population thereof comprising a genome in which the stem cell genome has been modified to express PD-L1. In some aspects, the present disclosure provides a method for altering a stem cell genome to express PD-L1. In certain aspects at least one ribonucleic acid or at least one pair of ribonucleic acids may be utilized to facilitate the insertion of PD-L1 into a stem cell line. In certain embodiments, the at least one ribonucleic acid or the at least one pair of ribonucleic acids is selected from the group consisting of SEQ ID NOs: 193184-200783.

In some aspects, the present disclosure provides a stem cell (e.g., hypoimmunogenic stem cell) or population thereof comprising a genome in which the stem cell genome has been modified to express CD-47. In some aspects, the present disclosure provides a method for altering a stem cell genome to express CD-47. In certain aspects at least one ribonucleic acid or at least one pair of ribonucleic acids may be utilized to facilitate the insertion of CD-47 into a stem cell line. In certain embodiments, the at least one ribonucleic acid or the at least one pair of ribonucleic acids is selected from the group consisting of SEQ ID NOs: 200784-231885.

In some aspects, the present disclosure provides a stem cell (e.g., hypoimmunogenic stem cell) or population thereof comprising a genome in which the stem cell genome has been modified to express HLA-F. In some aspects, the present disclosure provides a method for altering a stem cell genome to express HLA-F. In certain aspects at least one ribonucleic acid or at least one pair of ribonucleic acids may be utilized to facilitate the insertion of HLA-F into a stem cell line. In certain embodiments, the at least one ribonucleic acid or the at least one pair of ribonucleic acids is selected from the group consisting of SEQ ID NOs: 688808-399754.

Other Target Modifications

In some embodiments, additional targets can be modified and/or deleted in universal cells, such as universal T cells, to improve their function and/or tailor them to a specific therapeutic approach.

In some aspects, genes encoding for co-stimulatory molecules/receptors that engage cytotoxic T cells can be deleted by genome editing (Table 3). Deletion of co-stimulatory molecules/receptors may occur to prevent autoimmunity. In other aspects, genes encoding for co-inhibitory molecules/receptors can be deleted by genome editing (Table 4). Deletion of co-inhibitory molecules/receptors may occur to prevent T cell inhibition by cancer cells, and may be useful in T cell-based cancer immunotherapy.

TABLE 3

Co-stimulatory molecules that will be deleted to prevent autoimmunity (e.g., to block interaction of transplanted cells with T cells).

| Ligand on Cancer cells | Receptor on T cells |
| --- | --- |
| Ox40L | Ox40 |
| GITRL | GITR |
| 4-1BBL | 4-1BB |
| CD58 | CD2 |
| B7-1, -2 | CD28 |
| B2-2 | ICOS |
| CD70 | CD27 |
| LIGHT | HVEM |
| SLAM | SLAM |
| CD155, CD112 | CD226 |

TABLE 4

Co-inhibitory molecules/receptors that will be deleted to prevent T cell inhibition by cancer cells. Useful in T cell-based cancer immunotherapy

| Ligand on Cancer cells | Receptor on T cells |
|---|---|
| B7/H1PD-L1 | PD1 |
| B7-1/B7-2 | CTLA4 |
| MHC | LAG3 |
| CD155, CD112, CD113 | TIGIT |
| Galectin 9 | TIM3 |
| B7-1 | B7-H1/PD-L1 |
| PD-L2 | PD-1 |
| B7-H3 | TLT-2 |
| CD153 | CD30 |
| VISTA | ? |
| HVEM | CD160 |
| HVEM | BTLA |
| Collagen | LAIR1 |
| CD48 | 2B4/CD244 |

In some aspects, the present disclosure provides a stem cell or population thereof comprising a genome in which the OX40 gene has been edited to modify (e.g., delete) a contiguous stretch of genomic DNA. In certain aspects, the present disclosure provides a method for altering a target OX40 sequence in a cell. The contiguous stretch of genomic DNA can be modified (e.g., deleted) by contacting the cell or population thereof with a Cas protein or a nucleic acid encoding the Cas protein and at least one ribonucleic acid or at least one pair of ribonucleic acids selected from the group consisting of SEQ ID NOs: 231886-234210.

In some aspects, the present disclosure provides a stem cell or population thereof comprising a genome in which the GITR gene has been edited to modify a contiguous stretch of genomic DNA. In certain aspects, the present disclosure provides a method for altering a target GITR sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 234211-236445.

In some aspects, the present disclosure provides a stem cell or population thereof comprising a genome in which the 4-1BB gene has been edited to modify a contiguous stretch of genomic DNA. In certain aspects, the present disclosure provides a method for altering a target 4-1BB sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 234211-236445.

In some aspects, the present disclosure provides a stem cell or population thereof comprising a genome in which the CD28 gene has been edited to modify a contiguous stretch of genomic DNA. In certain aspects, the present disclosure provides a method for altering a target CD28 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 252807-274181.

In some aspects, the present disclosure provides a stem cell or population thereof comprising a genome in which the B7-1 gene has been edited to modify a contiguous stretch of genomic DNA. In certain aspects, the present disclosure provides a method for altering a target B7-1 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 274182-295529.

In some aspects, the present disclosure provides a stem cell or population thereof comprising a genome in which the B7-2 gene has been edited to modify a contiguous stretch of genomic DNA. In certain aspects, the present disclosure provides a method for altering a target B7-2 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 295530-324177.

In some aspects, the present disclosure provides a stem cell or population thereof comprising a genome in which the ICOS gene has been edited to modify a contiguous stretch of genomic DNA. In certain aspects, the present disclosure provides a method for altering a target ICOS sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 324178-339974.

In some aspects, the present disclosure provides a stem cell or population thereof comprising a genome in which the CD27 gene has been edited to modify a contiguous stretch of genomic DNA. In certain aspects, the present disclosure provides a method for altering a target CD27 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 339975-344266.

In some aspects, the present disclosure provides a stem cell or population thereof comprising a genome in which the HVEM gene has been edited to modify a contiguous stretch of genomic DNA. In certain aspects, the present disclosure provides a method for altering a target HVEM sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 344267-350722.

In some aspects, the present disclosure provides a stem cell or population thereof comprising a genome in which the SLAM gene has been edited to modify a contiguous stretch of genomic DNA. In certain aspects, the present disclosure provides a method for altering a target SLAM sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 350723-353590.

In some aspects, the present disclosure provides a stem cell or population thereof comprising a genome in which the CD226 gene has been edited to modify a contiguous stretch of genomic DNA. In certain aspects, the present disclosure provides a method for altering a target CD226 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 353591-416840.

In some aspects, the present disclosure provides a stem cell or population thereof comprising a genome in which the PD1 gene has been edited to modify a contiguous stretch of genomic DNA. In certain aspects, the present disclosure provides a method for altering a target PD1 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of sequences numbered 196-531 and 4047-9101 in U.S. application Ser. No. 15/083,021, which is incorporated herein by reference.

In some aspects, the present disclosure provides a stem cell or population thereof comprising a genome in which the CTLA4 gene has been edited to modify a contiguous stretch of genomic DNA. In certain aspects, the present disclosure provides a method for altering a target CTLA4 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of sequences numbered 1-195 and 797-4046 in U.S. application Ser. No. 15/083,021, which is incorporated herein by reference.

In some aspects, the present disclosure provides a stem cell or population thereof comprising a genome in which the LAG3 gene has been edited to modify a contiguous stretch of genomic DNA. In certain aspects, the present disclosure provides a method for altering a target LAG3 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 416841-421195.

In some aspects, the present disclosure provides a stem cell or population thereof comprising a genome in which the TIGIT gene has been edited to modify a contiguous stretch of genomic DNA. In certain aspects, the present disclosure provides a method for altering a target TIGIT sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 421196-432039.

In some aspects, the present disclosure provides a stem cell or population thereof comprising a genome in which the TIM3 gene has been edited to modify a contiguous stretch of genomic DNA. In certain aspects, the present disclosure provides a method for altering a target TIM3 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 432040-447610.

In some aspects, the present disclosure provides a stem cell or population thereof comprising a genome in which the CD160 gene has been edited to modify a contiguous stretch of genomic DNA. In certain aspects, the present disclosure provides a method for altering a target CD160 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 447611-459294.

In some aspects, the present disclosure provides a stem cell or population thereof comprising a genome in which the BTLA gene has been edited to modify a contiguous stretch of genomic DNA. In certain aspects, the present disclosure provides a method for altering a target BTLA sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 459295-482454.

In some aspects, the present disclosure provides a stem cell or population thereof comprising a genome in which the CD244 gene has been edited to modify a contiguous stretch of genomic DNA. In certain aspects, the present disclosure provides a method for altering a target CD244 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 482455-504169.

In some aspects, the present disclosure provides a stem cell or population thereof comprising a genome in which the CD244 gene has been edited to modify a contiguous stretch of genomic DNA. In certain aspects, the present disclosure provides a method for altering a target CD244 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 482455-504169.

In some aspects, the present disclosure provides a stem cell or population thereof comprising a genome in which the CD30 gene has been edited to modify a contiguous stretch of genomic DNA. In certain aspects, the present disclosure provides a method for altering a target CD30 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 699755-731993.

In some aspects, the present disclosure provides a stem cell or population thereof comprising a genome in which the TLT gene has been edited to modify a contiguous stretch of genomic DNA. In certain aspects, the present disclosure provides a method for altering a target TLT sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 731994-739957.

In some aspects, the present disclosure provides a stem cell or population thereof comprising a genome in which the VISTA gene has been edited to modify a contiguous stretch of genomic DNA. In certain aspects, the present disclosure provides a method for altering a target VISTA sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 739958-757515.

In some aspects, the present disclosure provides a stem cell or population thereof comprising a genome in which the B7-H3 gene has been edited to modify a contiguous stretch of genomic DNA. In certain aspects, the present disclosure provides a method for altering a target B7-H3 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 757516-777888.

In some aspects, the present disclosure provides a stem cell or population thereof comprising a genome in which the PD-L2 gene has been edited to modify a contiguous stretch of genomic DNA. In certain aspects, the present disclosure provides a method for altering a target PD-L2 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 777889-817976.

In some embodiments, lymphocyte adhesion is blocked to prevent autoimmunity. In certain aspects, target genes can be edited by genome editing to block lymphocyte adhesion (Table 5).

TABLE 5

Blocking lymphocyte adhesion to prevent autoimmunity.

| Ligand on Cancer cells | Receptor on T cells |
|---|---|
| ICAM-1, ICAM-2 | LFA-1 |
| CD58/LFA-3 | CD2 |
| CD-SIGN | ICAM-3 |

In some aspects, the present disclosure provides a stem cell or population thereof comprising a genome in which the LFA-1 gene has been edited to modify a contiguous stretch of genomic DNA. In certain aspects, the present disclosure provides a method for altering a target LFA-1 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 504170-526670.

In some aspects, the present disclosure provides a stem cell or population thereof comprising a genome in which the CD2 gene has been edited to modify a contiguous stretch of genomic DNA. In certain aspects, the present disclosure provides a method for altering a target CD2 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 526671-536704.

In some aspects, the present disclosure provides a stem cell or population thereof comprising a genome in which the CD58 gene has been edited to modify a contiguous stretch of genomic DNA. In certain aspects, the present disclosure provides a method for altering a target CD58 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 536705-570967.

In some embodiments, genes encoding for T cell receptors can be deleted by genome editing. Deletion of T cell receptor genes may occur to prevent autoimmune attack in T cell therapy. In some aspects, the gene encoding the T cell receptor is a T cell receptor alpha locus (TCRA), or a homolog, ortholog, or variant thereof (Gene ID: 5133, also known as IMD7, TCRD, TRA@, TRAC, and referred to herein as TCRa, TCRA, TCRalpha, and the like). In some aspects, the gene encoding the T cell receptor is a T cell receptor alpha locus (TCRB), or a homolog, ortholog, or variant thereof (Gene ID: 6957, also known as TCRB; TRB @, and referred to herein as TCRb, TCRB, TCRbeta, and the like). In some aspects, the T cell receptor gene is modified by genome editing as described in U.S. application Ser. No. 15/083,021 and PCT Application No. PCT/US2016/024554, both of which are incorporated herein by reference.

In some aspects, the present disclosure provides a stem cell or population thereof comprising a genome in which the TRAC gene has been edited to modify a contiguous stretch of genomic DNA. In certain aspects, the present disclosure provides a method for altering a target TRAC sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of sequences numbered 532-609 and 9102-9797, as described in U.S. application Ser. No. 15/083,021, incorporated herein by reference.

In some aspects, the present disclosure provides a stem cell or population thereof comprising a genome in which the TRBC gene has been edited to modify a contiguous stretch of genomic DNA. In certain aspects, the present disclosure provides a method for altering a target TRBC sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of sequences numbered 610-765 and 9798-10573, as described in U.S. application Ser. No. 15/083,021 and incorporated herein by reference.

In some embodiments, genes involved in regulatory T cell (T reg) function can be deleted by genome editing (Table 6). Deletion of genes involved in regulatory T cell (T reg) function may occur to break tolerance in T cell therapy.

TABLE 6

Deletion of genes involved in regulatory T cell (T reg) function to break tolerance in T cell therapy.

| Gene | Function |
|---|---|
| FOXP3 | T reg development |
| HELIOS | T reg maintenance |
| ST2 | IL-33 receptor |

In some aspects, the present disclosure provides a stem cell or population thereof comprising a genome in which the FOXP3 gene has been edited to modify (e.g., delete) a contiguous stretch of genomic DNA. In certain aspects, the present disclosure provides a method for altering a target FOXP3 sequence in a cell. The contiguous stretch of genomic DNA can be modified (e.g., deleted) by contacting the cell or population thereof with a Cas protein or a nucleic acid encoding the Cas protein and at least one ribonucleic acid or at least one pair of ribonucleic acids selected from the group consisting of SEQ ID NOs: 570968-584068.

In some aspects, the present disclosure provides a stem cell or population thereof comprising a genome in which the HELIOS gene has been edited to modify a contiguous stretch of genomic DNA. In certain aspects, the present disclosure provides a method for altering a target HELIOS sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 683033-688807.

The capacity of the CRISPR/Cas system for multiplexing also allows the generation of disease-specific universal donor cell lines that harbor one or more genomic alterations that will improve their applicability to treat a certain disease or condition. A list of potential diseases that can be addressed can be found in Table 7.

TABLE 7

Additional targets that can be modified using the CRISPR/Cas system in order to generate universal donor cell lines tailored to a specific disease or application.

| Gene | Disease |
|---|---|
| TCR | T cell therapy |
| PD-1 | T cell therapy |
| CTLA4 | T cell therapy |
| LAG-3 | T cell therapy |
| TIGIT | T cell therapy |
| TIM3 | T cell therapy |
| CCR5 | HIV resistance |
| PCSK9 | Cardiovascular disease |
| APOC3 | Cardiovascular disease |

It is to be understood that the inventions disclosed herein are not limited in their application to the details set forth in the description or as exemplified. The invention encompasses other embodiments and is capable of being practiced or carried out in various ways. Also, it is to be understood that the phraseology and terminology employed herein is for the purpose of description and should not be regarded as limiting.

While certain compositions, methods and assays of the present invention have been described with specificity in accordance with certain embodiments, the following examples serve only to illustrate the methods and compositions of the invention and are not intended to limit the same.

The articles "a" and "an" as used herein in the specification and in the claims, unless clearly indicated to the contrary, should be understood to include the plural referents. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or the entire group members are present in, employed in, or otherwise relevant to a given product or process. Furthermore, it is to be understood that the invention encompasses all variations, combinations, and permutations in which one or more limitations, elements, clauses, descriptive terms, etc., from one or more of the listed claims is introduced into another claim dependent on the same base claim (or, as relevant, any other claim) unless otherwise indicated or unless it would be evident to one of ordinary skill in the art that a contradiction or inconsistency would arise. Where elements are presented as lists, (e.g., in Markush group or similar format) it is to be understood that each subgroup of the elements is also disclosed, and any element(s) can be removed from the group. It should be understood that, in general, where the invention, or aspects of the invention, is/are referred to as comprising particular elements, features, etc., certain embodiments of the invention or aspects of the invention consist, or consist essentially of, such elements, features, etc. For purposes of simplicity those embodiments have not in every case been specifically set forth in so many words herein. It should also be understood that any embodiment or aspect of the invention can be explicitly excluded from the claims, regardless of whether the specific exclusion is recited in the specification. The publications and other reference materials referenced herein to describe the background of the invention and to provide additional detail regarding its practice are hereby incorporated by reference.

EXAMPLES

Cell Lines

The inventors have targeted various genes in a variety of cell lines. The various cell lines utilized include HuES8, HuES9, BJ-RiPSCs, Thp1, Jurkat, Primary T cells and HEK293T cells (FIG. 27). HuES8 and HuES9 are human ES cell lines. BJ-RiPSC is an iPSC line.

Knock-Out of HLA-A, HLA-B, and HLA-C

Knock-out targeting of HLAs was examined. Initially, an HLA-B and HLA-C knock-out strategy was examined. Two short guide RNAs (sgRNAs) were designed upstream of the HLA-B locus and downstream of HLA-C, which allowed for excision of the HLA-B and HLA-C genes (FIG. 14A). sgRNA #1 and sgRNA #2 target the HLA-B upstream region, and sgRNA #3 and sgRNA #4 target the HLA-C downstream region.

Figure 14C:
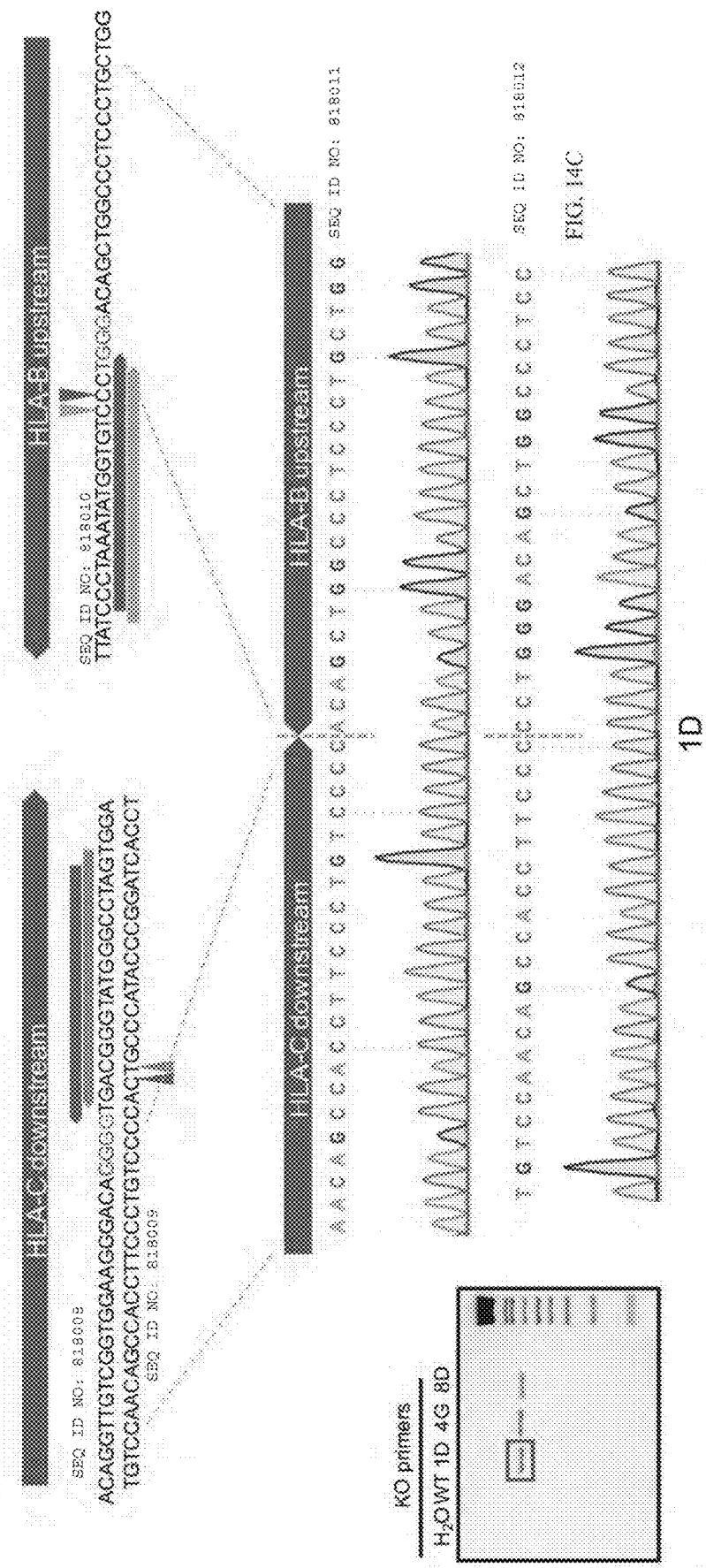

PCR screening was performed and confirmed that clone 1D was a homozygous knock-out clone. A schematic showing the PCR verification strategy for successful deletion of HLA-B and HLA-C is shown in FIG. 13B. Two pairs of wild-type (WT) primers were designed flanking each cutting site, with predicted amplicons sizes of 545 bp and 472 bp. Clone 1D was identified as a homozygous knock-out clone by the presence of ~680 pb PCR band generated with KO primers and the absence of bands using the two different sets of WT primers (FIG. 14B). In addition, genomic DNA was isolated from the indicated targeted HuES8 clones. Sequencing results of the clone 1D PCR product demonstrated successful deletion of HLA-B and HLA-C genes in HuES9 (FIG. 14C).

Figure 14D:
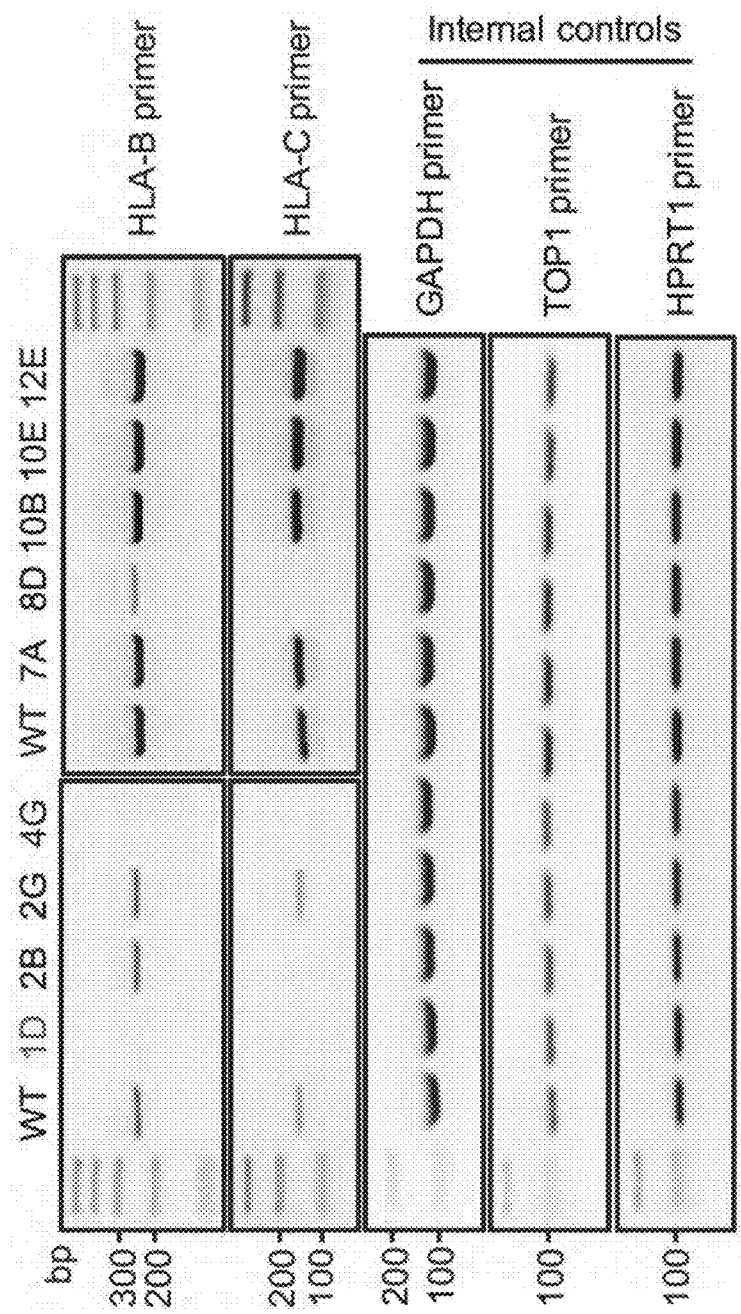
Figure 14F:
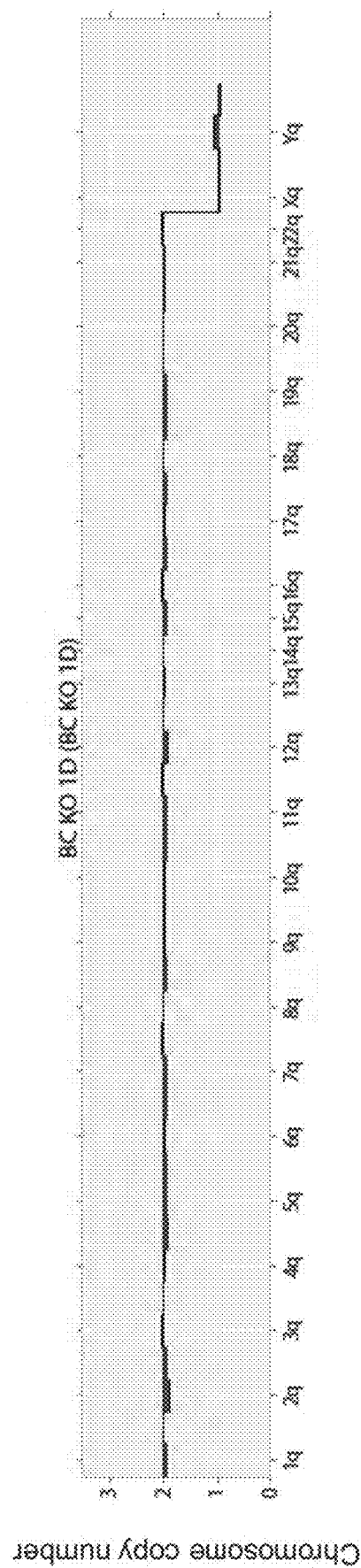

Further, RT-PCR with HLA-B and HLA-C specific primers demonstrated the mRNA expression of HLA-B and HLA-C in clone 1D was eliminated (FIG. 14D). GAPDH, TOP1 and HPRT1 were used as internal controls. WT and clone 1D RT-PCR products amplified with HLA-B primers were sequenced and identified as HLA-B and HLA-A mRNAs, respectively using BLAST (FIG. 14E). These results demonstrated that in the absence of the HLA-B gene, the HLA-B specific primers will amplify HLA-A mRNA in HuES8 clone 1D. HuES8 clone 1D displays a normal karyotype as assessed by NanoString nCounter set (FIG. 14F).

Figure 14G:
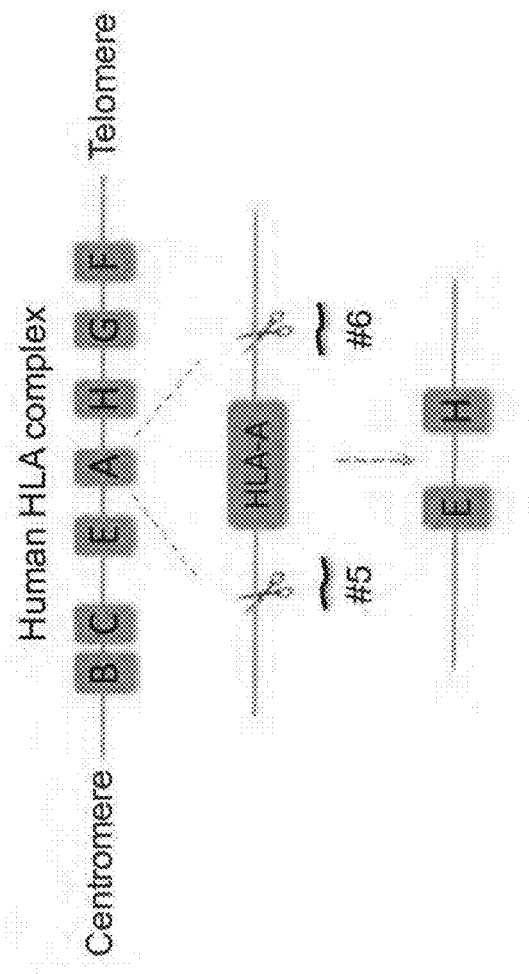
Figure 14H:
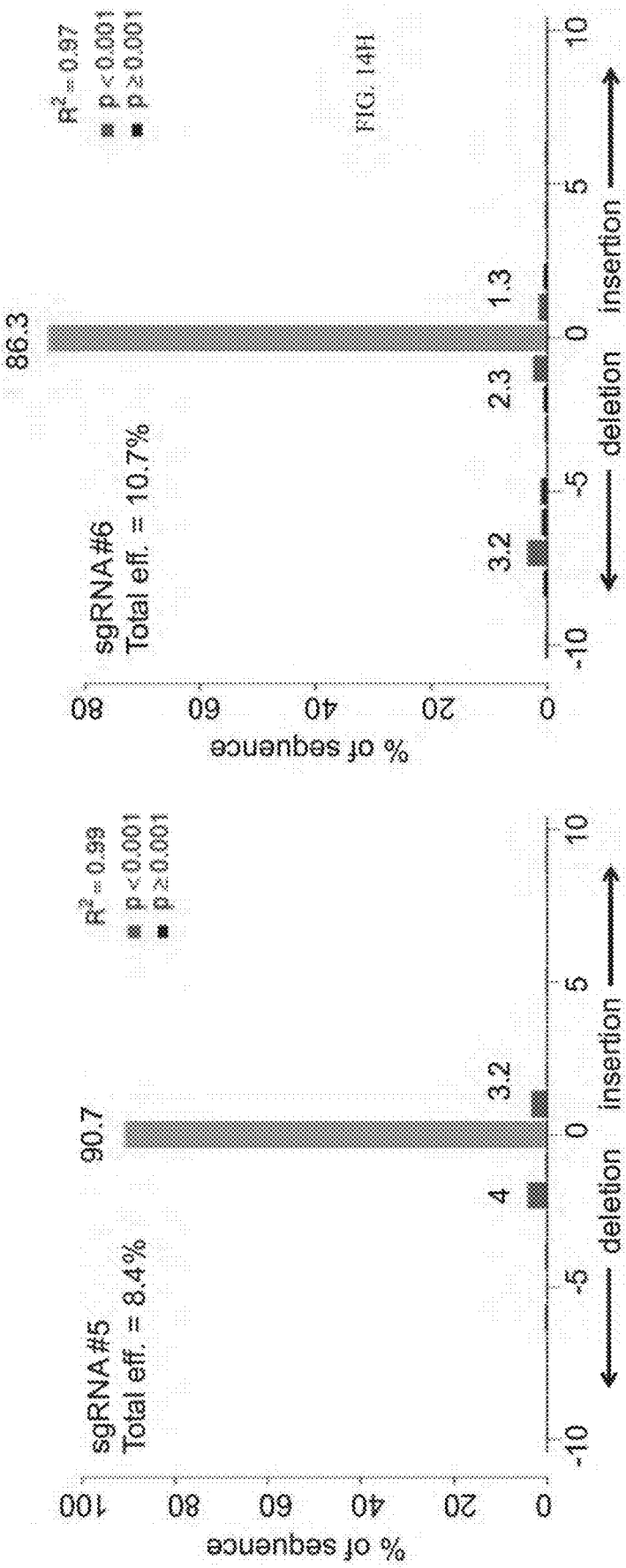

A schematic demonstrating an HLA-A knockout strategy using the dual sgRNA approach is provided in FIG. 14G. The schematic shows the position of the two sgRNAs (#5 and #6) that were designed to bind upstream and downstream of HLA-A. The on-target cutting efficiency of sgRNA #5 and #6 was determined in 293T cells using TIDE (FIG. 14H).

Figure 14I:
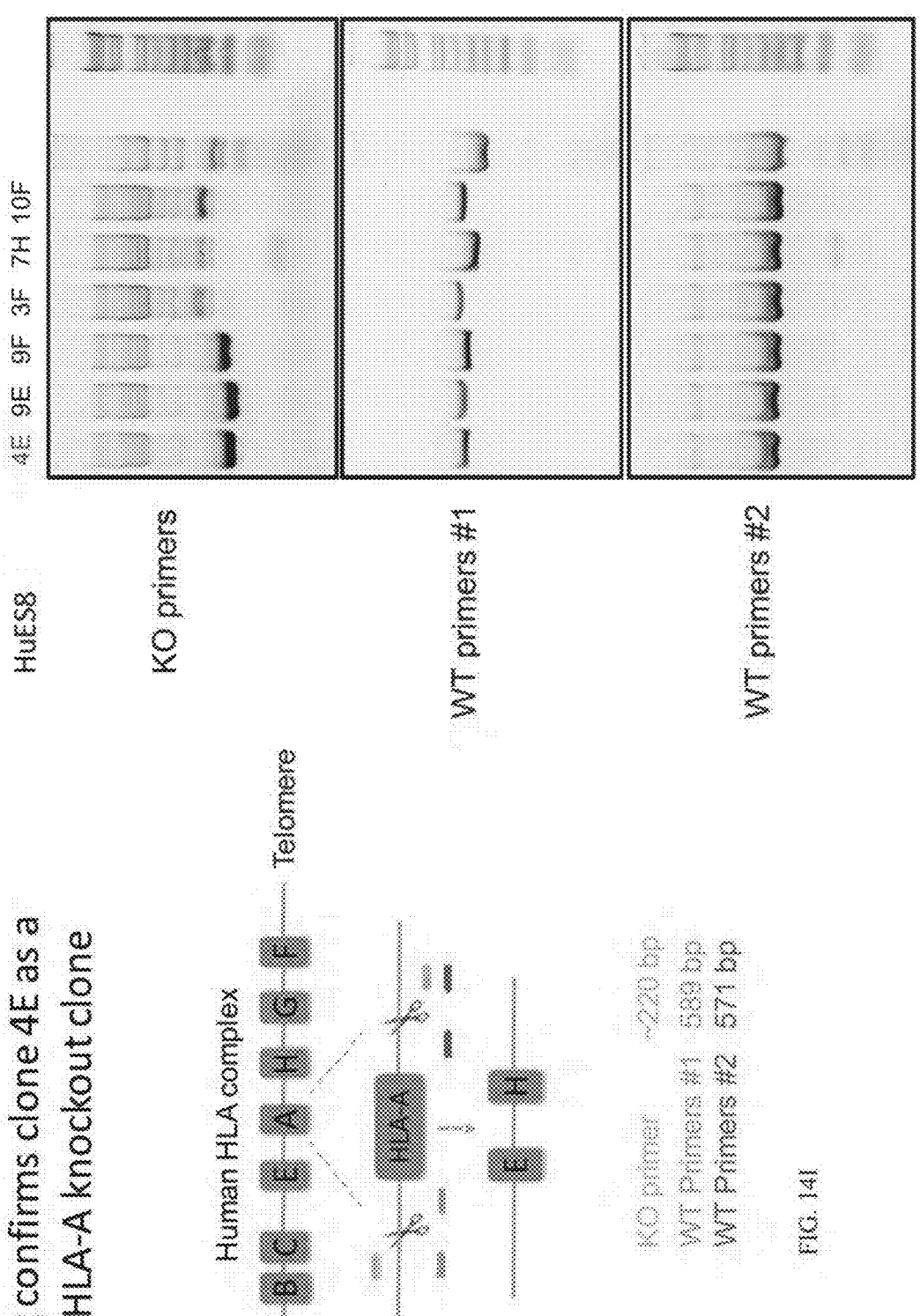
Figure 14J:
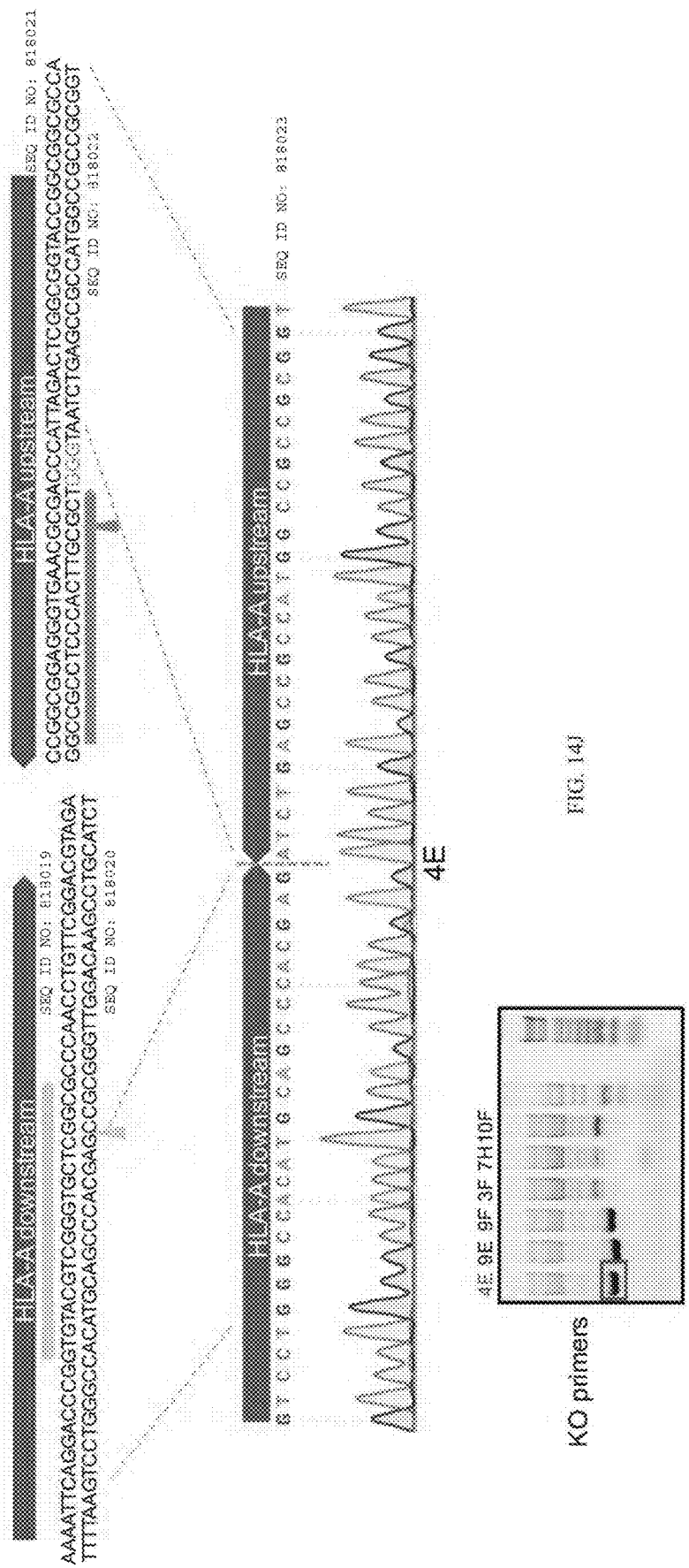

PCR screening confirmed that clone 4E was a heterozygous HLA-A knockout clone (FIG. 14I). The PCR screening strategy confirmed deletion of HLA-A in HuES8. KO primers were designed with one primer annealing upstream and one primer annealing downstream of the cutting sites. Upon HLA-A deletion, the resulting amplicon was observed as 220 bp on a 2% agarose gel. Two pairs of WT primers were designed flanking each cutting site, with predicted amplicon sizes of 589 bp and 571 bp. Clone 4E was identified as a heterozygous clone due to the presence of bands generated with KO primers and WT primers amplified from genomic DNA (FIG. 14I). Sequencing of the PCR product amplified from the genomic DNA of clone 4E using KO primers demonstrated successful deletion of HLA-A in HuES8 (FIG. 14J).

Knock-Out of Transcriptional Regulators

Figures 3A, 3B:
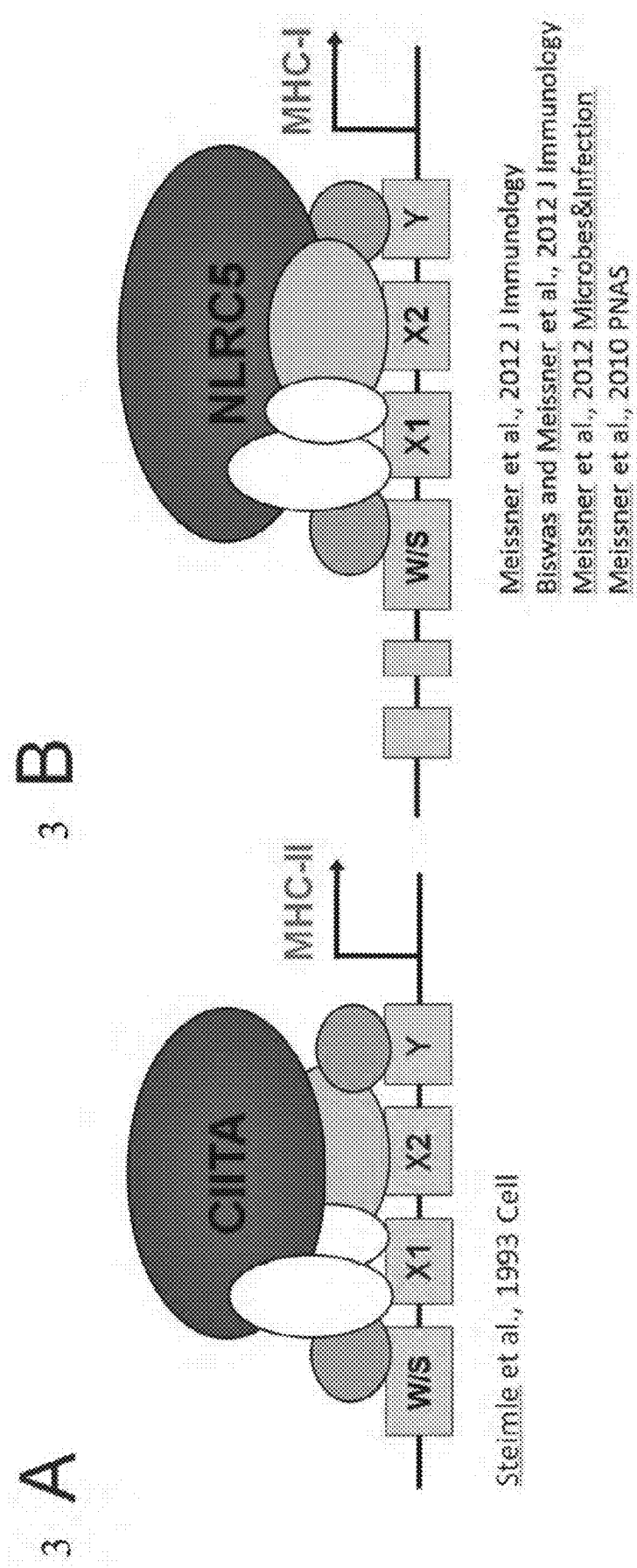
FIGS. 3A-3B illustrate targeting of transcriptional regulators of antigen presentation.
Figure 4:
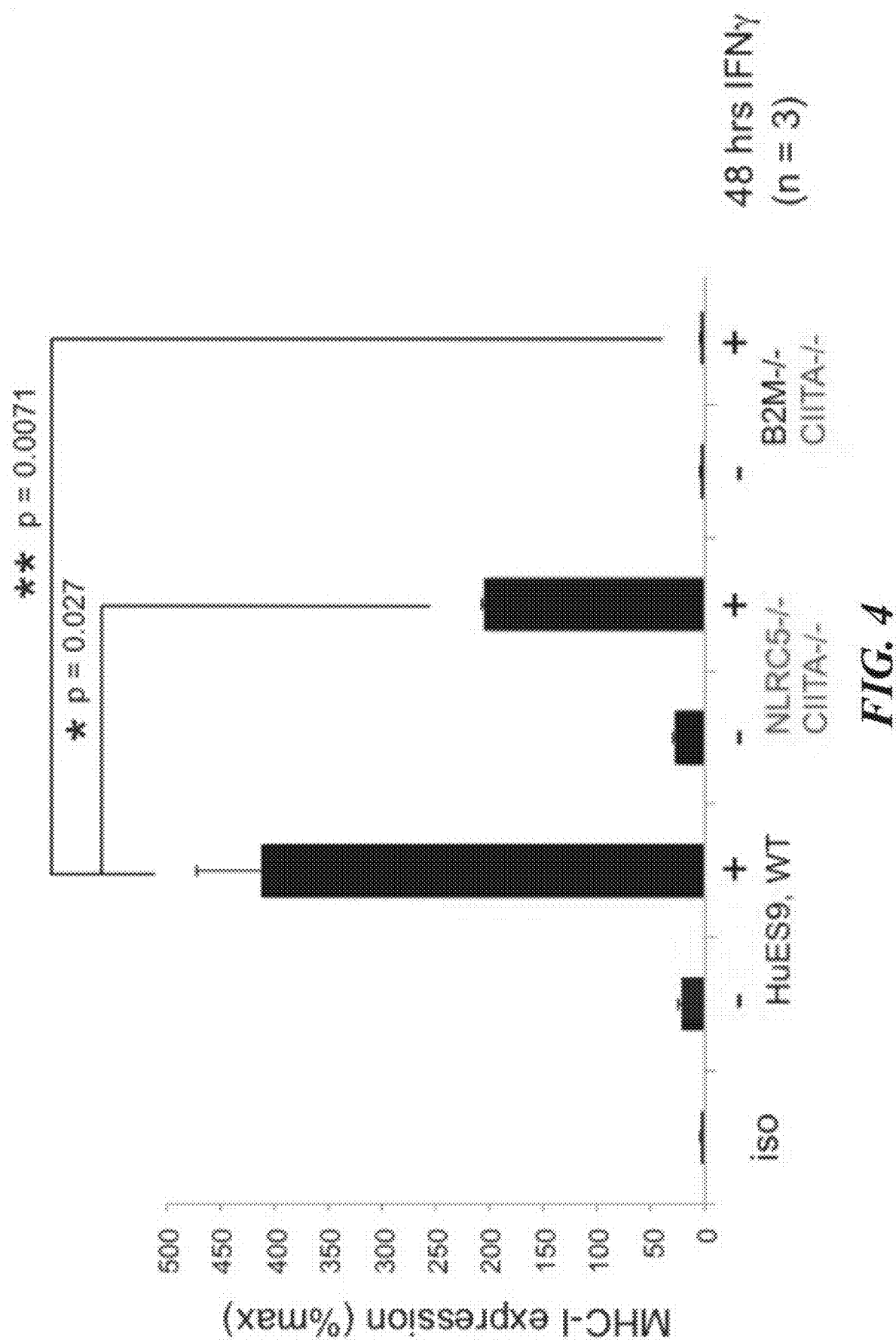
FIG. 4 illustrates MHC-I expression in WT HuES9 and the indicated modified mutant cell lines. Cells were stimulated for 48 hrs. with IFNγ and MHC-I expression was assessed by FACS.

As illustrated in FIGS. 3A-3B, in certain aspects, the inventions disclosed herein target the transcriptional regulators of antigen presentation (e.g., CIITA and/or NLRC5). The inventors have discovered that targeting and/or modulating the expression of such transcriptional regulators of antigen presentation provides a means to efficiently modulate (e.g., reduce or eliminate) the expression of the three classical MHC-Ia molecules, HLA-A, HLA-B, and HLA-C, and thereby produce hypoimmunogenic universal stem cell lines that are useful for cell replacement therapy. As evidenced in FIG. 4, the present inventors have demonstrated that such genome-edited cells are characterized by reduced MHC-I expression relative to the WT HuES9 cells, as assessed by FACS. Reduced or eliminated MHC-I surface expression was observed in those stem cells in which the expression of NLRC5, CIITA and B2M was modulated using the CRISPR/Cas system. In particular, FIG. 4 evidences low basal MHC-I expression in stem cells which can be increased by IFN-γ, that an approximately 50% reduction of MHC-I surface expression was observed in the IFN-γ-treated NLRC5$^{-/-}$ stem cells and that a complete loss of MHC-I surface expression was observed in the B2M$^{-/-}$ stem cells.

Figures 5A, 5B, 5C:
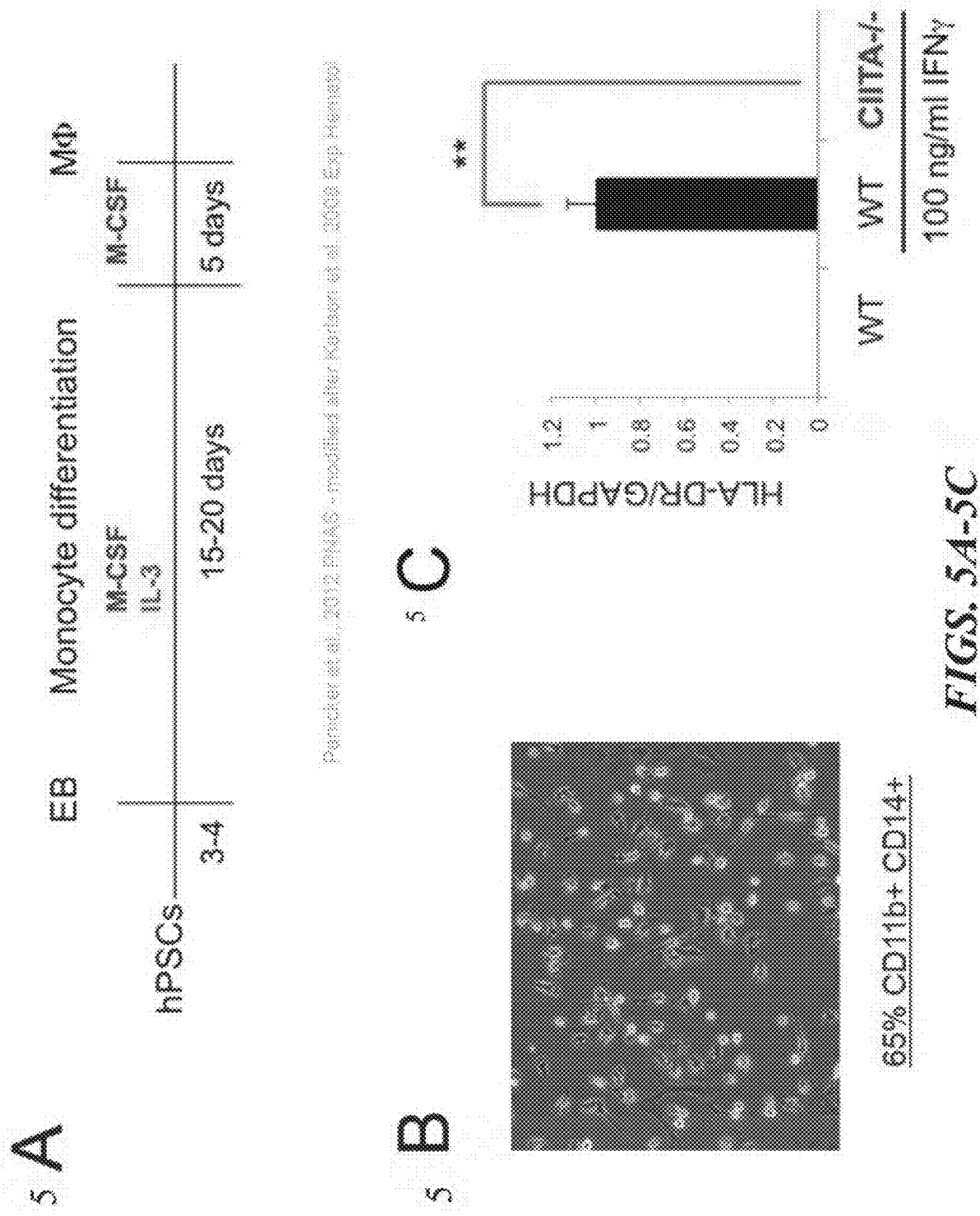
FIGS. 5A-5C illustrate that CIITA-deficient stem cell-derived macrophage lack MHC-II expression.
Figures 10A, 10B:
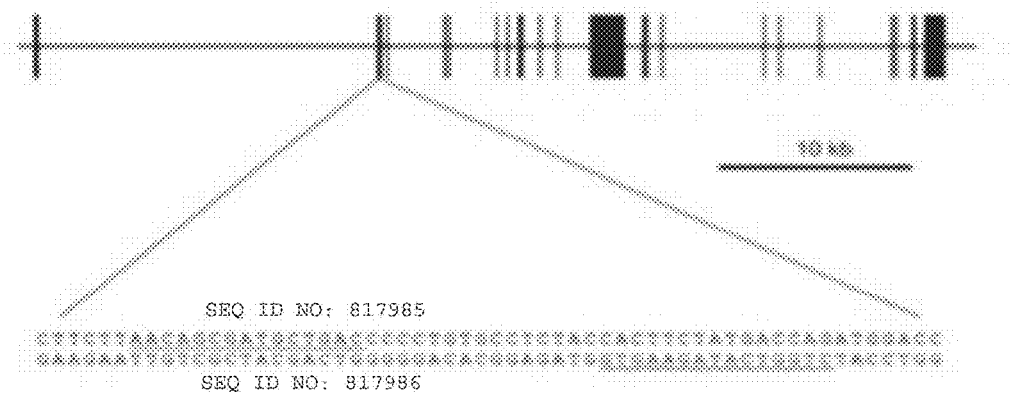
FIGS. 10A-10B illustrate targeting of the first coding exon of the CIITA gene.

Similar results were observed on MHC-II expression following modulation of the expression of CIITA. The present inventors differentiated the genome-edited CIITA$^{-/-}$ stem cell line into macrophage, which are antigen presenting cells. As depicted in FIG. 5C, the CIITA-deficient stem cell-derived macrophage lacked MHC-II expression, thus clearly showcasing the expected phenotype. In particular, by targeting the first coding exon of the CIITA gene (FIGS. 10A-10B), the foregoing results evidence that MHC-II expression can be efficiently abrogated.

Figure 6:
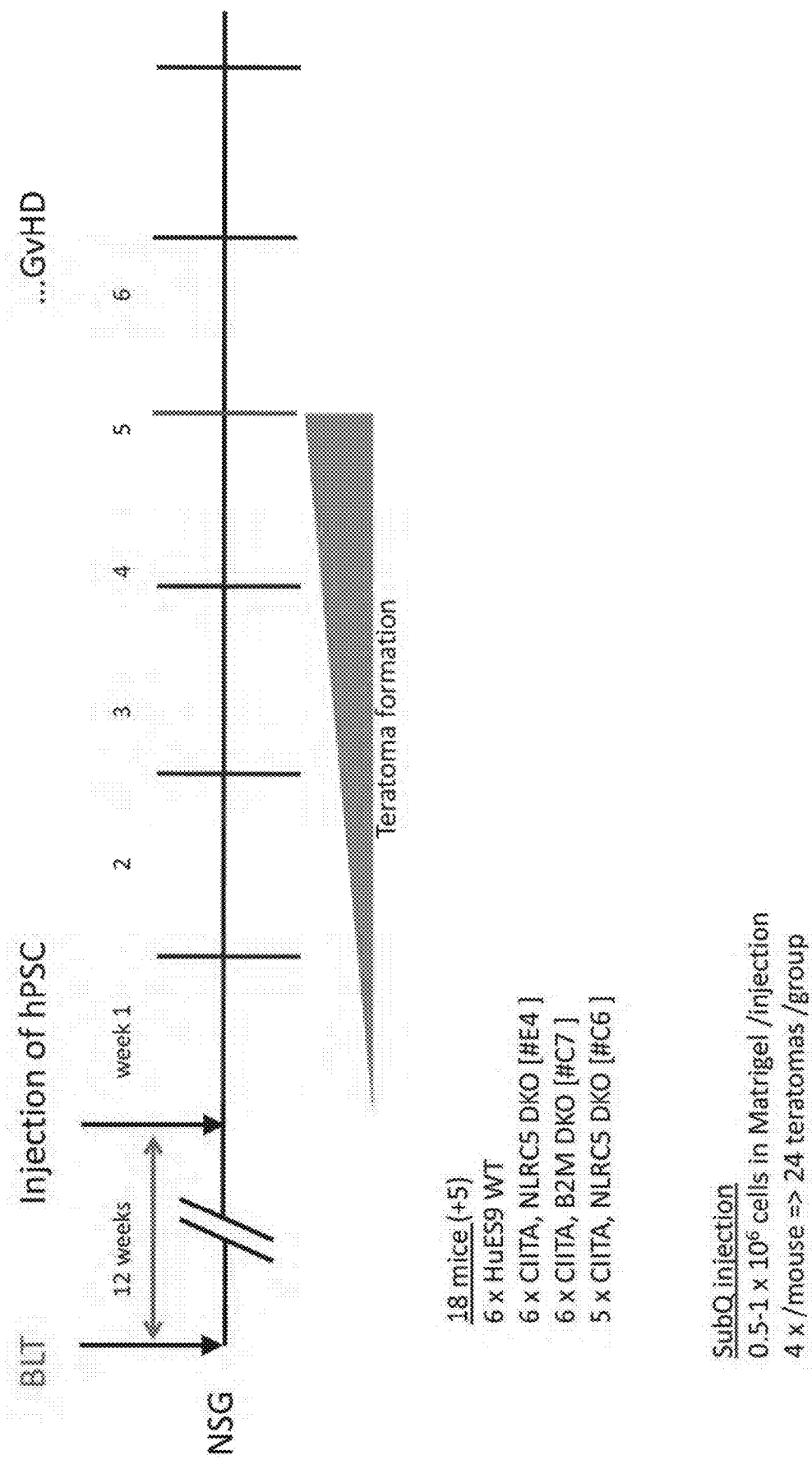
FIG. 6 illustrates a time line of the teratoma rejection study disclosed herein in which humanized NSG mice—BLT mice are given 3 months to fully reconstitute a human immune system before injection of the indicated genome-edited stem cell lines.
Figure 7:
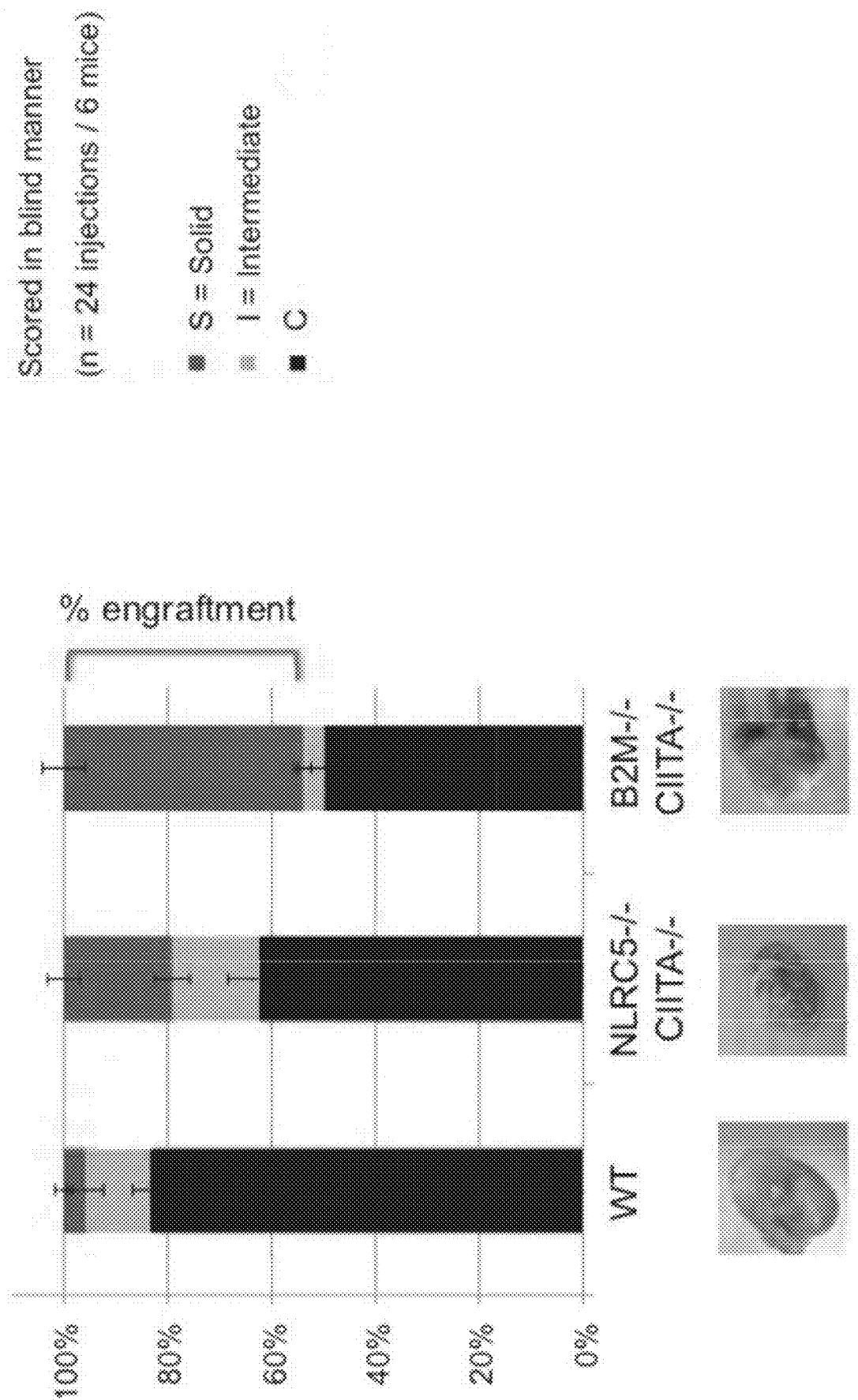
FIG. 7 demonstrates improved engraftment of genome-edited stem cells in humanized mice. Illustrated are the quantification of teratoma type observed following the teratoma rejection study depicted in FIG. 6. Upon review of the morphology of the teratoma samples, a clear phenotype that correlates with the levels of MHC-I expression was observed.
Figure 8A:
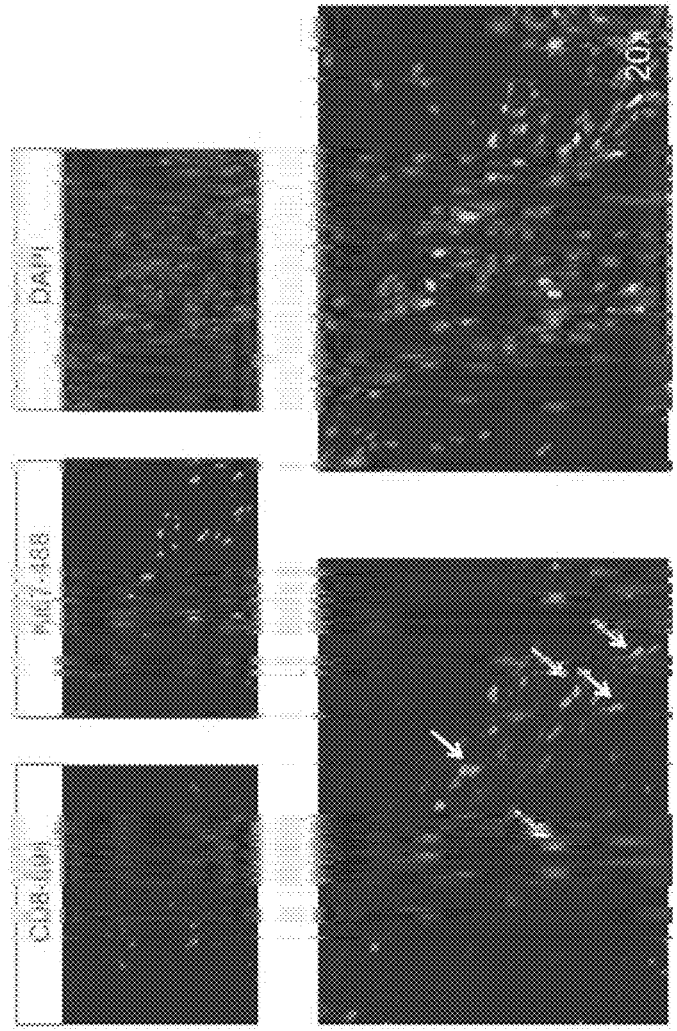
FIGS. 8A-8C demonstrate that proliferation of infiltrating CD8+ T cell indicates immune rejection.
Figure 8B:
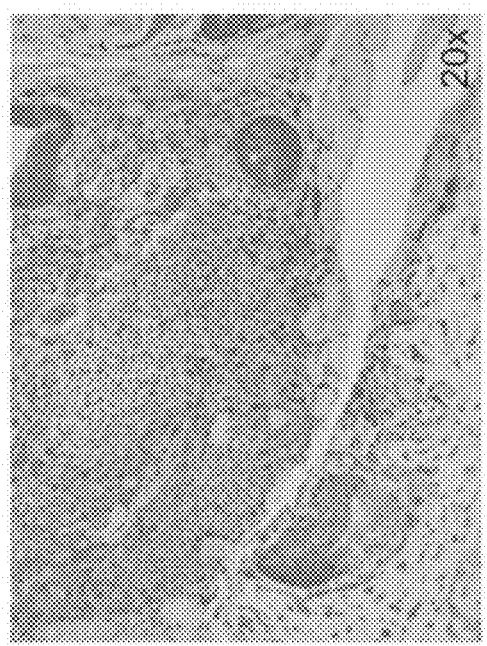
Figure 8C:
Figures 9A, 9B, 9C, 9D:
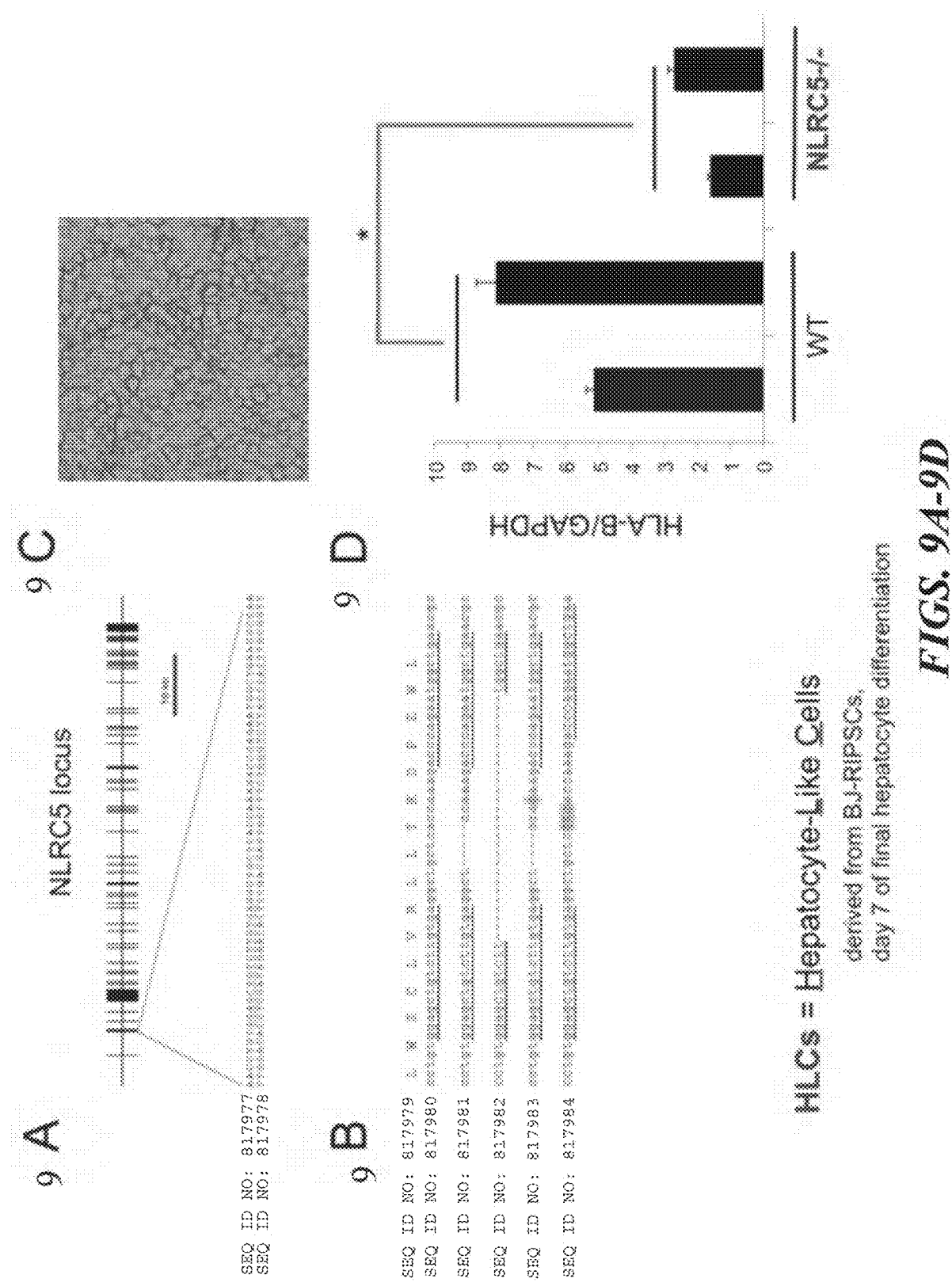
FIGS. 9A-9D demonstrate that the deletion of NLRC5 using TALENs results in reduced MHC-I expression in induced pluripotent stem cell-derived hepatocyte-like cells (HLCs).

The functional consequences of reduced HLA expression in the genome-edited cells were next evaluated in a humanized mouse model that was prepared by reconstituting an immunocompromised mice model with a human immune system (FIG. 6). As illustrated in Table 1 below, a comparable number of teratomas formed in all cases, irrespective of the genotype and the whole colony had to be sacrificed. Similarly, no differences in the failure rates of teratoma formation was observed. The inventors looked more closely at the overall morphology of the teratoma samples and a clear cut phenotype that correlates with the levels of MHC-I expression was identified. NLRC5, reduced, B2M absent MHC-I on the surface. FIG. 7 illustrates the quantification of the resulting teratoma types. FIGS. 8A-8C further demonstrate CD8+ T cell proliferation in wild-type cells and suggests immune rejection of the wild-type teratomas and improved engraftment of the genome-edited cells in the humanized mouse model.

TABLE 1

|  | Genotype | #tumors (injections) |
|---|---|---|
| p42 | WT | 21 (24) |
| E4 | NLRC5−/−CIITA−/− | 21 (24) |
| C7 | B2M−/−CIITA−/− | 20 (24) |
| C6 | NLRC5−/−CIITA−/− | 18 (20) |

The foregoing results therefore demonstrate successful targeting of NLRC5, CITTA and B2M in HuES9 and BJ RiPSCs and further evidence that genome-edited cells can be differentiated into a variety of different cell types that are characterized by reduced HLA expression.

The inventors have used both a TALENs system and a CRISPR/Cas system to facilitate the targeting of transcriptional regulators of HLA expression (i.e., the MHC enhanceosome). TALEN-induced CIITA and NLRC5 mutations in BJ-RIPSCs and HuES9 are illustrated in FIGS. 15A-D. In addition, NLRC5 and CIITA can also be targeted utilizing CRISPRs to achieve a reduction in MHC class I expression and complete loss of MHC class II expression, respectively.

Figure 16B:
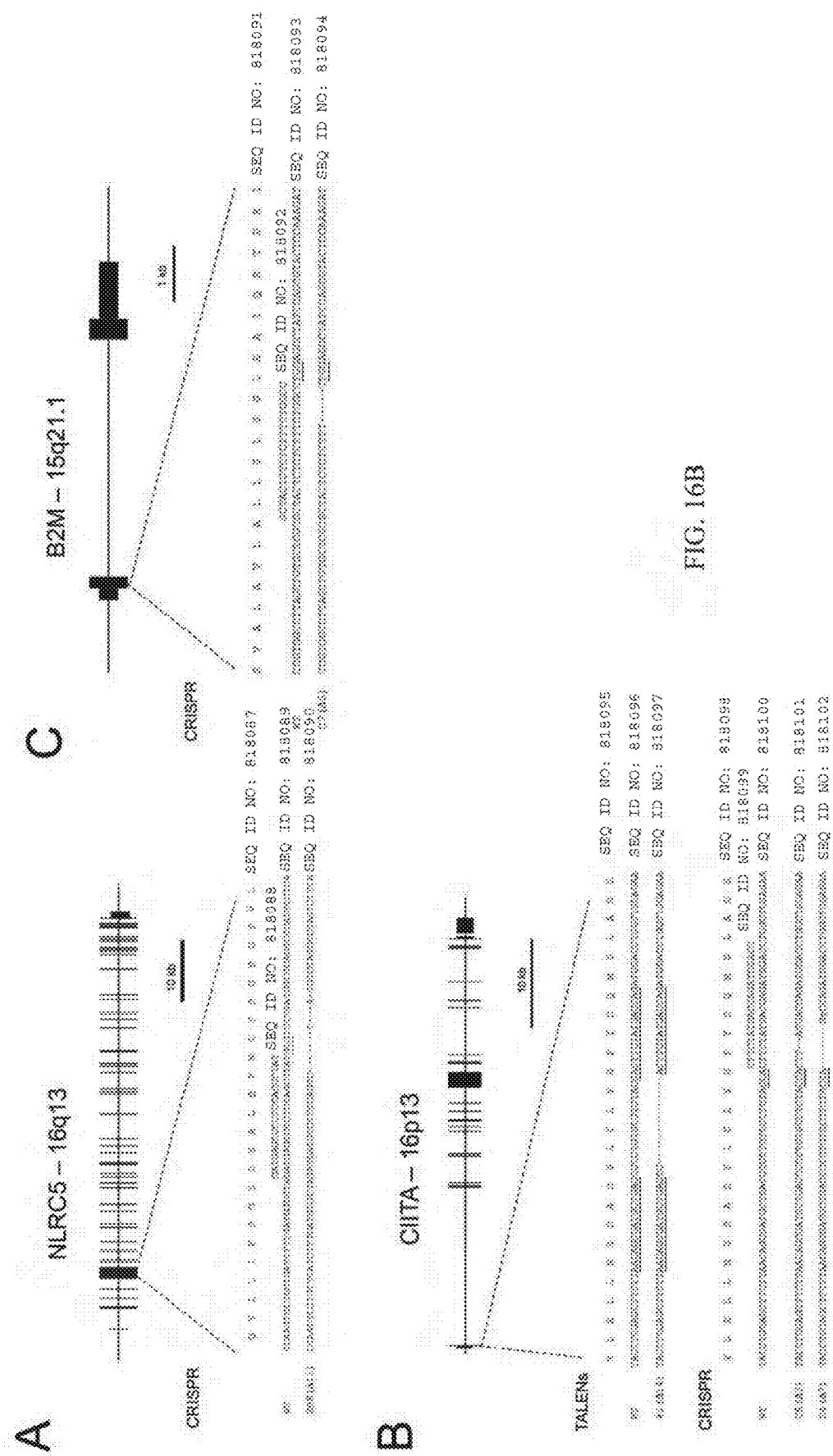

NLRC5 was targeted in Thp1 cells using CRISPR and it was demonstrated that MHC-I expression in NLRC5−/− Thp1 cells was reduced (FIG. 16A). Examples of CRISPR and/or TALENs systems targeting NLRC5, CIITA and B2M are provided in FIG. 16B. Reduced MHC class I expression in HuES9 was shown following targeting with NLRC5 or B2M CRISPRs. For example, about 50% reduction was shown in IFNγ-treated NLRC5−/− cells and complete loss of MHC-I surface expression was shown in B2M−/− cells (FIG. 16C).

Figure 16D:
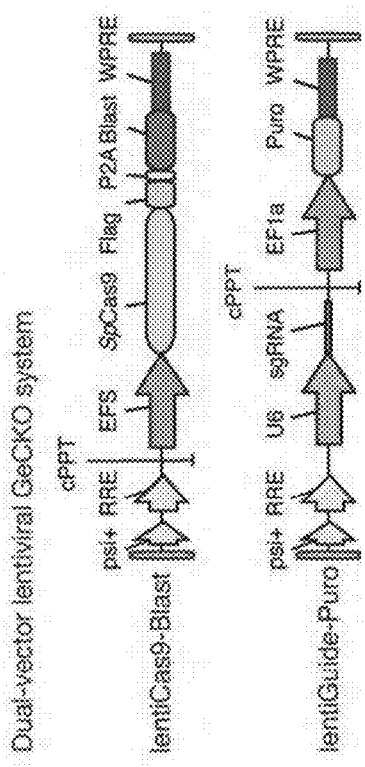
Figure 16F:
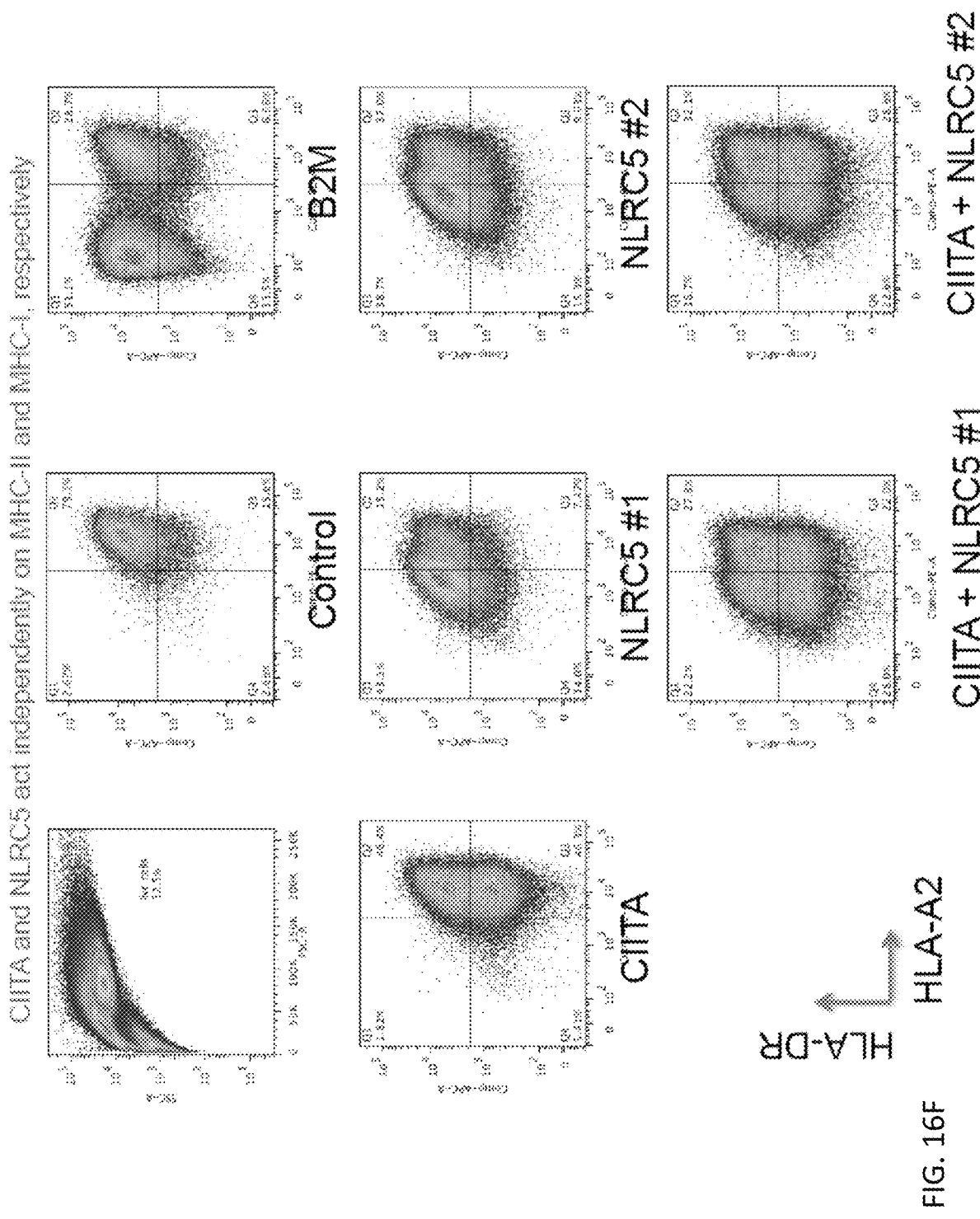
Figure 16G:
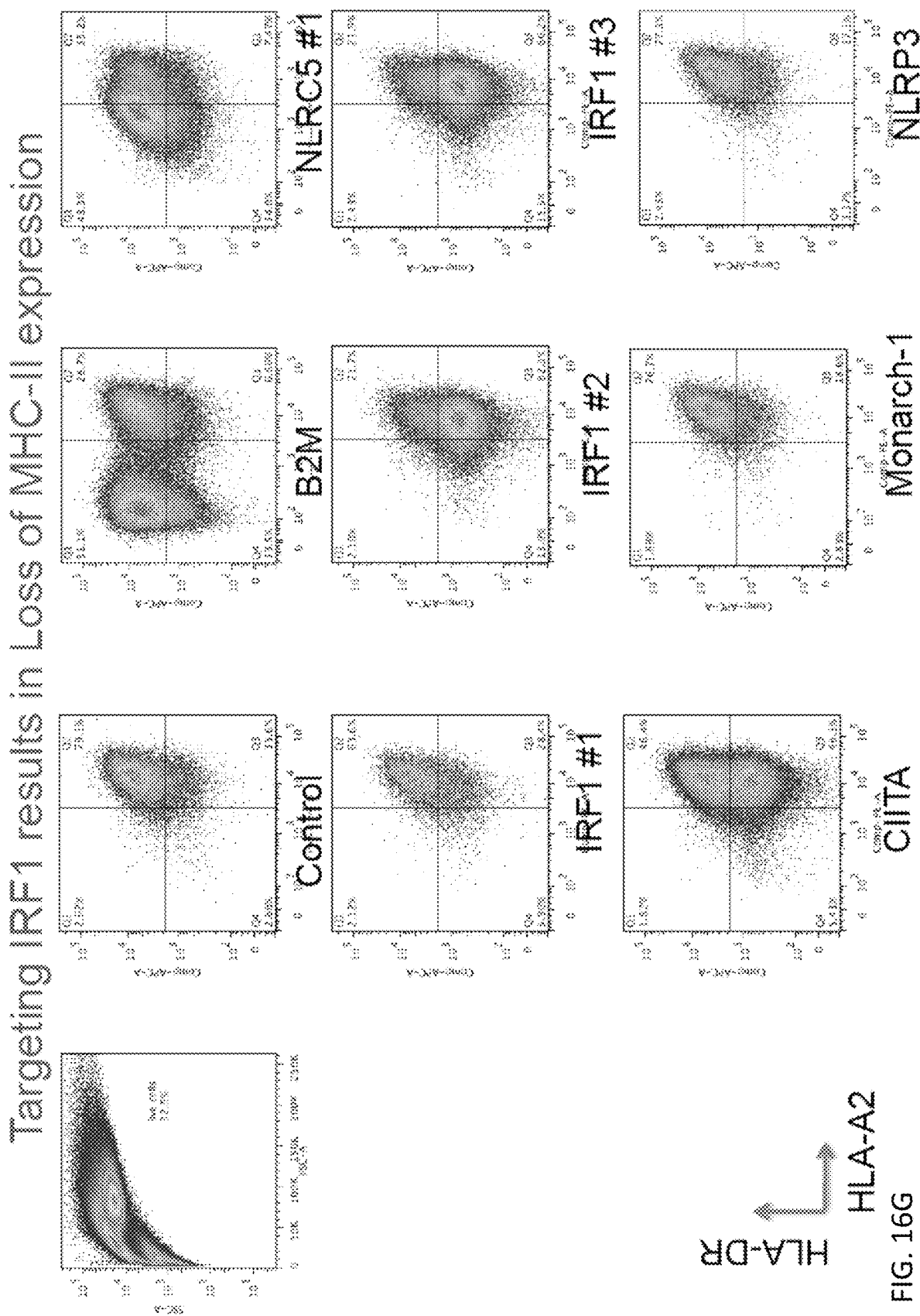

A lentiviral transduction of Thp-1 was conducted using a two component (e.g., dual vector) system (FIG. 16D). The two component system included Lenti-Cas9-Blasticidin and Lenti-Guide-puro. Examples of the different CRISPRs used for the lentiviral transduction of Thp-1 are provided in FIG. 16E. Thp-1 was transduced with lentivirus encoding NLRC5 and CIITA. A B2M CRISPR was used as a positive control. All of the cells were stimulated ON with 50U IFNγ to boost HLA expression (HLA-A2 was 1:200 and HLA-DR was 1:100). It was demonstrated that CIITA and NLRC5 act independently on MHC-II and MHC-I, respectively (FIG. 16F). At ten days post CRISPR transduction, when the Thp1 cells were all stimulated ON with 50U IFNγ (HLA-A2 is 1:200 and HLA-DR is 1:100), it was demonstrated that targeting IRF1 results in a loss of MHC-II expression (FIG. 16G).

Figure 17A:
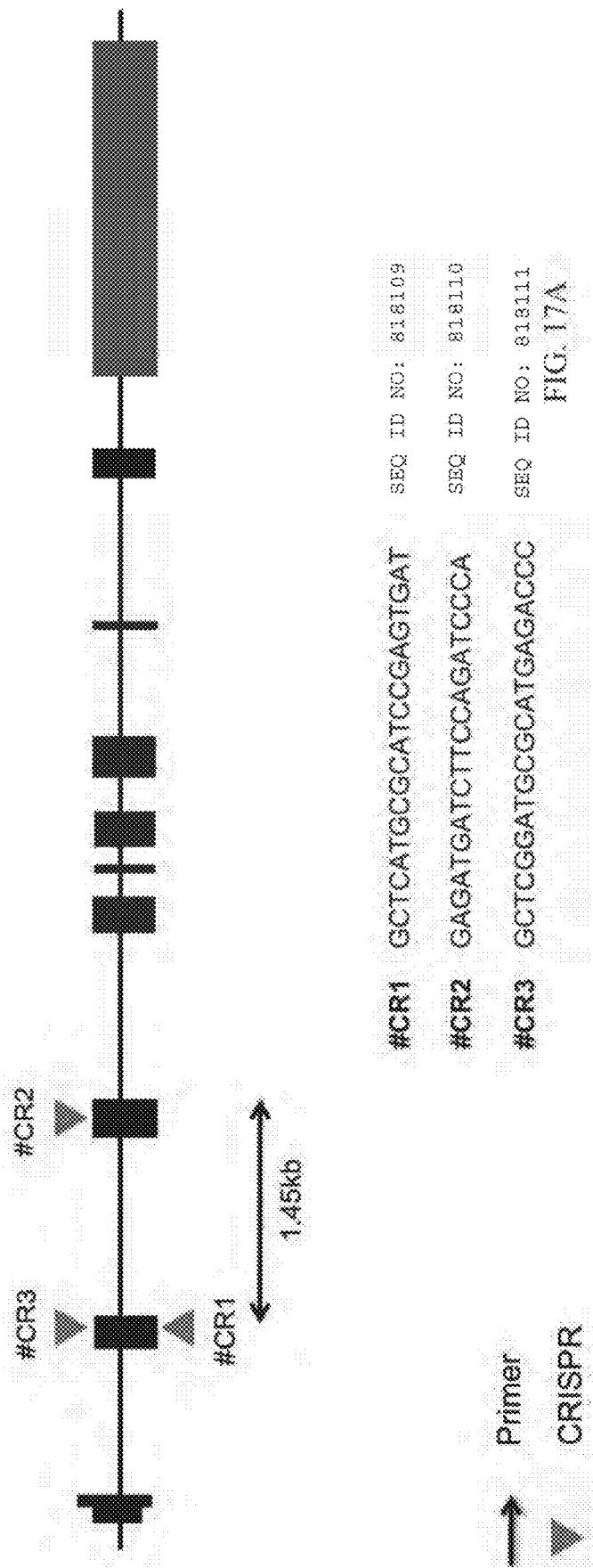
Figure 17B:
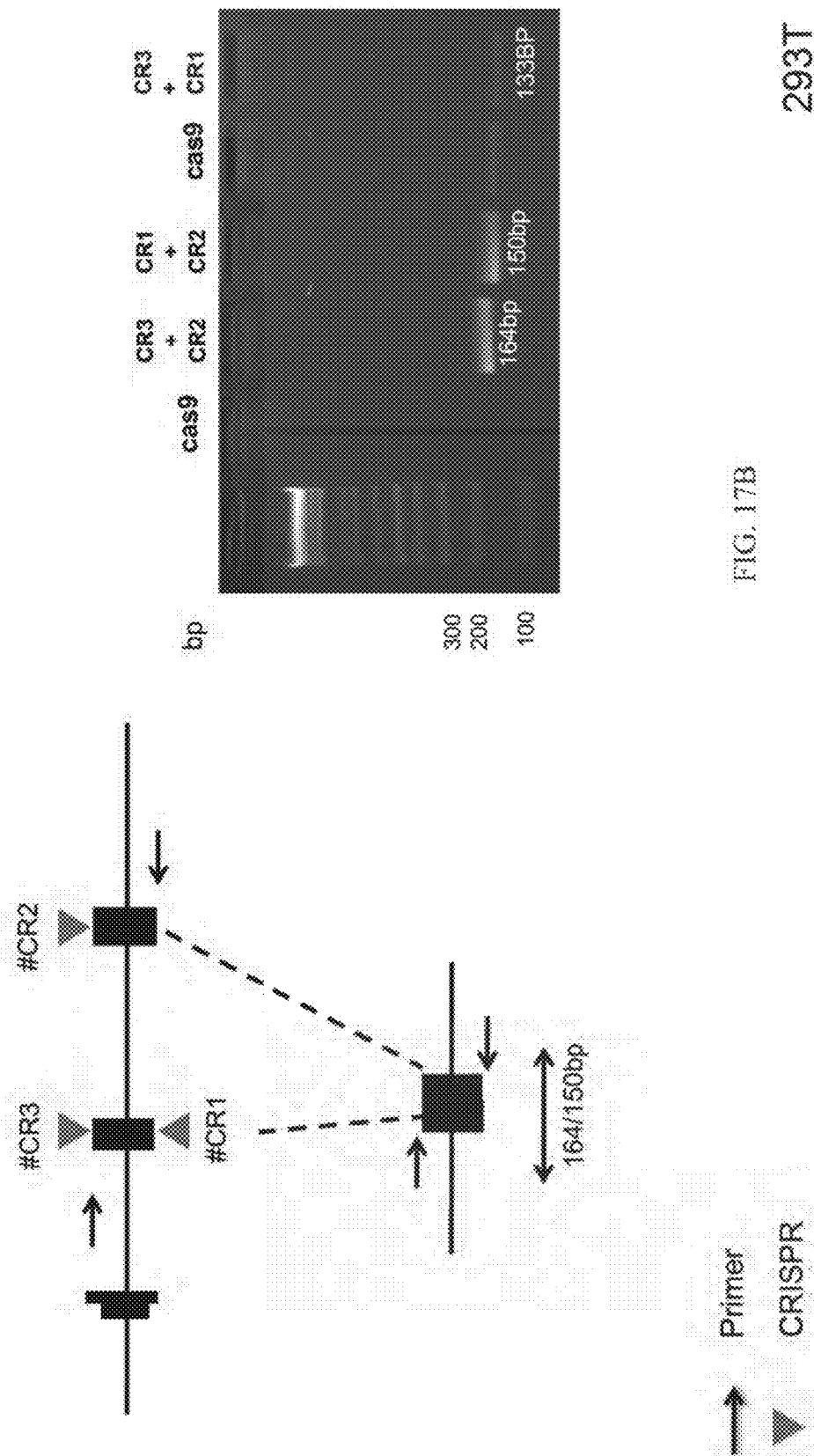
Figure 17C:
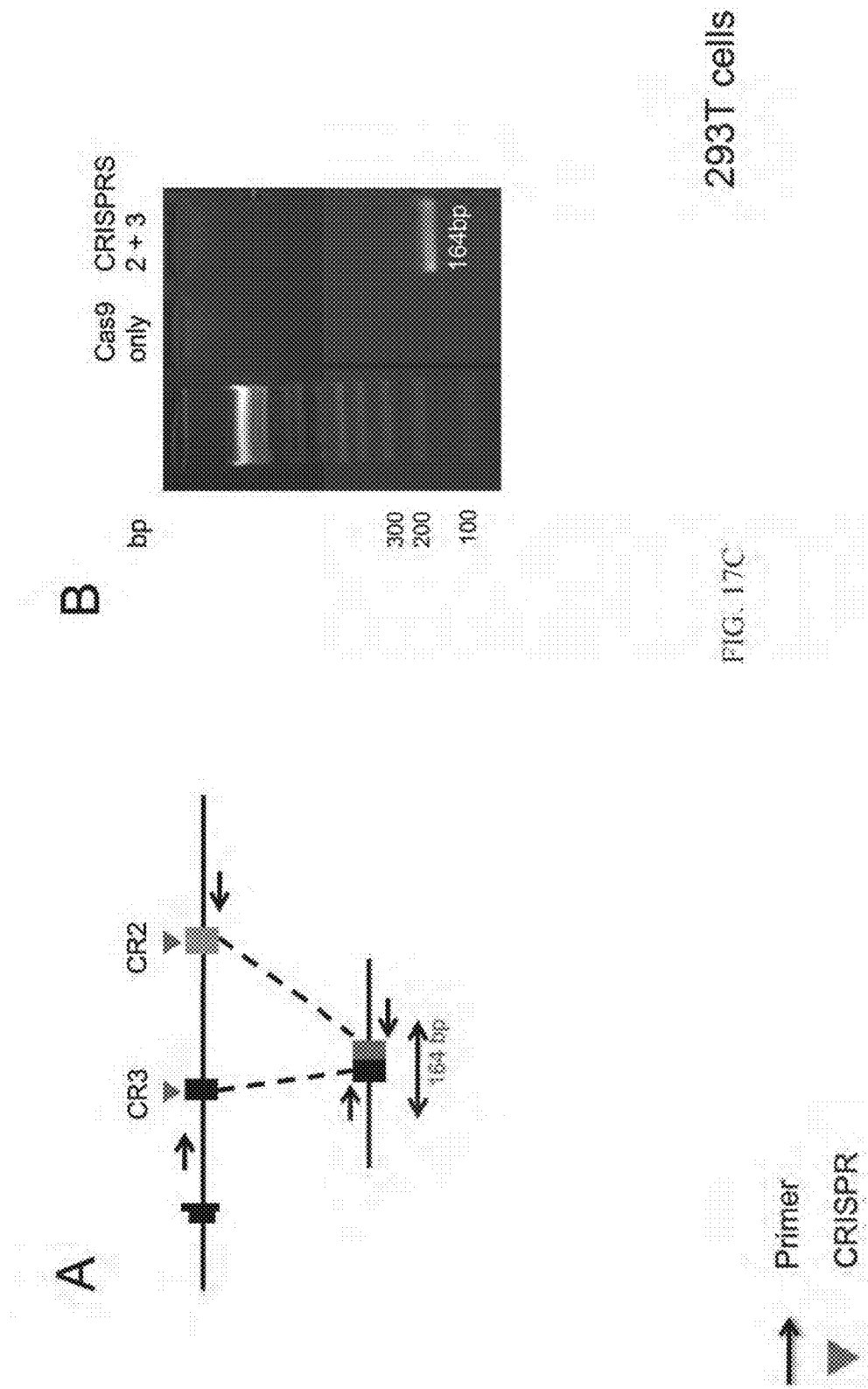
Figure 17D:
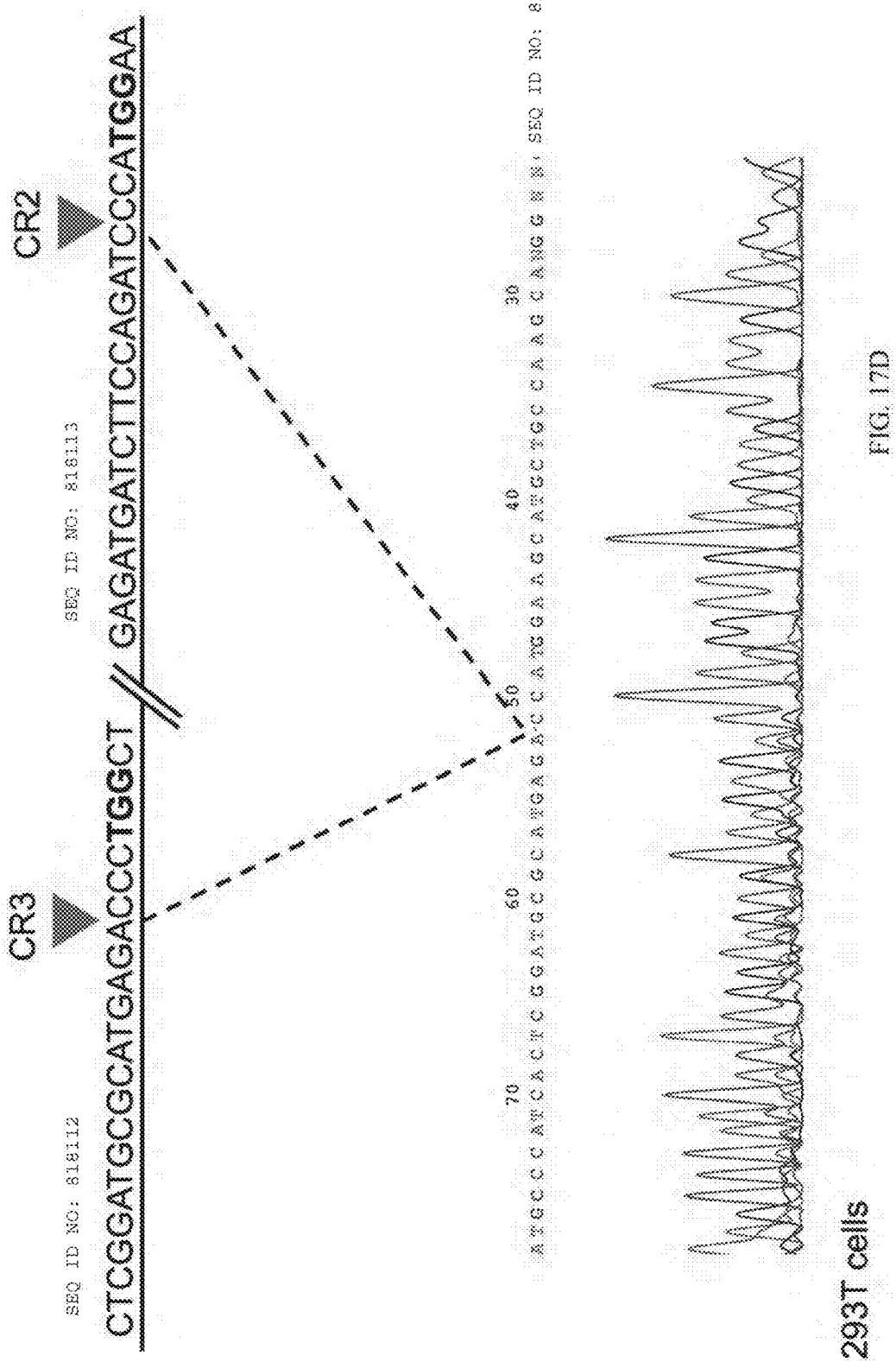
Figure 17E:
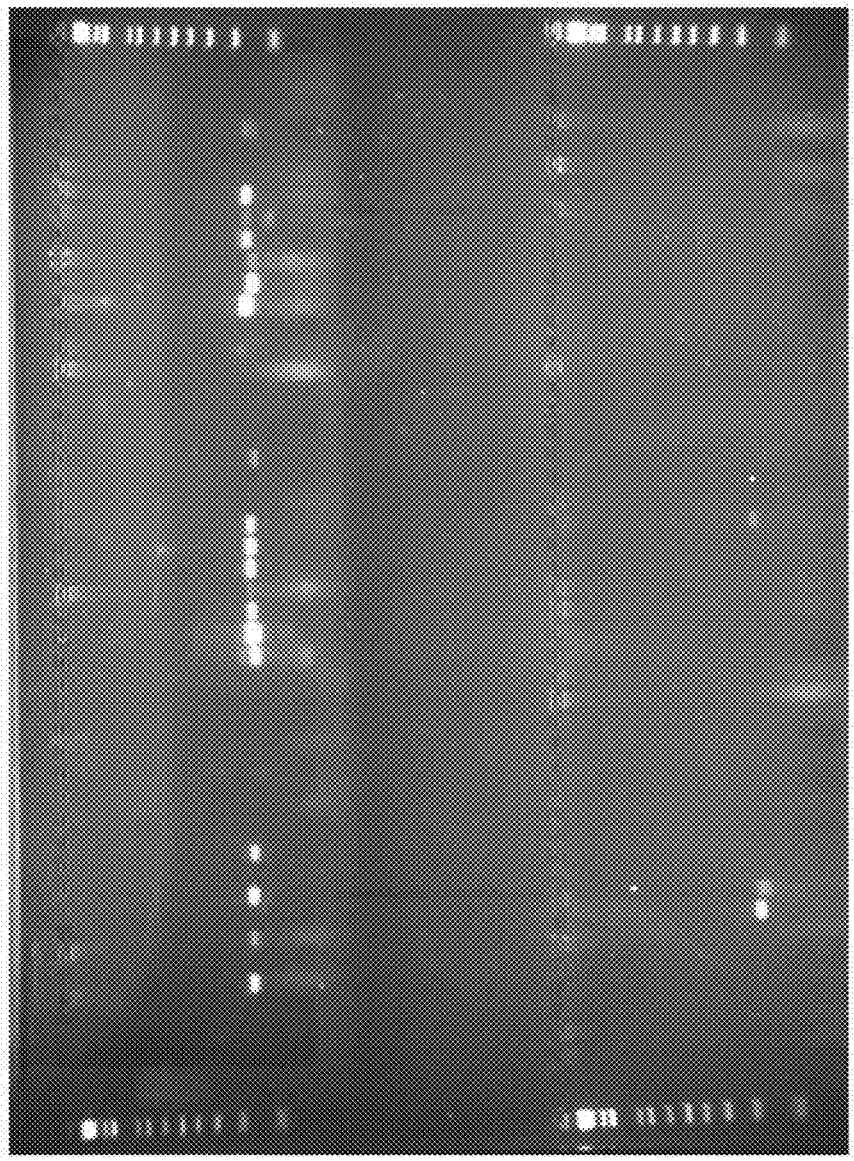

The inventors further examined targeting of IRF1 and the resultant reduced MHC class I expression in human pluripotent stem cells (HuES9) and Thp-1 cells. A schematic demonstrating a dual CRISPR strategy for targeting the IRF1 locus is provided in FIG. 17A. Testing of different IRF1 guide combinations was conducted (FIG. 17B) and a 'dual guide strategy' for the targeted deletion of IRF1 was identified (FIG. 17C). After the dual guide strategy for the targeted deletion of IRF1 was applied, a sequence confirmation of IRF1 CRISPR induced deletion was provided (FIG. 17D), followed by screening of IRF-1 targeted HuES9 cells (FIG. 17E). The presence of the PCR bands suggests successful targeting using the dual CRISPR strategy.

Figure 17H:
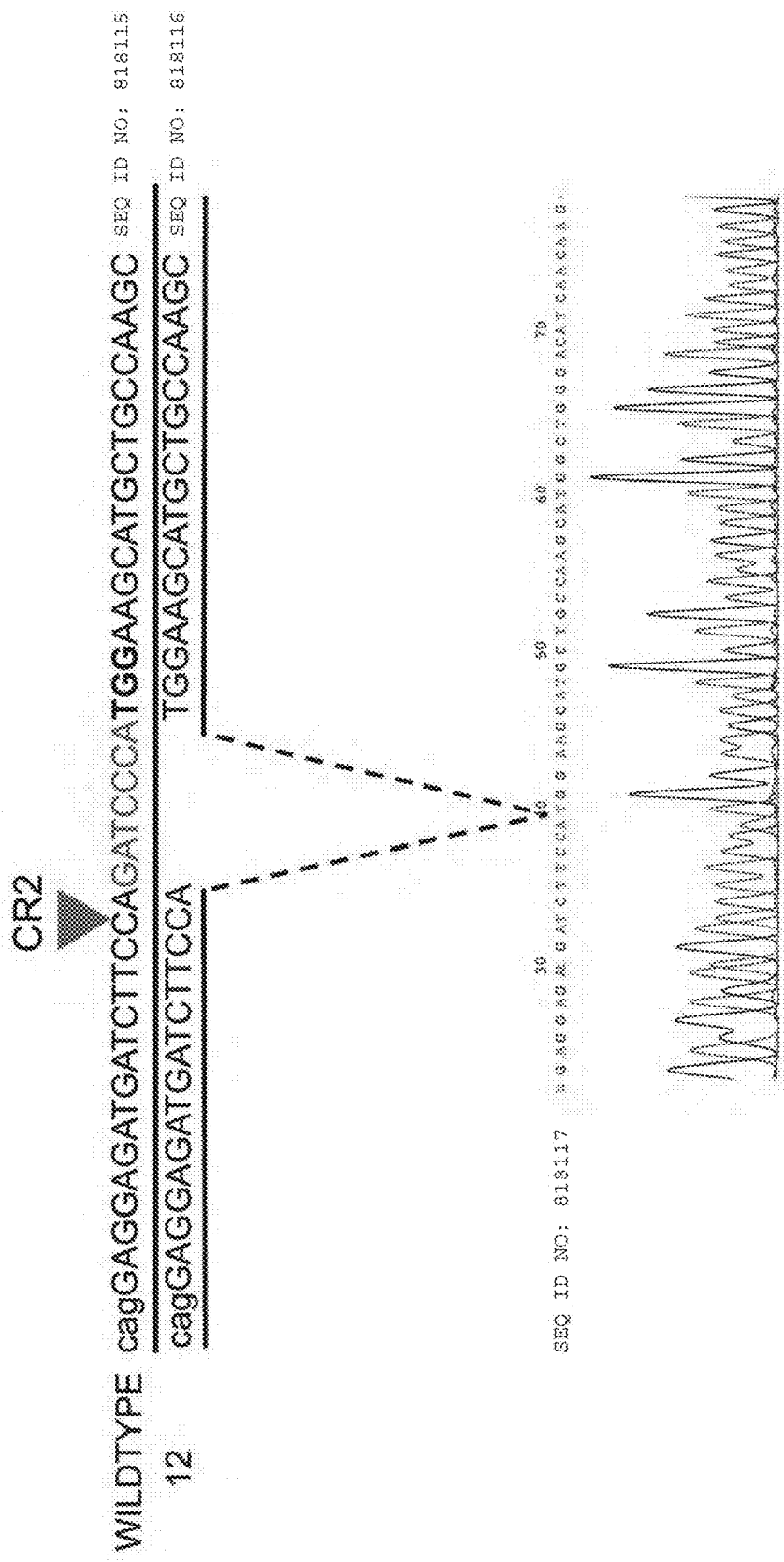
Figure 17I:
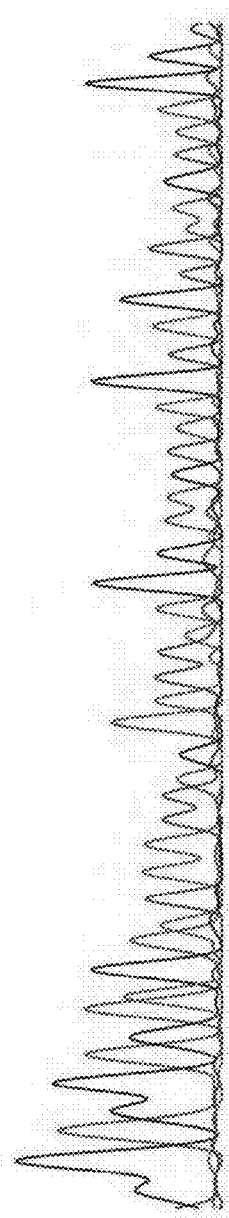
Figure 17J:
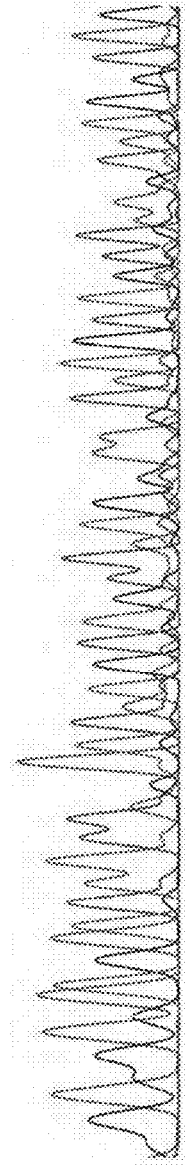
Figure 17K:
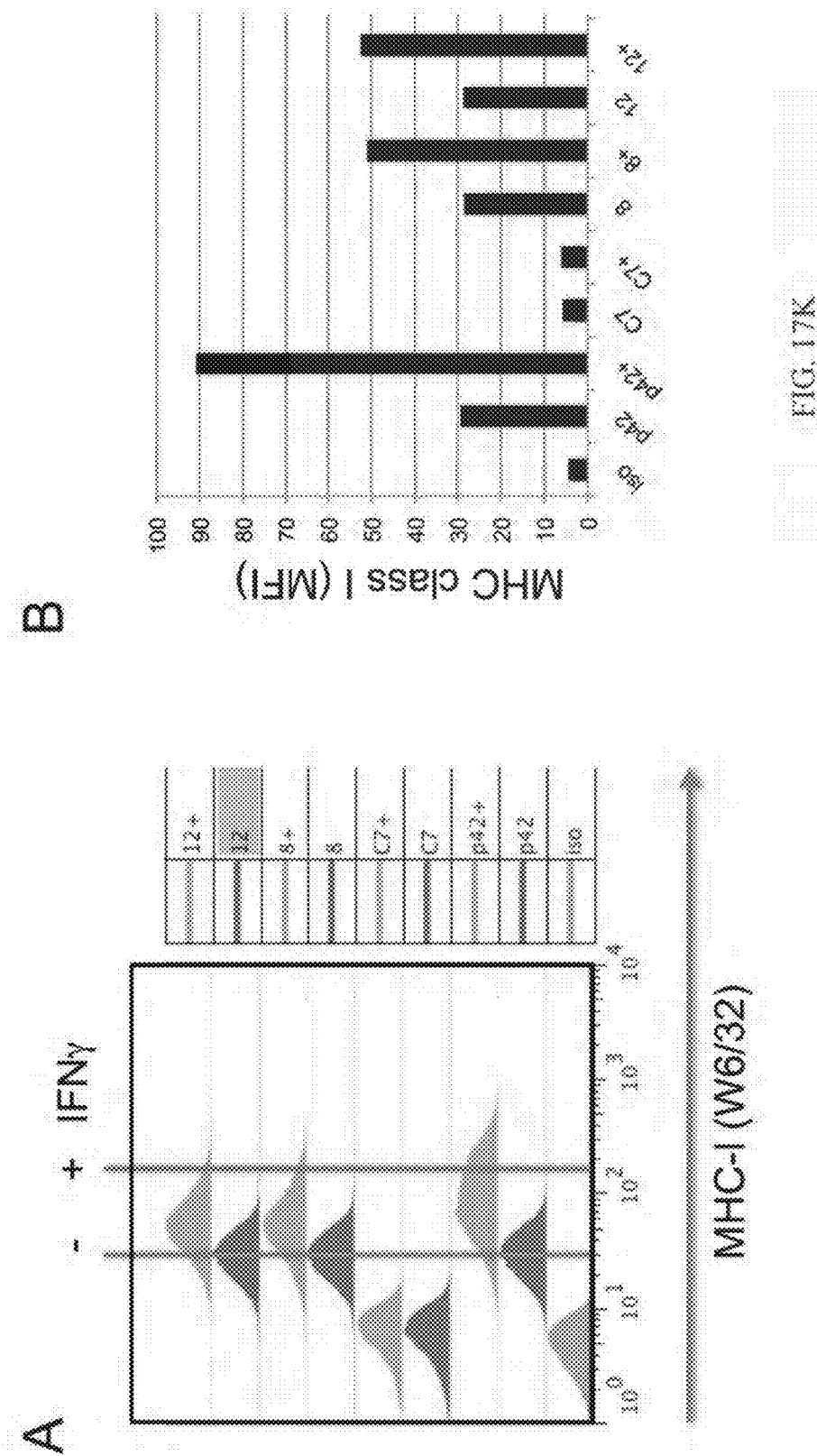

The inventors then reconfirmed (FIG. 17F) and genotyped (FIG. 17G) the IRF1 clones. Sequencing confirmed IRF1 CRISPR induced deletion in clone 12 (FIG. 17H), clone 17 (FIG. 17I) and clone 21 (FIG. 17J). The IRF1−/− HuES9 clones exhibited impaired MHC class I induction following IFNγ treatment for 48 hours (FIG. 17K).

Figure 18A:
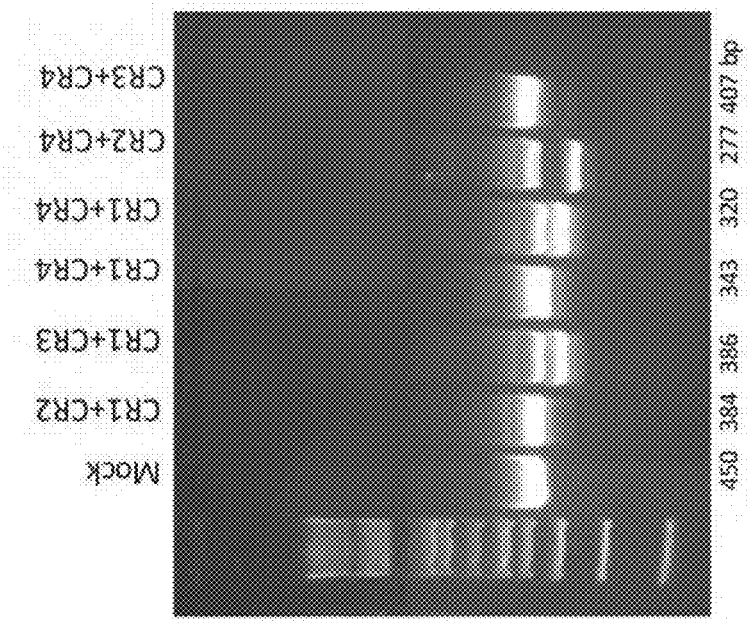
Figure 18B:
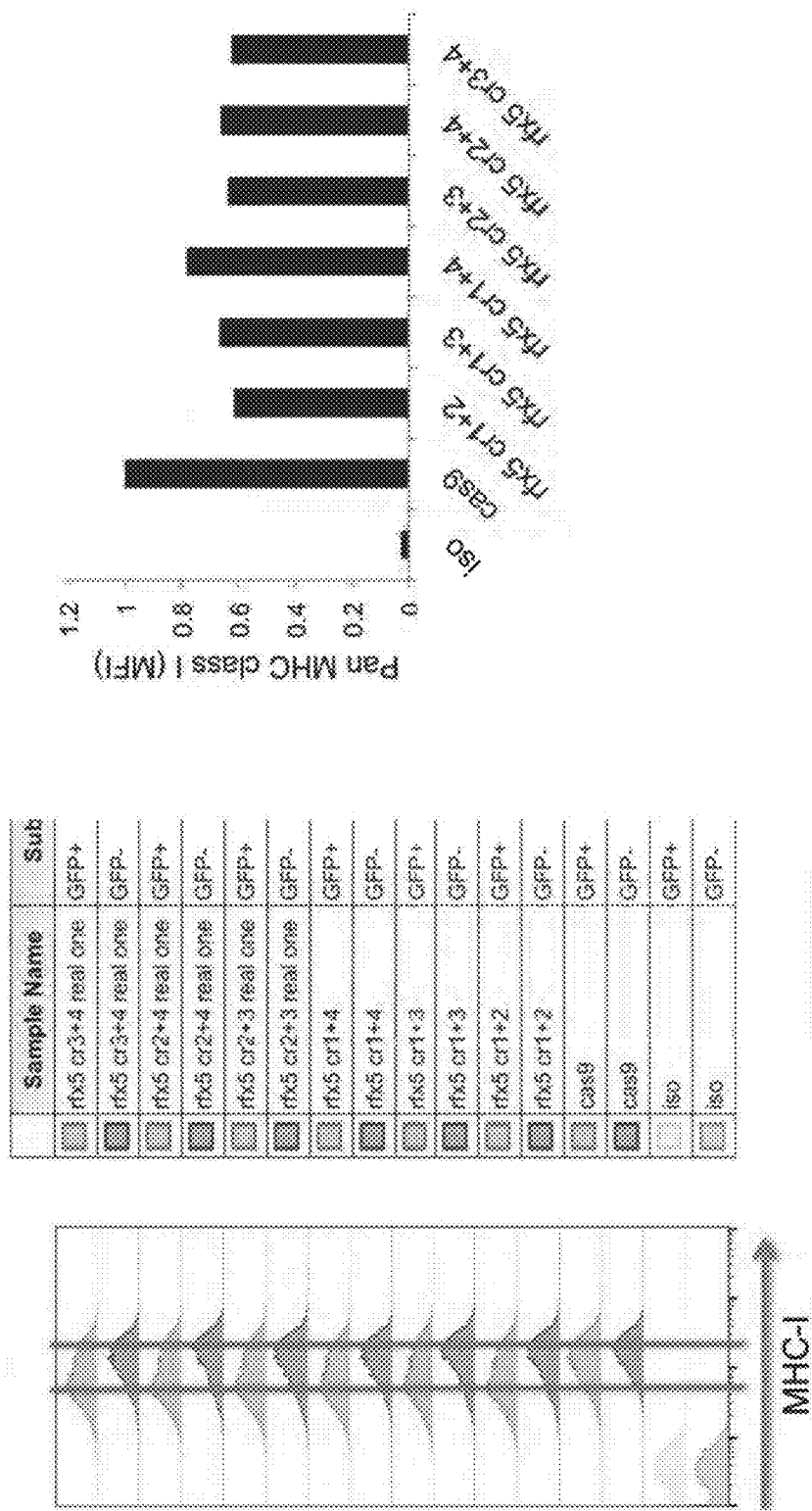
Figure 18C:
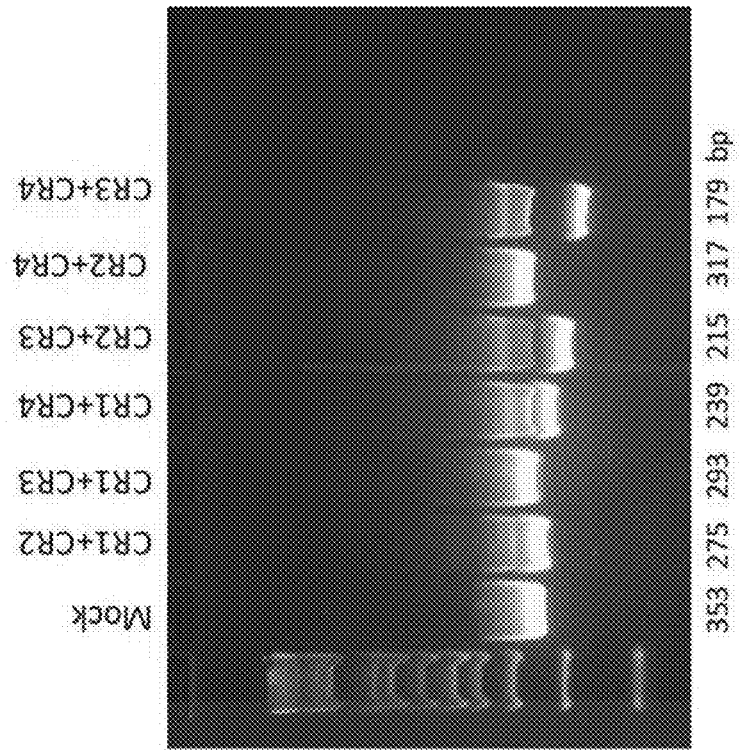
Figure 18D:
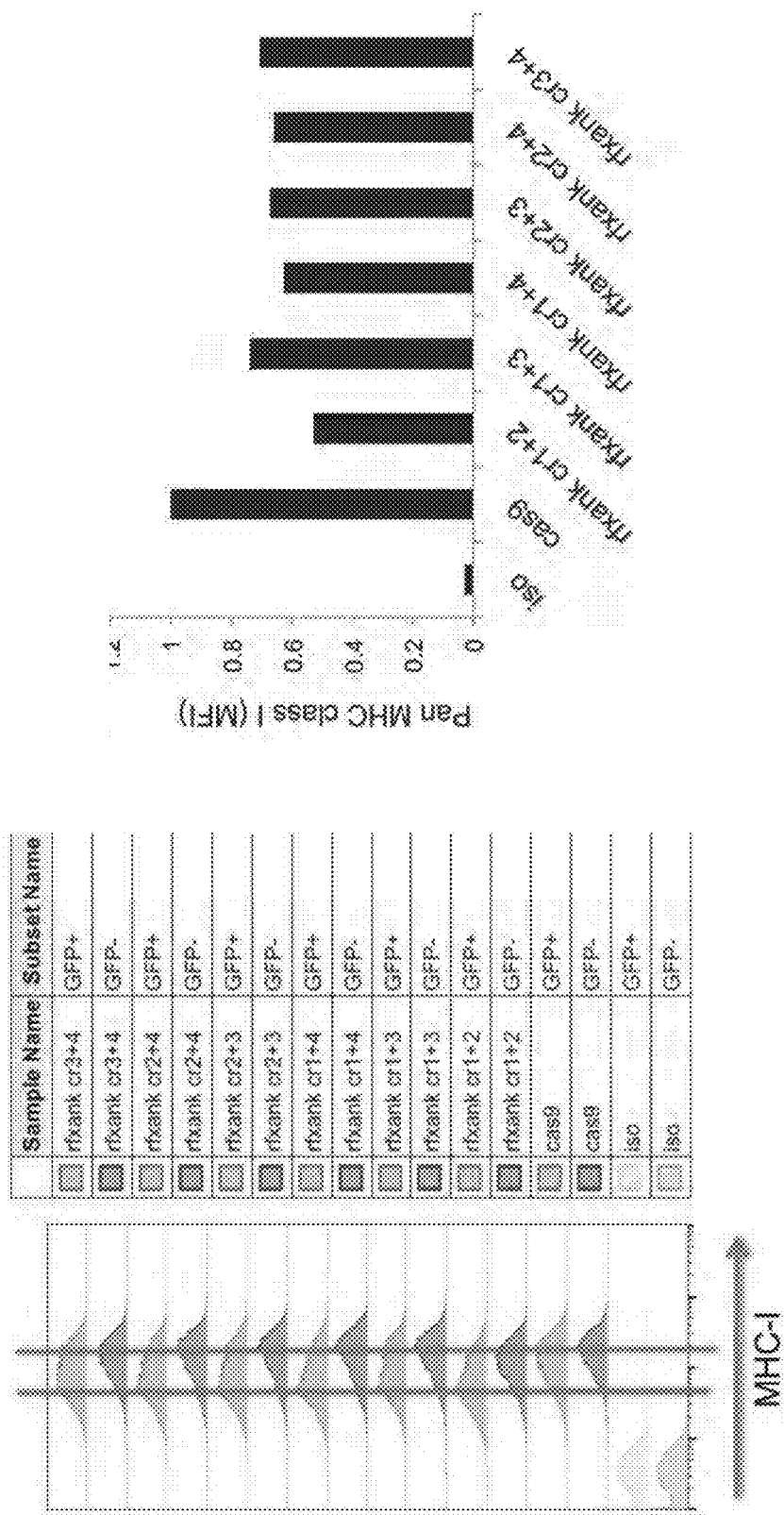
Figure 18E:
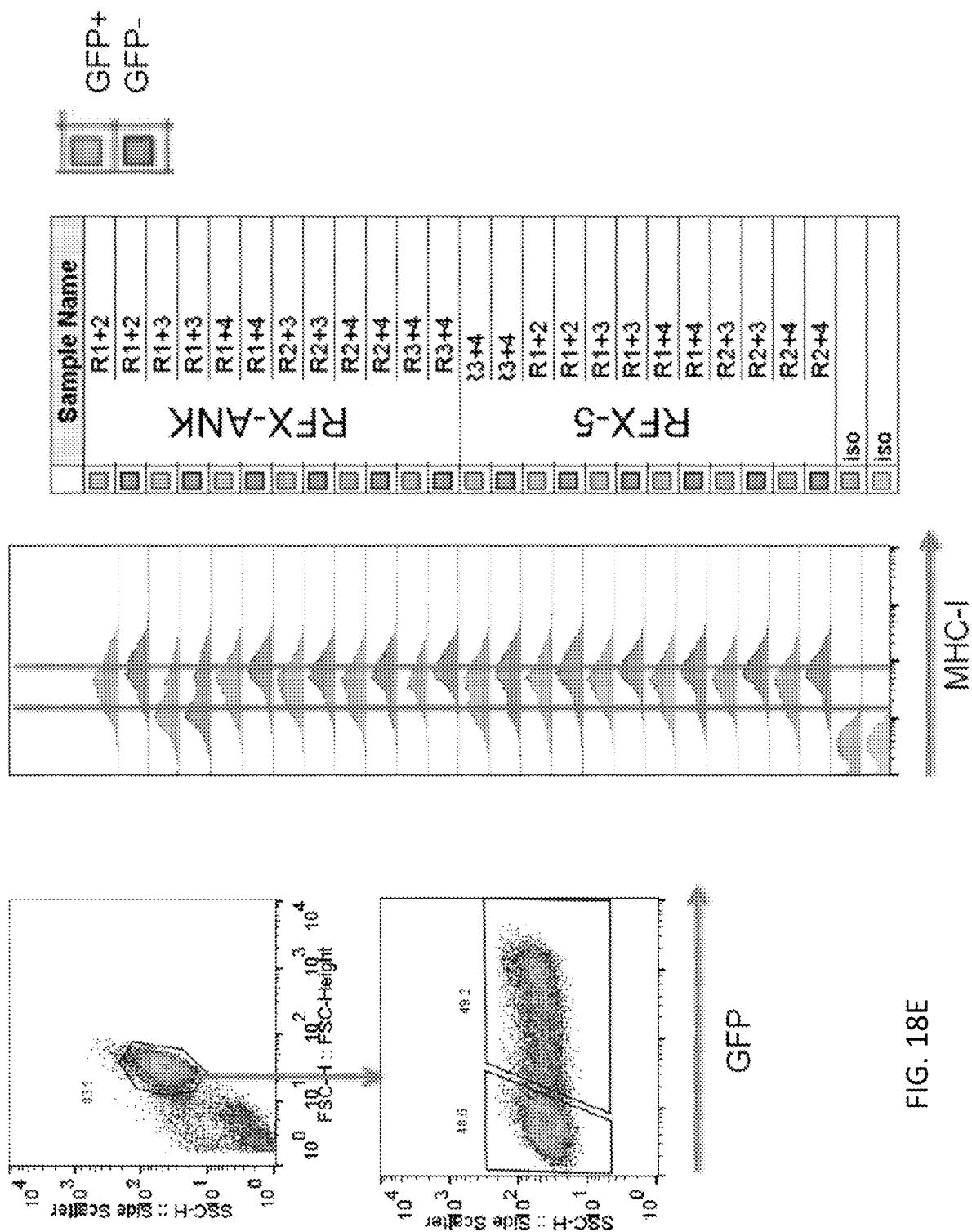
Figure 18F:
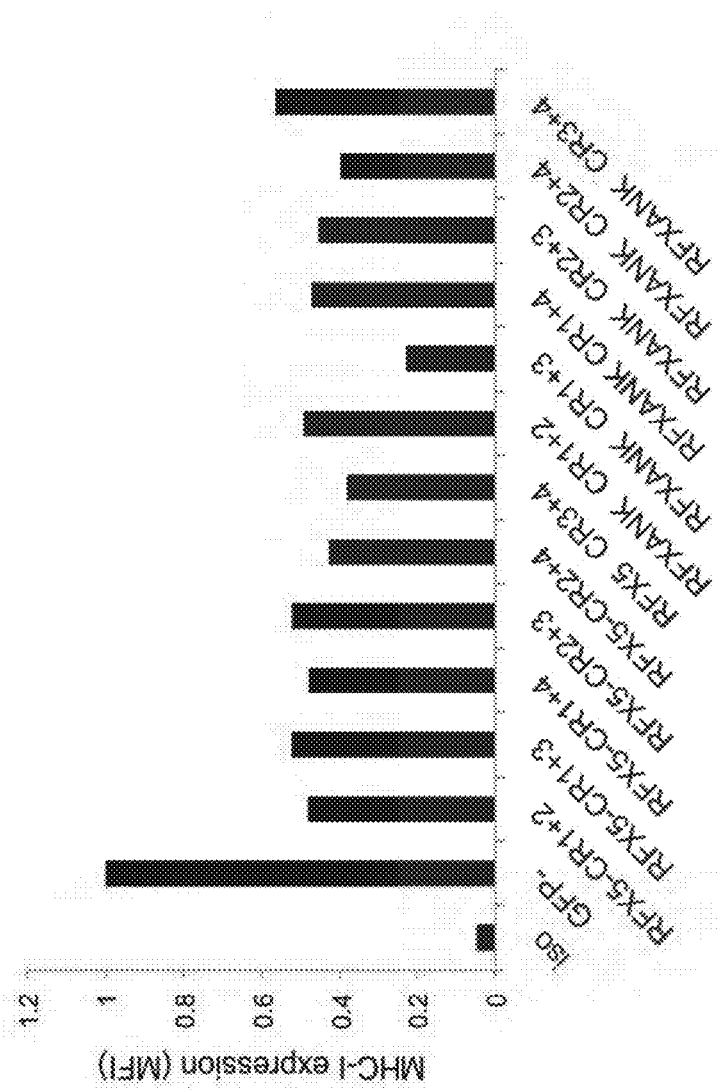
Figure 18H:
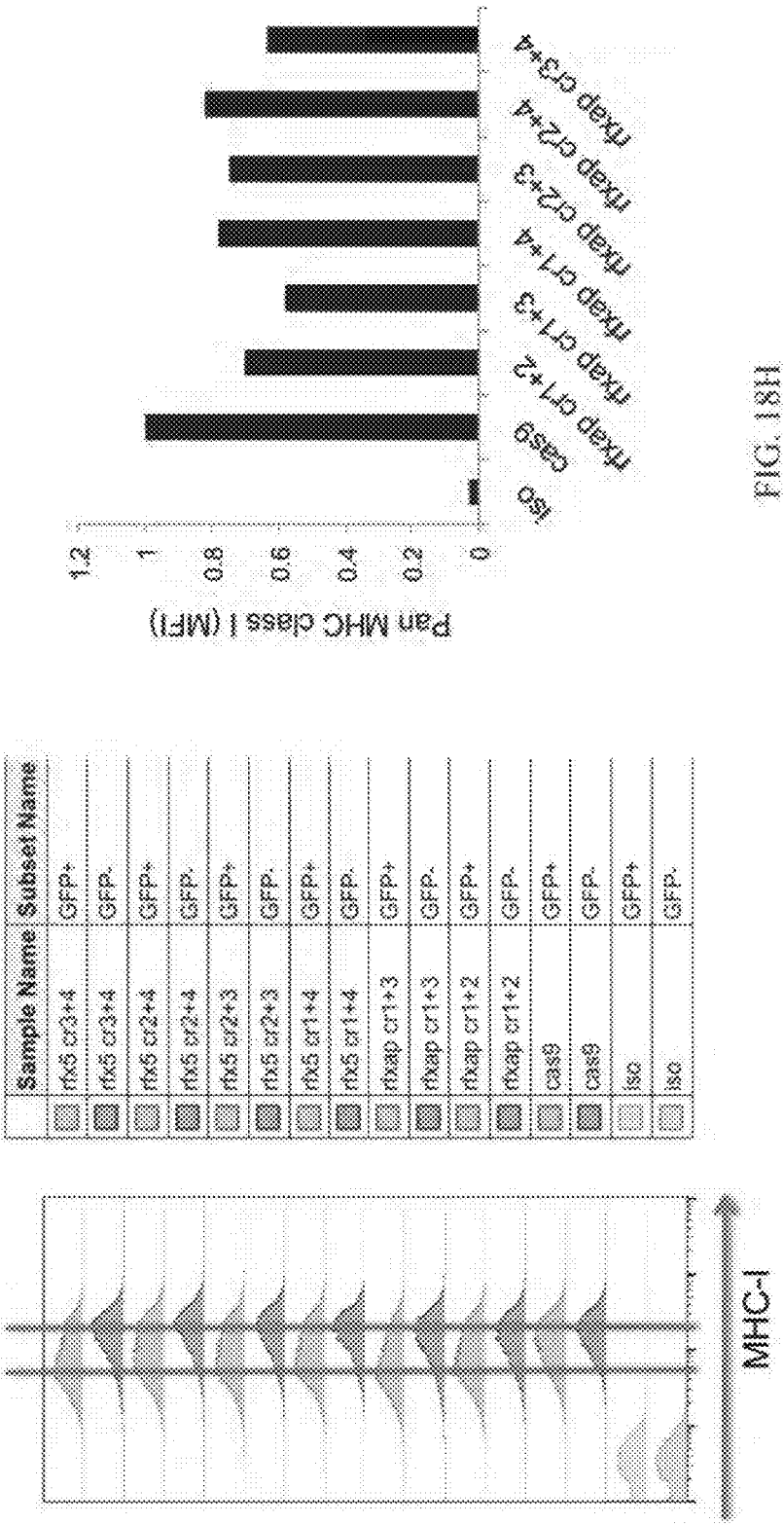
Figure 19A:
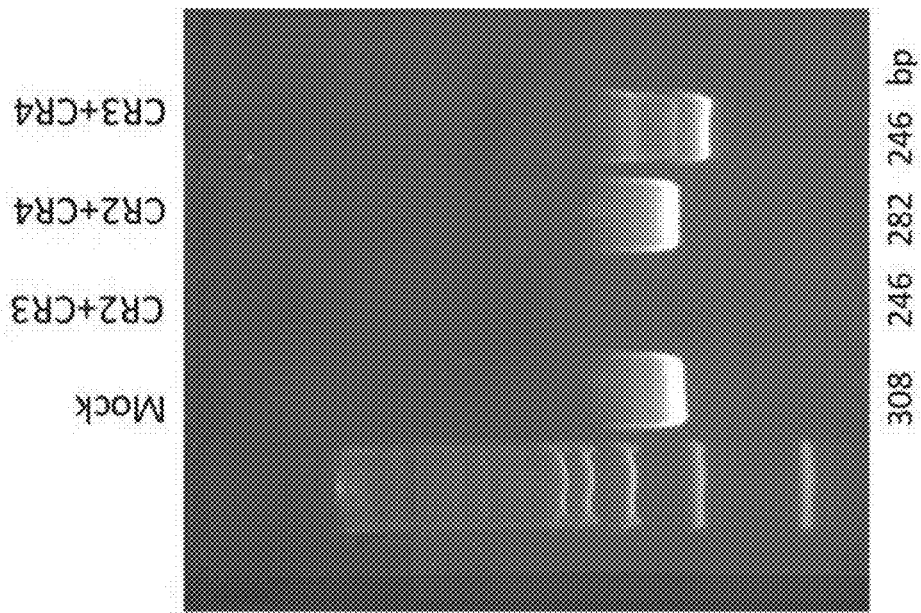
FIGS. 19A-19E demonstrate targeting of NFY-A, NFY-B and NFY-C utilizing CRISPR results in reduced MHC class I expression.
Figure 19B:
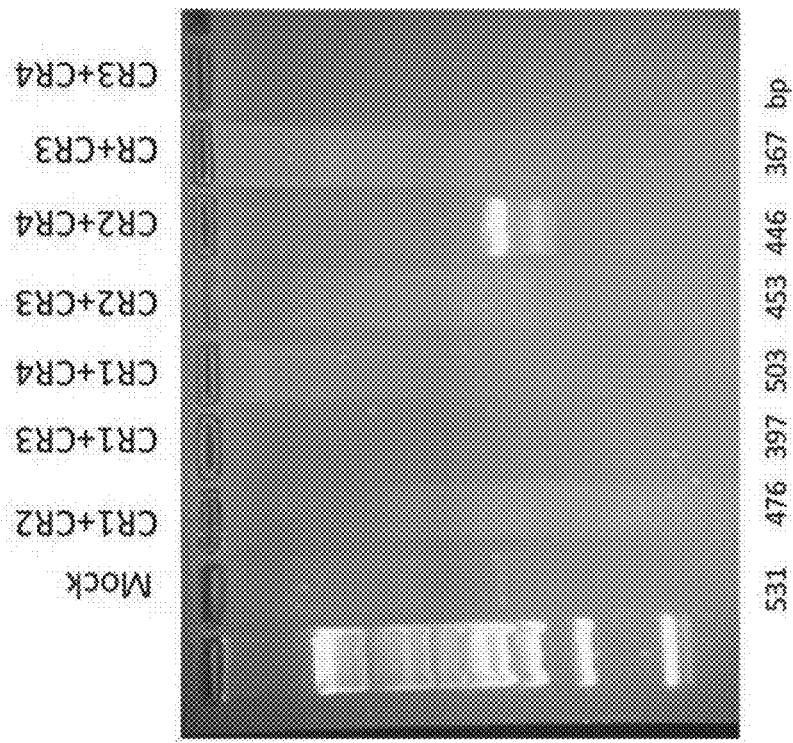
Figure 19C:
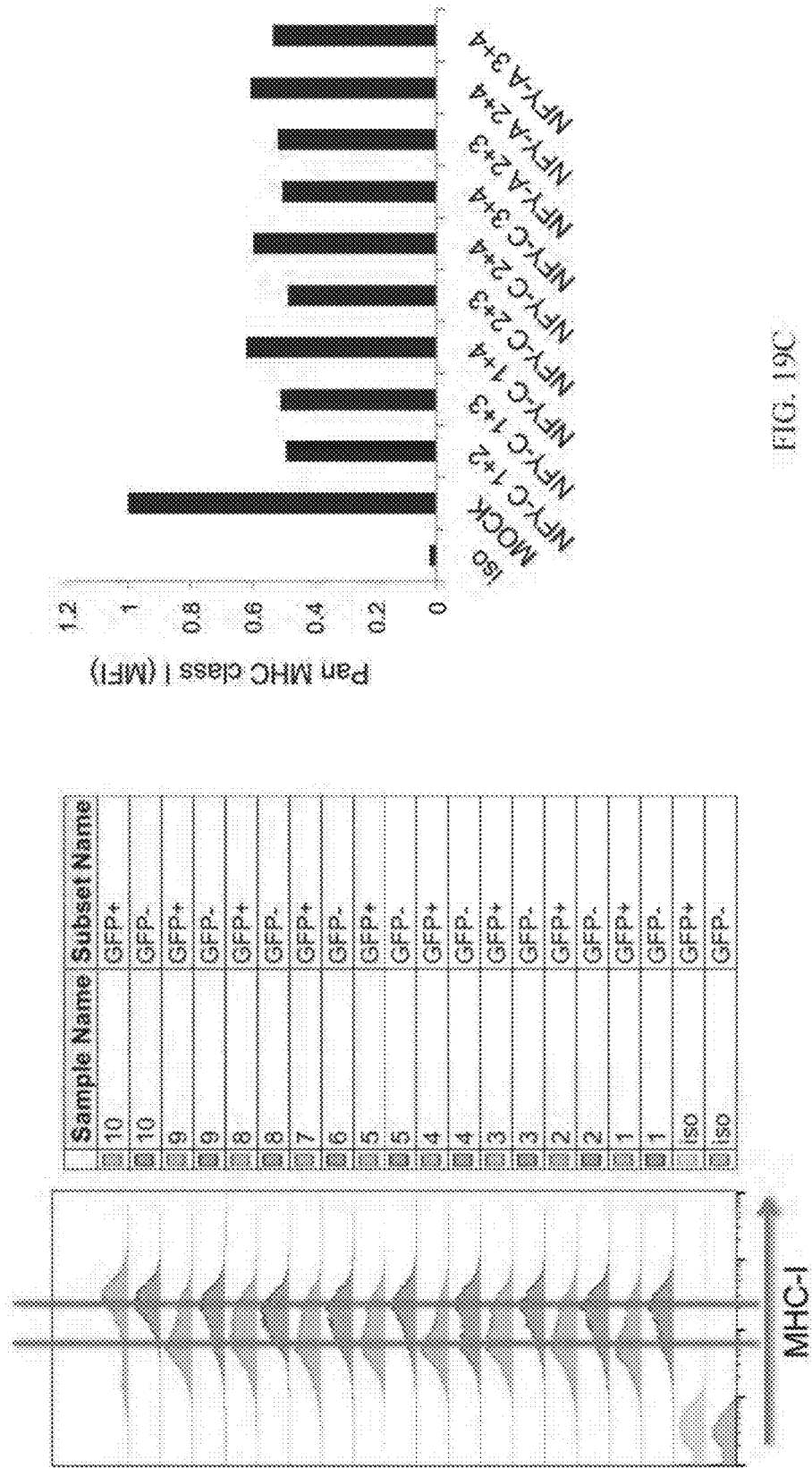
Figure 19D:
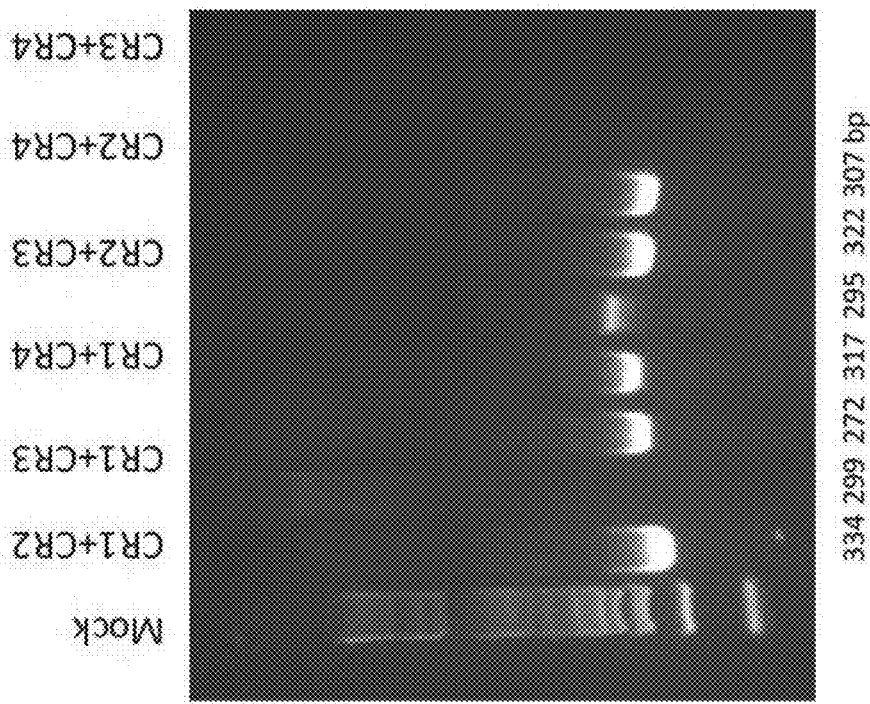
Figure 19E:
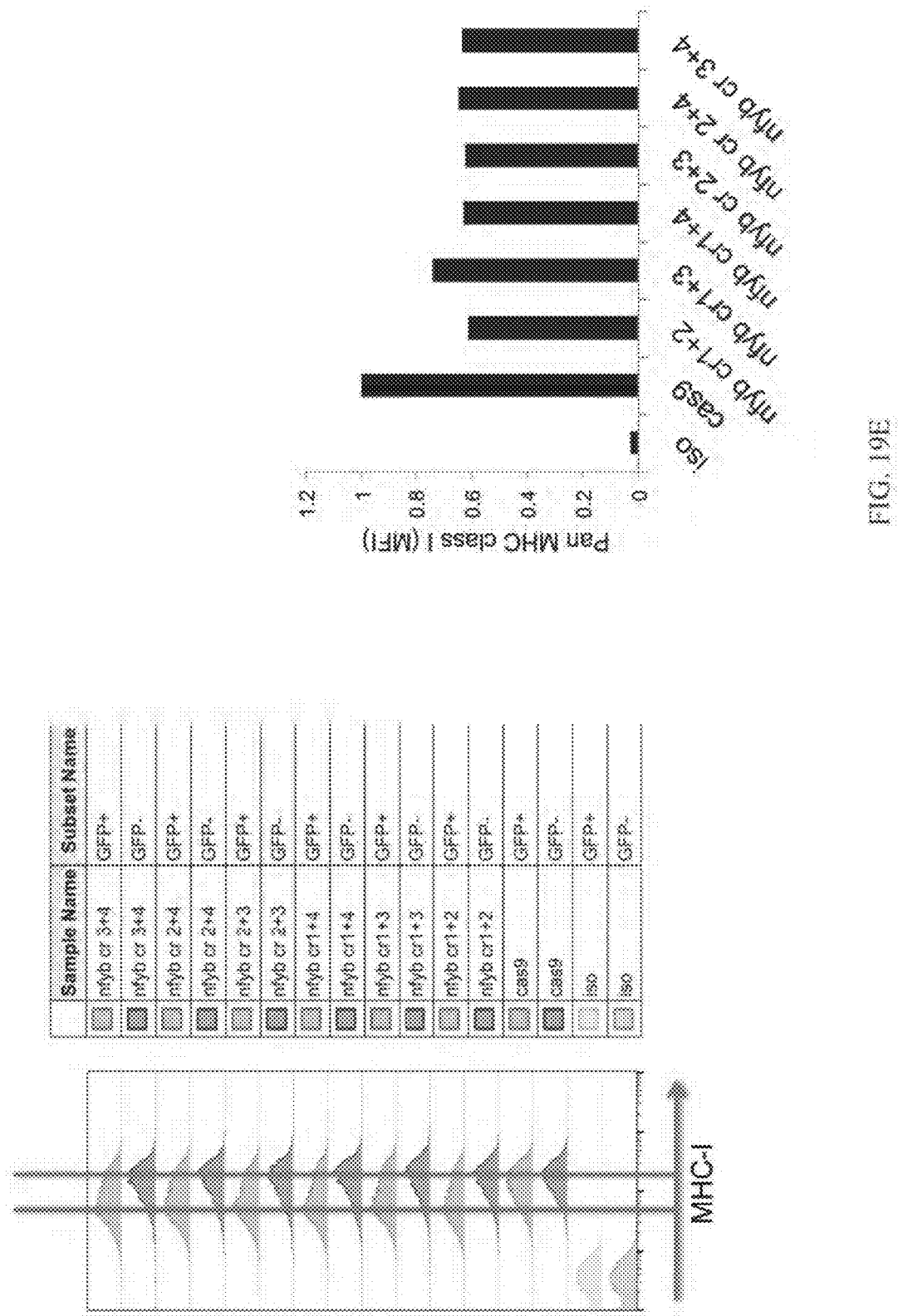

The inventors also examined targeting of additional enhanceosome components. The impact on MHC-I expression by targeting additional enhanceosome components in 293T cells was examined, but it is expected that the targeting of these additional enhanceosome components will also affect MHC-II levels in cells that actually express it, e.g., Thp1 cells or other APCs. For example, the inventors examined CRISPR targeting of RFX5 (FIG. 18A), RFX-ANK (FIG. 18C) and RFK-AP (FIG. 18G) in 293T cells using a dual guide strategy. The targeting results demonstrated reduced MHC class I expression of RFX5 (FIG. 18B, FIGS. 18E-18F), RFK-ANK (FIG. 18D, FIGS. 18E-F) and RFK-AP (FIG. 18H). The inventors also examined CRISPR dual guide targeting of NFY-A (FIG. 19A), NFY-B (FIG. 19D) and NFY-C (FIG. 19B) in 293T cells. The targeting results demonstrated reduced MHC class I expression of NFY-A (FIG. 19C), NFY-B (FIG. 19E) and NFY-C (FIG. 19C).

Blocking Surface Trafficking of MHC Class I

Figure 31:
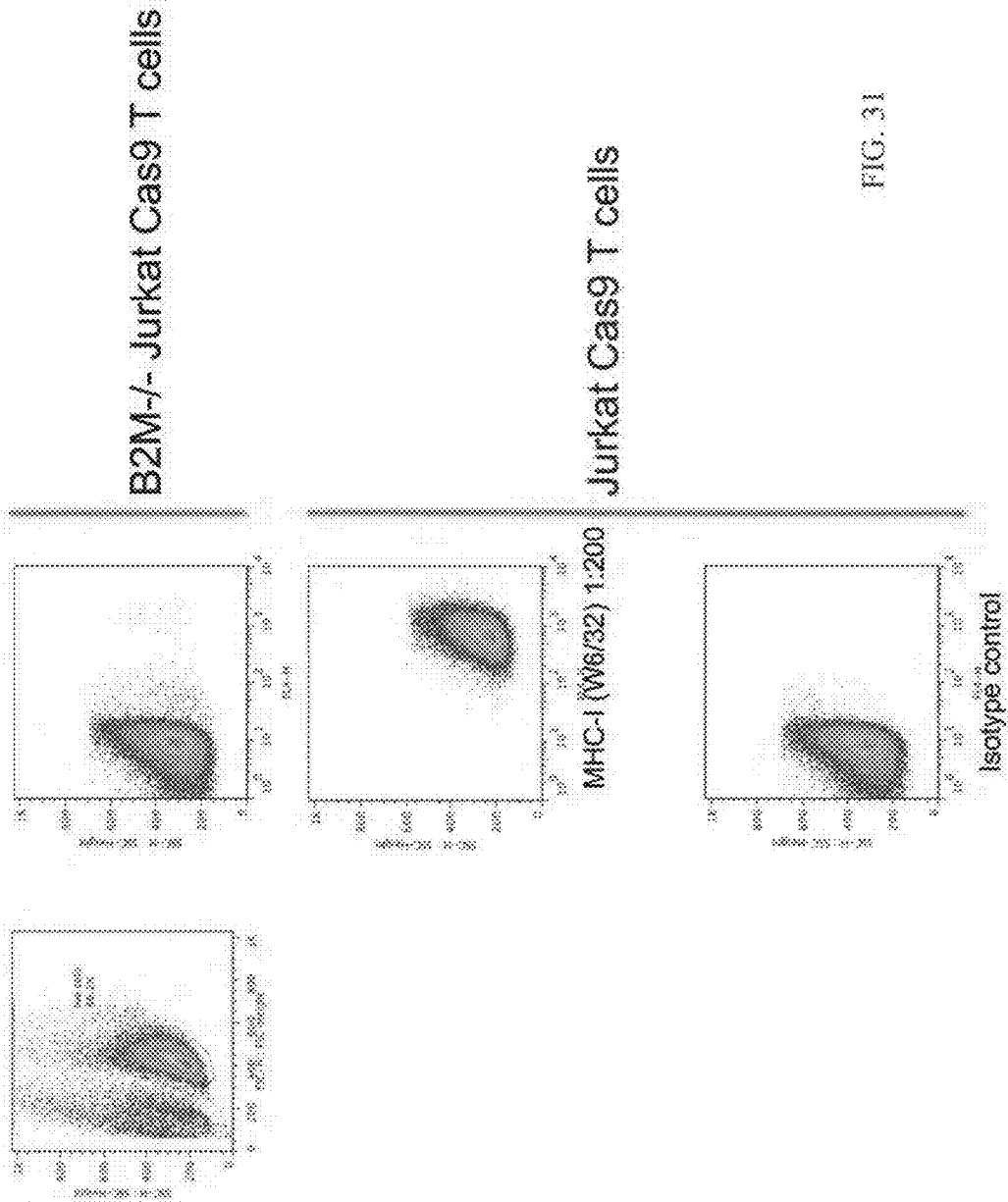
FIG. 31 shows loss of MHC class I surface expression in B2M−/− Jurkat Cas9 T cells. The B2M−/− Jurkat Cas9 T cells are compared to Jurkat Cas9 T cells that do not include a knock out of B2M.
Figures 32A, 32B, 32C, 32D, 32E, 32F, 32G, 32H:
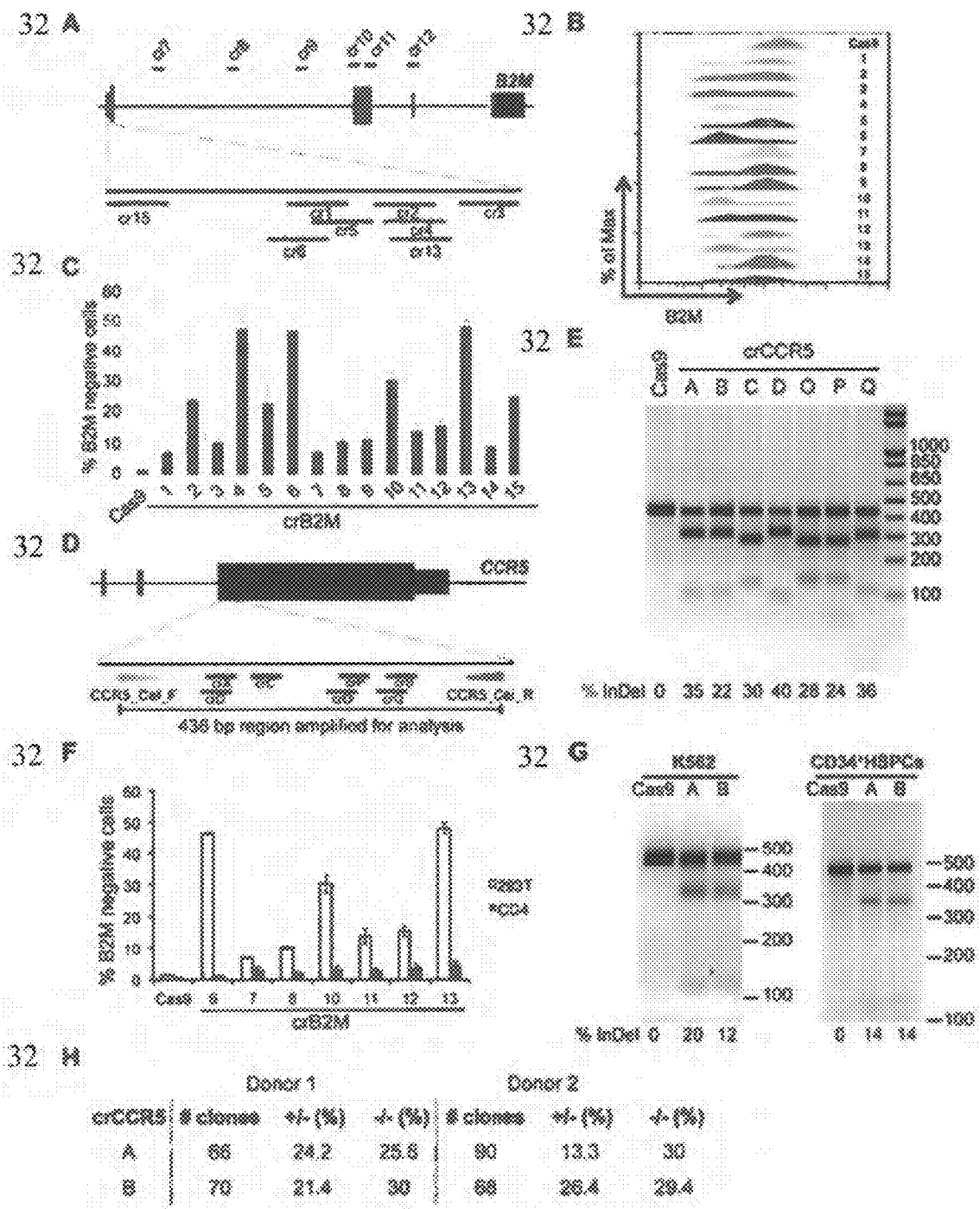
FIGS. 32A-32H demonstrate targeting clinically relevant loci in human cells using CRISPR/Cas9.
Figures 33A, 33B, 33C, 33D, 33E:
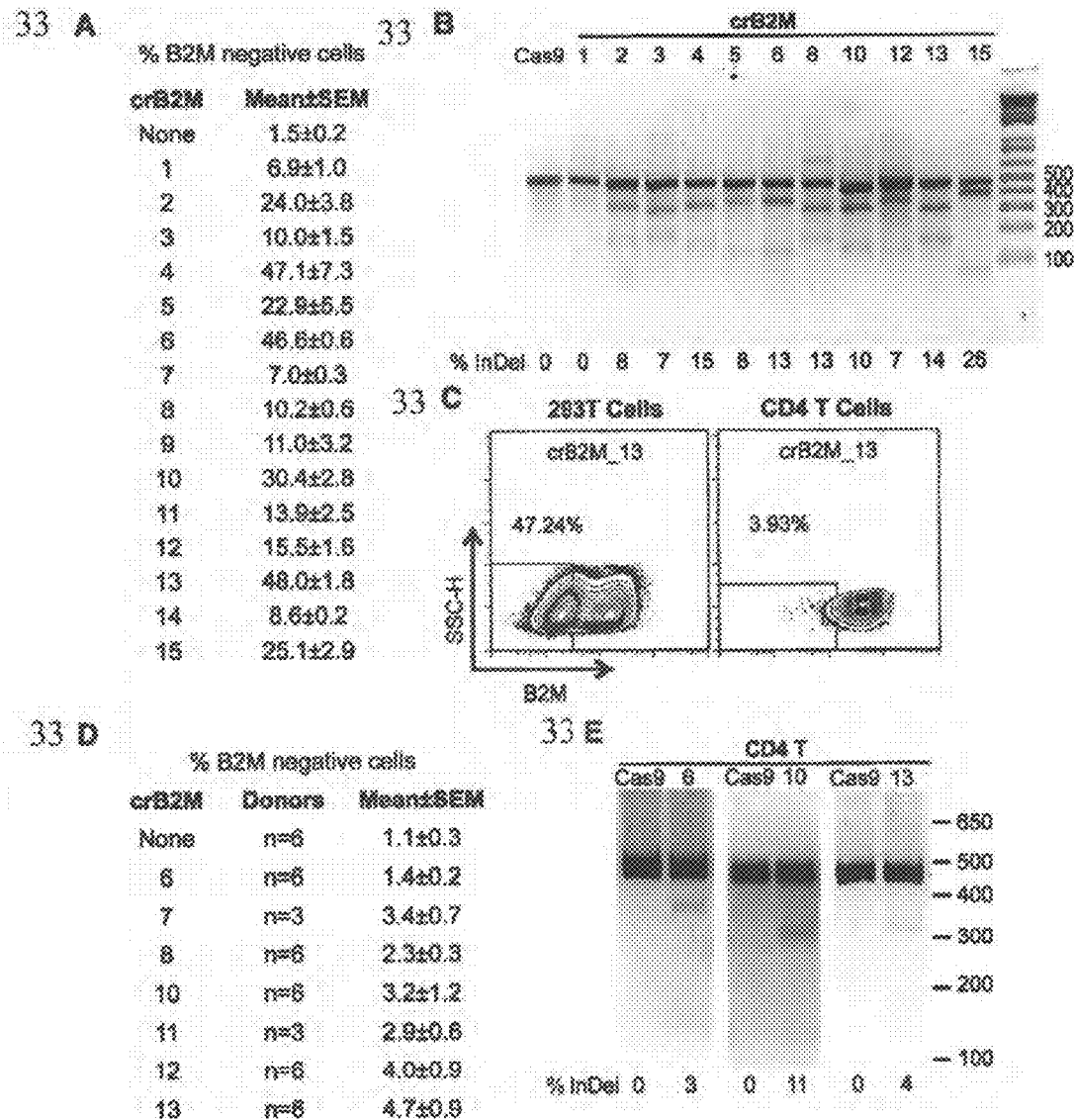
FIGS. 33A-33E demonstrate an evaluation of on target mutational efficiencies of various gRNAs targeting B2M.
Figure 36:
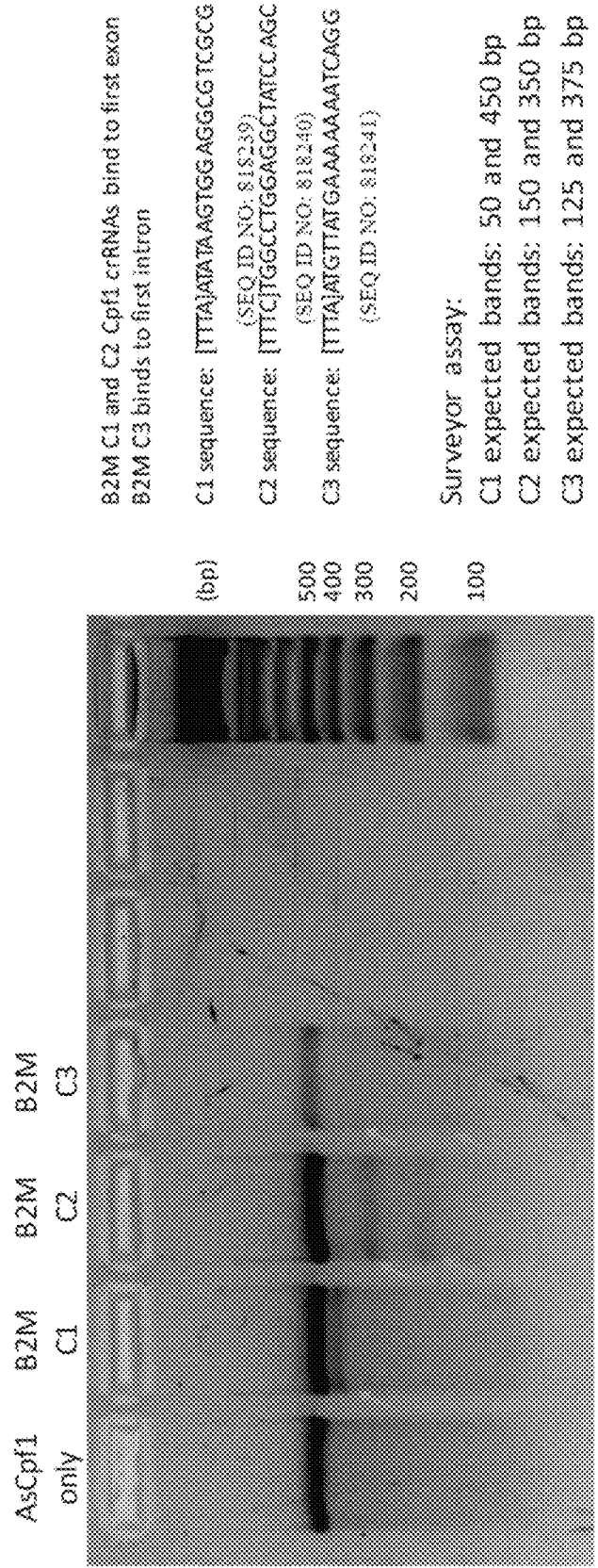
FIG. 36 demonstrates B2M deletion efficiencies of selected guides in 293T cells. Arrows on the Surveyor assays show nuclease cleavage bonds.
Figure 37:
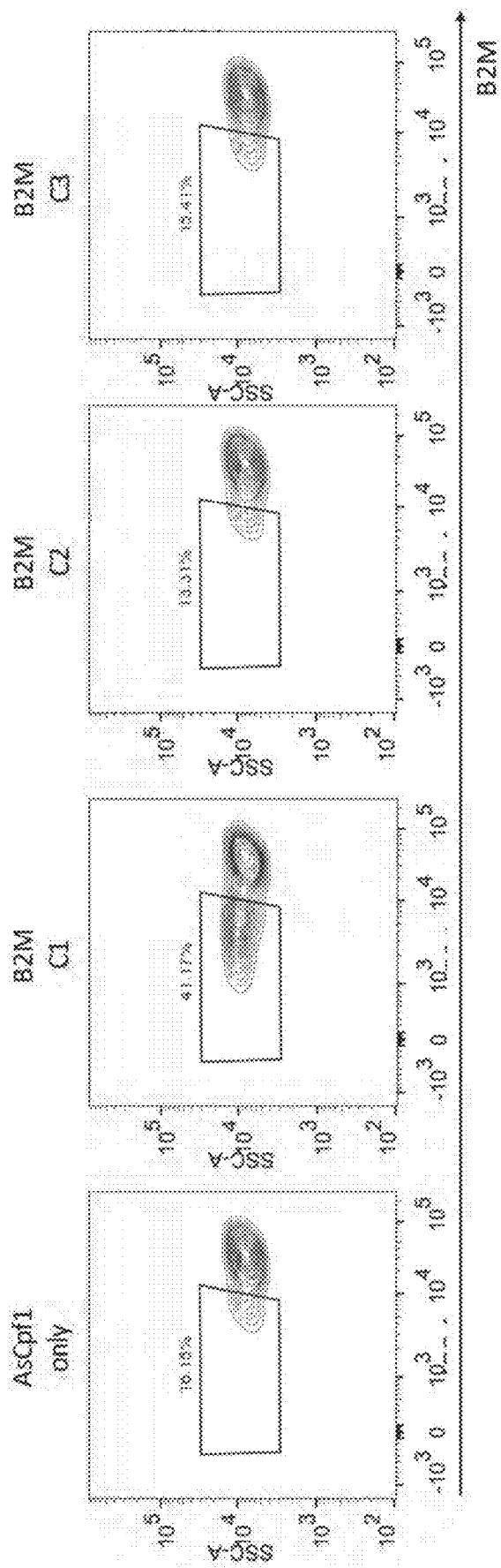
FIG. 37 demonstrates a comparison of B2M surface expression in 293T cells when transfected with AsCpf1 and guide crB2M.
Figure 38:
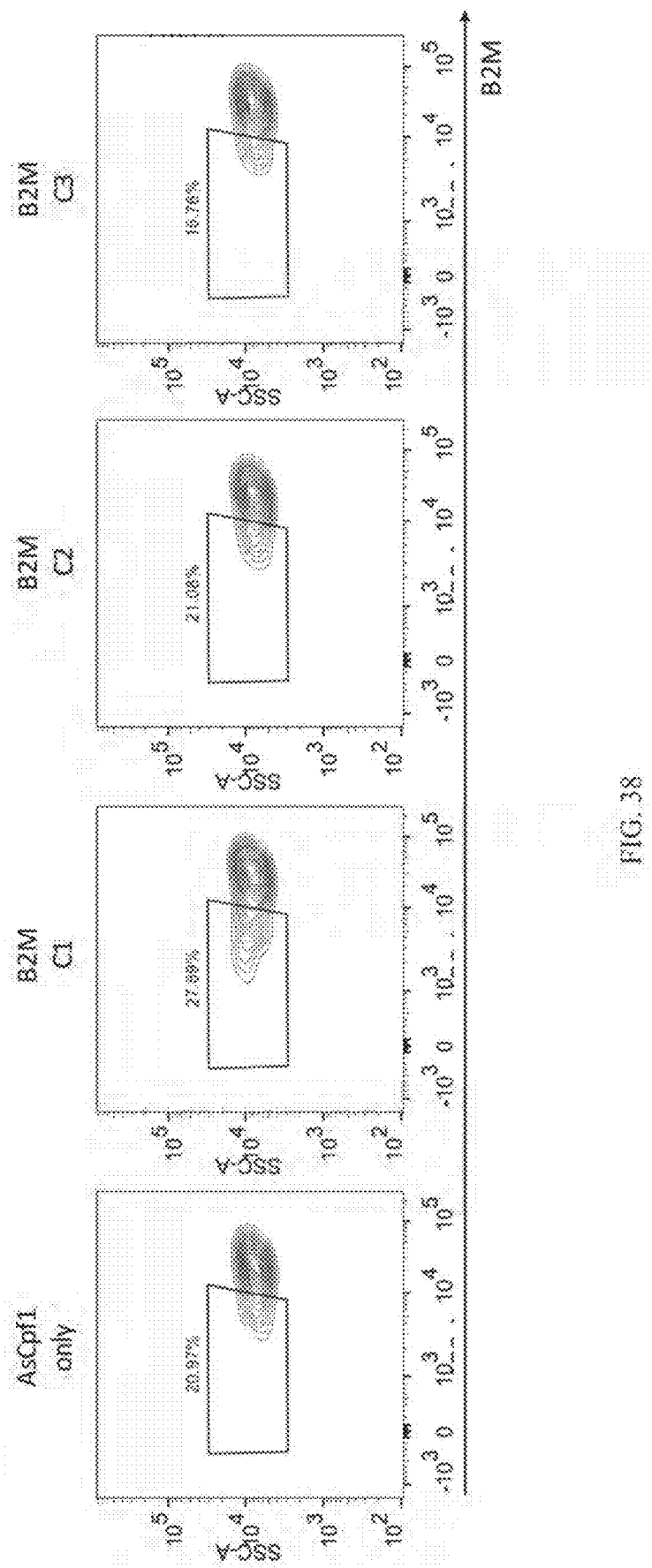
FIG. 38 demonstrates a comparison of B2M surface expression in 293T cells when transfected with LbCpf1 and guide crB2M.
Figure 40B:
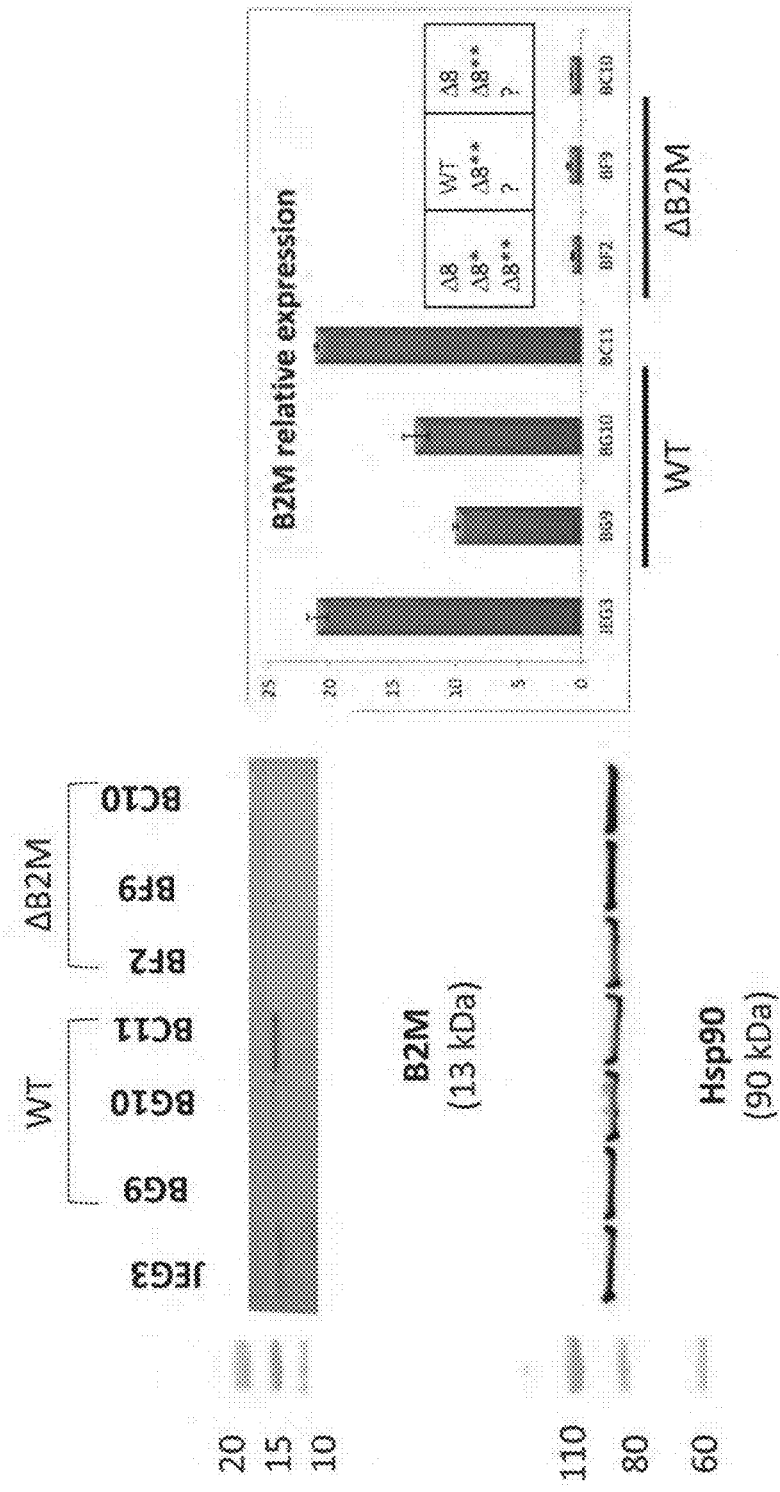
Figure 40C:
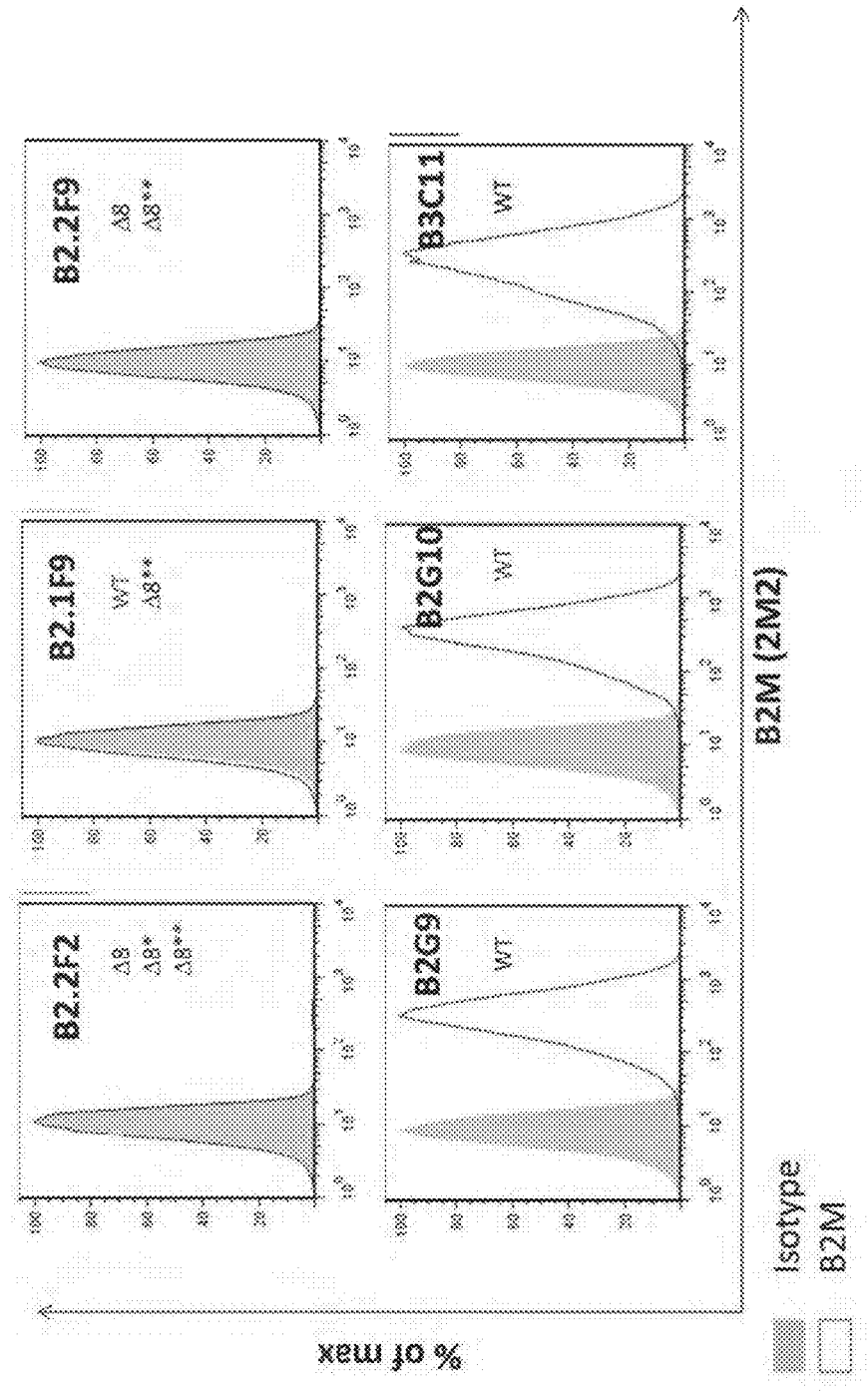
Figure 40D:
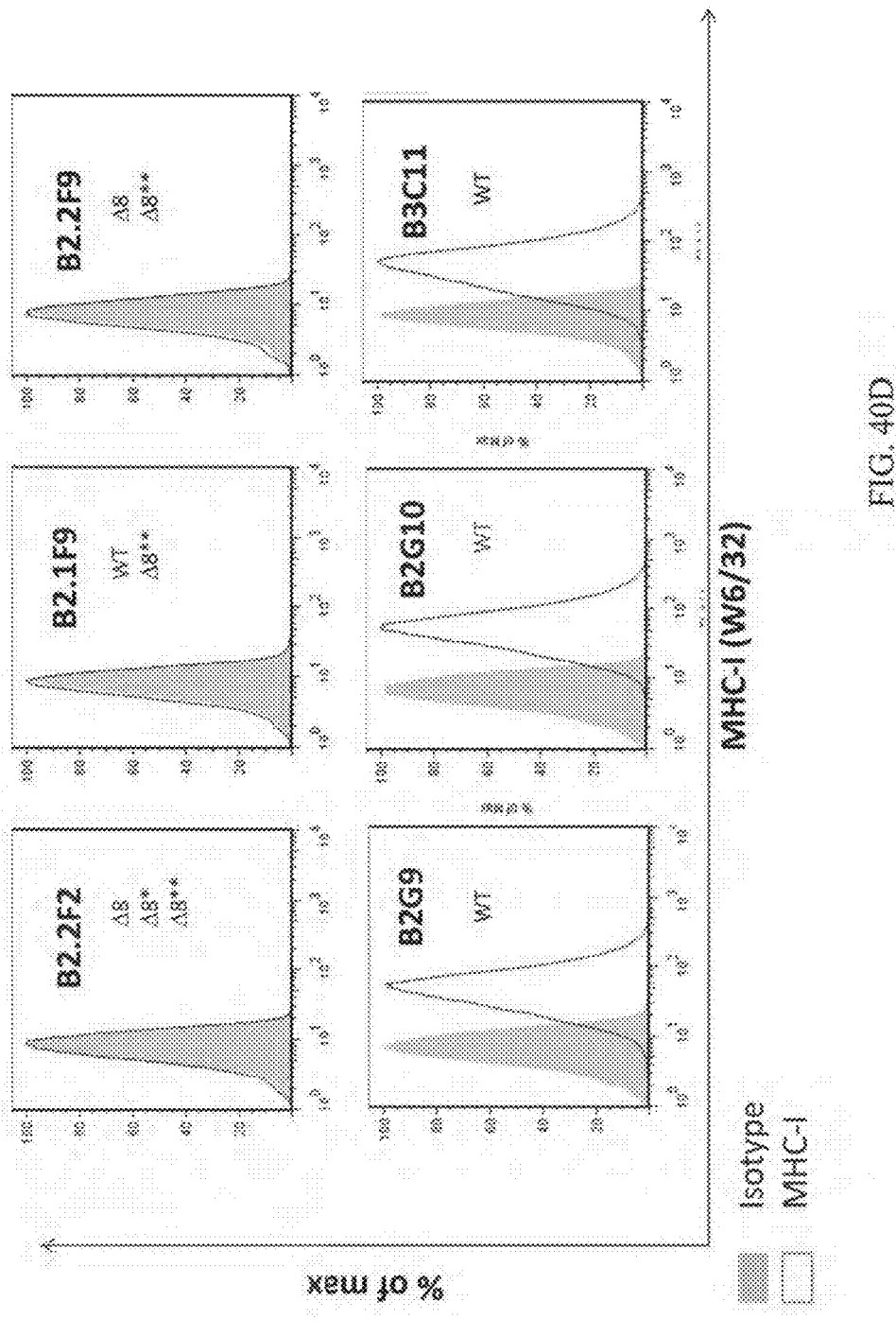
Figure 40E:
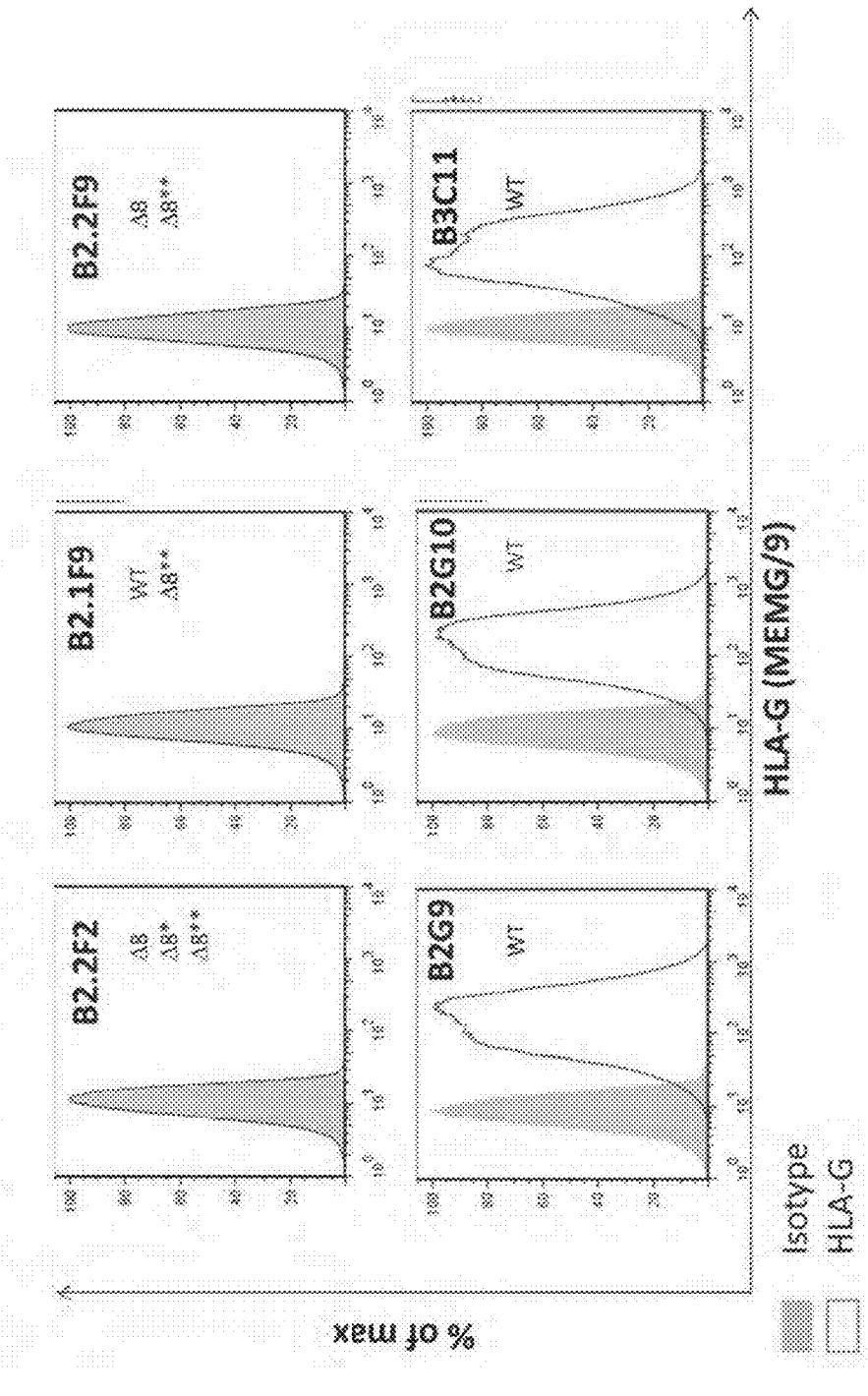
Figure 40F:
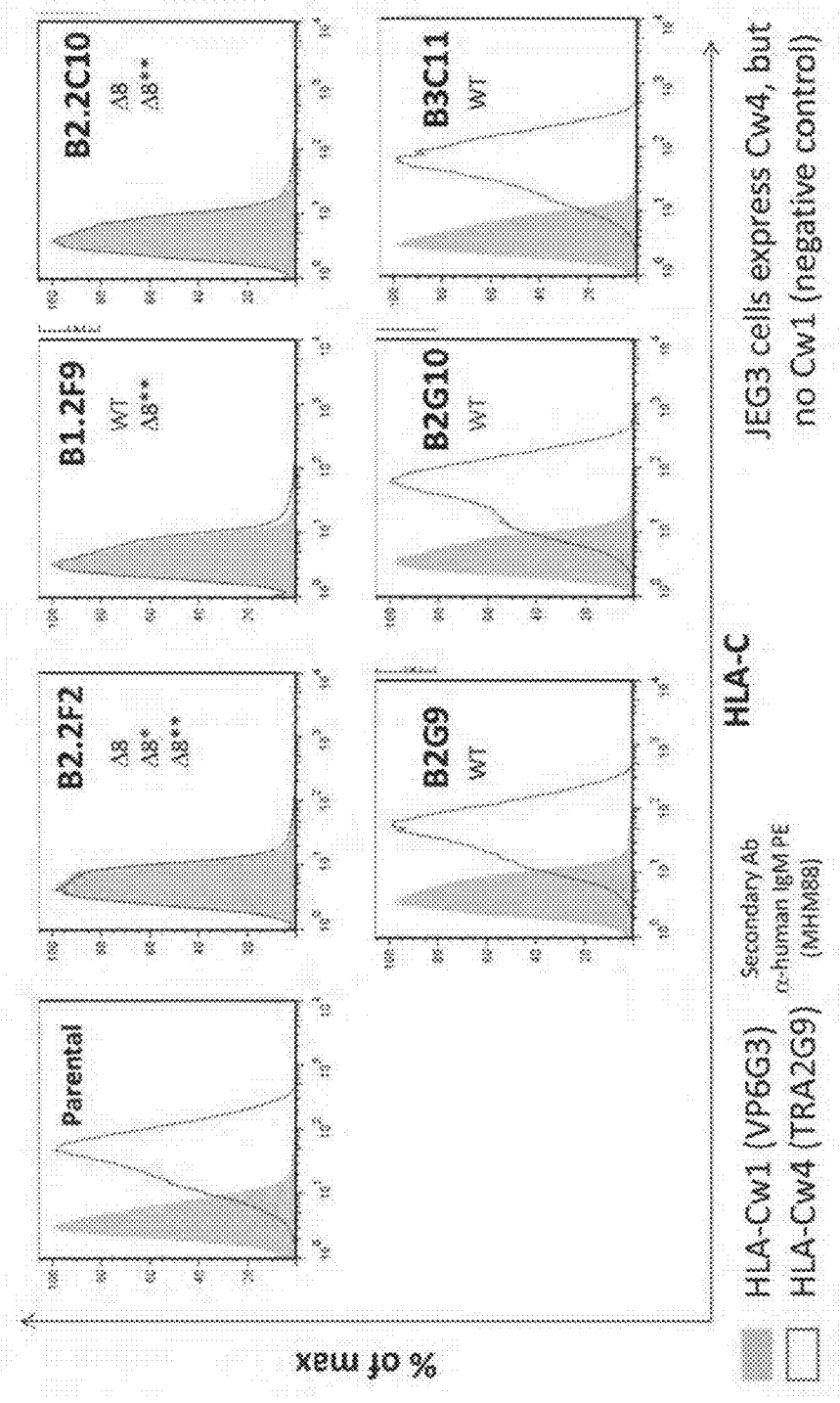
Figure 40G:
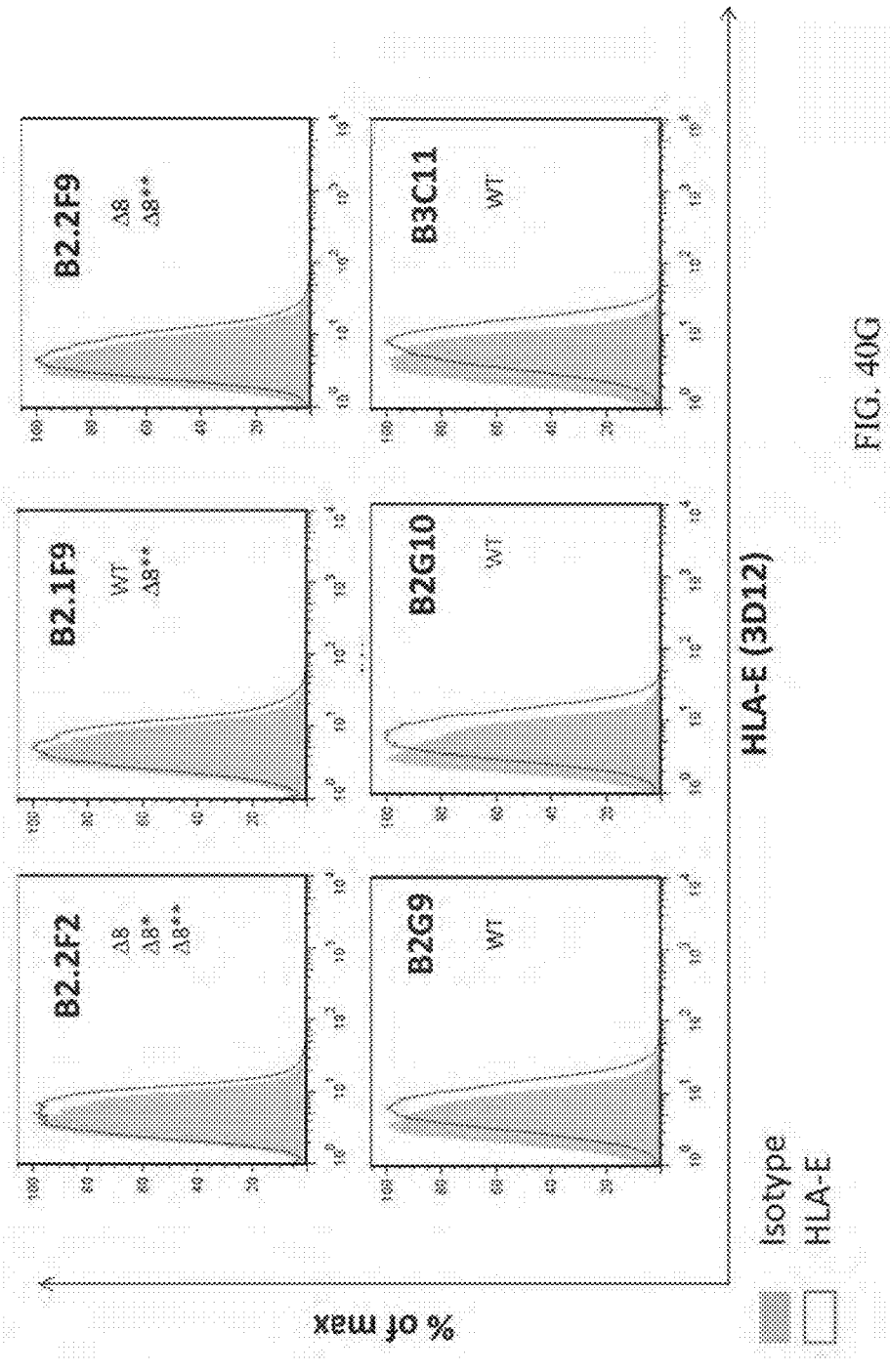
Figure 41:
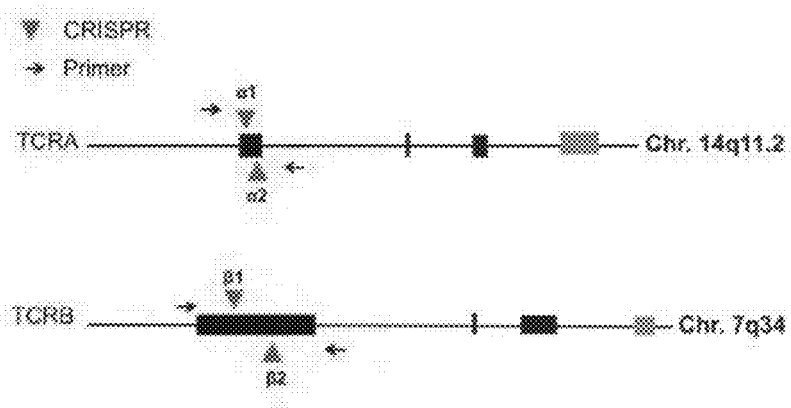
FIG. 41 demonstrates an exemplary TCR targeting strategy of the present invention.
Figures 42A, 42B:
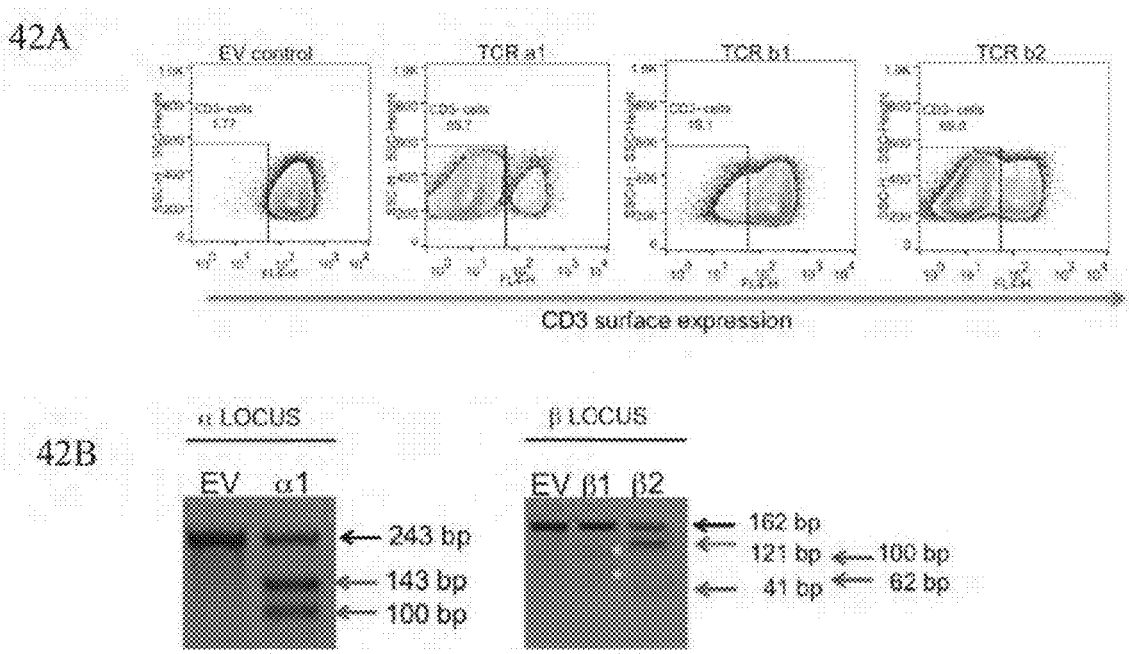
FIGS. 42A-42B demonstrate deletion of T cell receptor in Jurkat T cells.
Figures 43A, 43B:
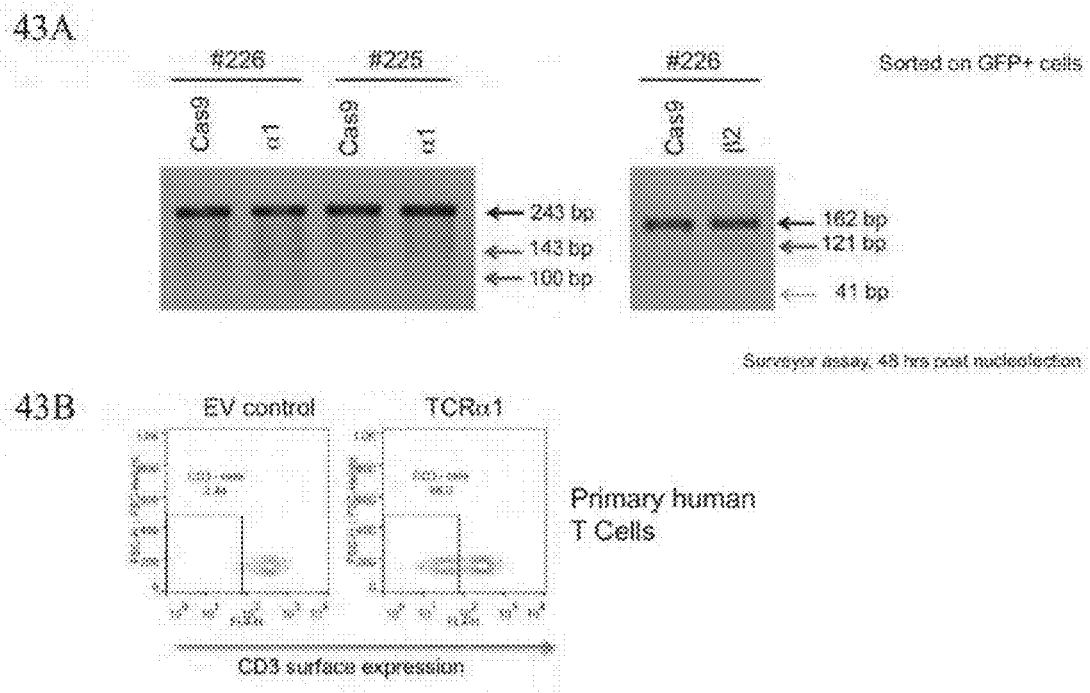
FIGS. 43A-43B demonstrate TCR Deletion in Primary Human CD3+ T Cells.
Figure 44A:
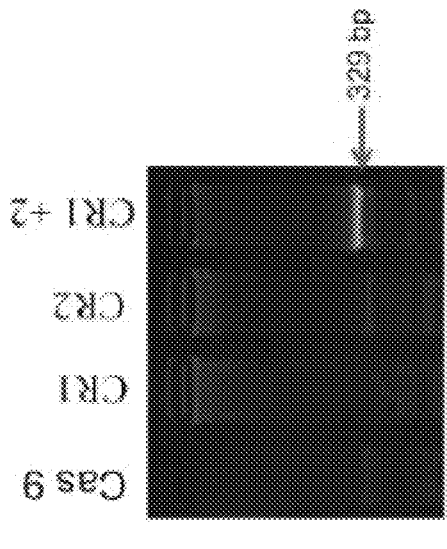
FIGS. 44A-44C demonstrate an exemplary PD-1 locus targeting strategy of the present invention.
Figure 44B:
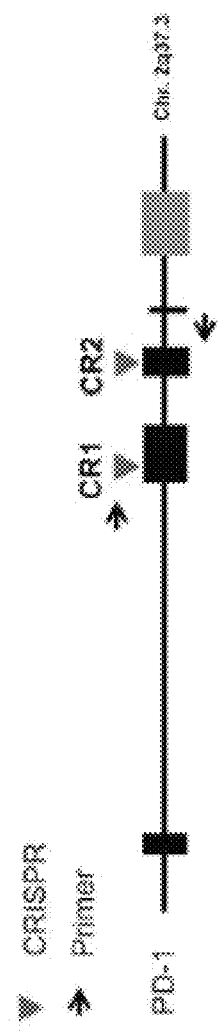
Figure 44C:
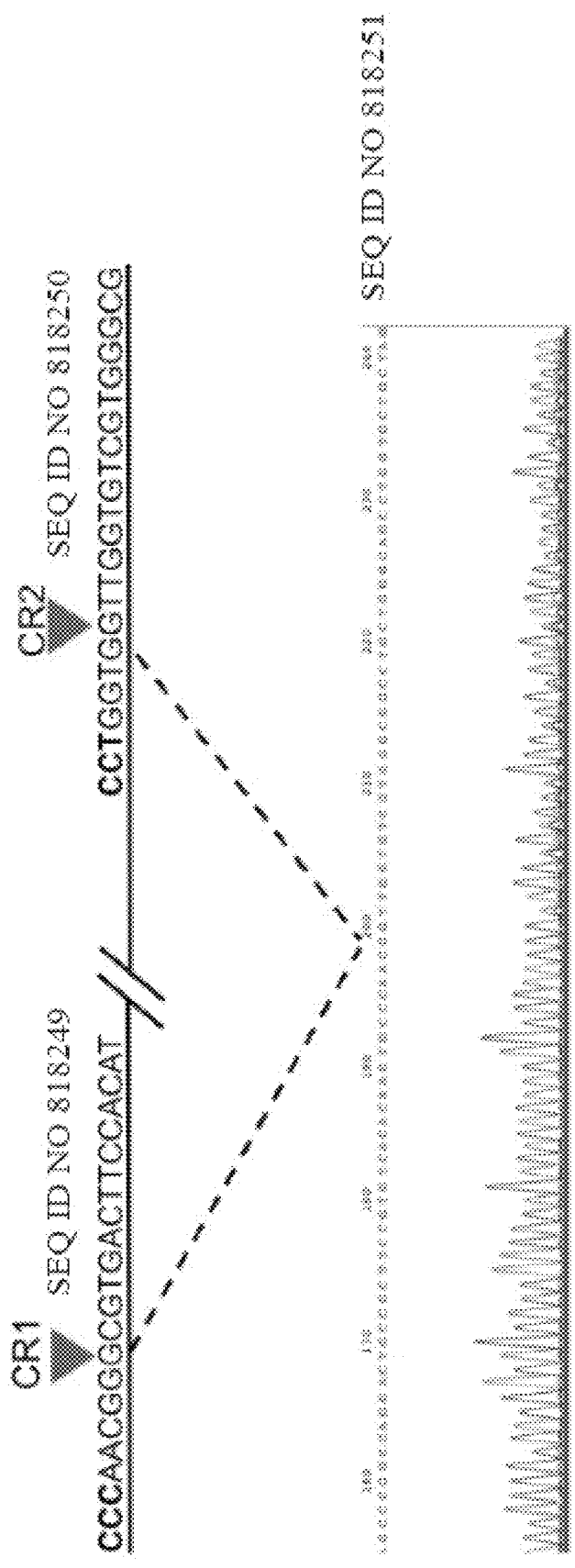
Figures 45A, 45B:
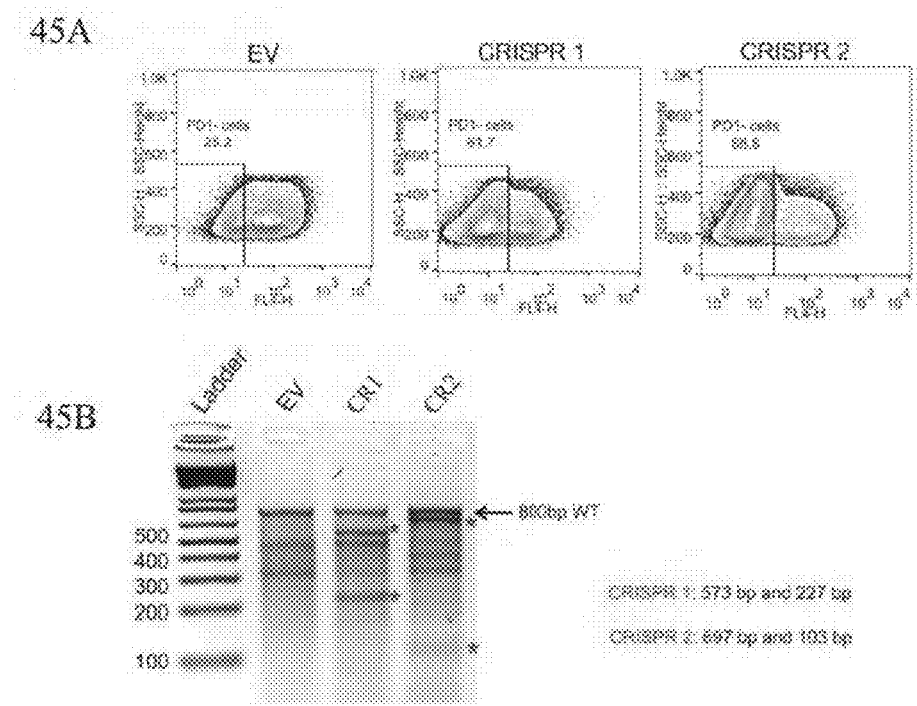
Figures 47A, 47B:
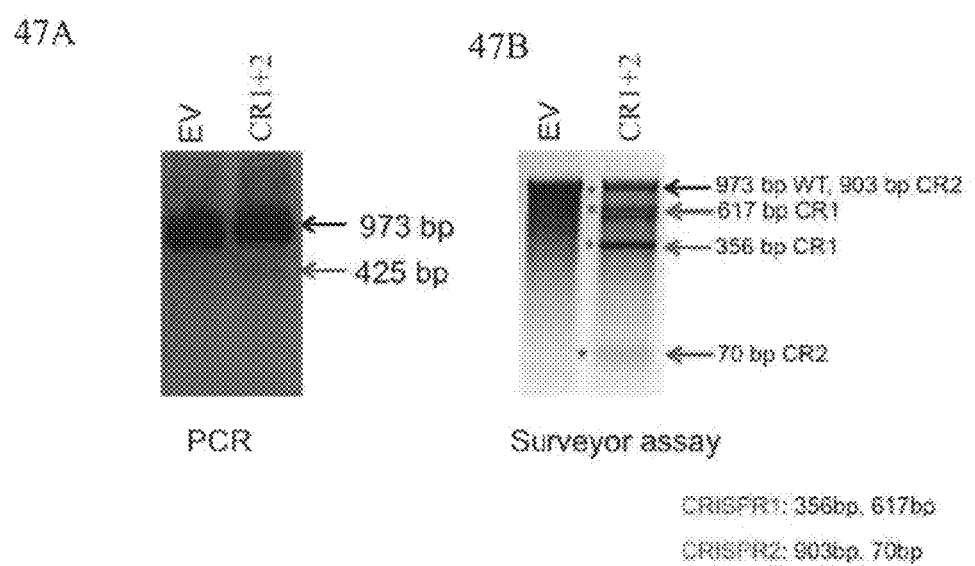
FIGS. 47A-47B demonstrate cutting at the CTLA-4 locus in Jurkat T cells.

The successful targeting of B2M utilizing TALENs and/or CRISPR has previously been described in PCT Patent Application No. PCT/US2015/059621, which is incorporated herein by reference and is shown in FIGS. 32-40. It has further been demonstrated that surface expression of MHC class I molecules is reduced or eliminated, thereby blocking the surface trafficking of MHC-I molecules. For example, loss of MHC class I surface expression in B2M−/− Jurkat Cas9 T cells was shown in comparison to MHC class I surface expression in Jurkat Cas9 T cells in FIG. 31.

Figure 20A:
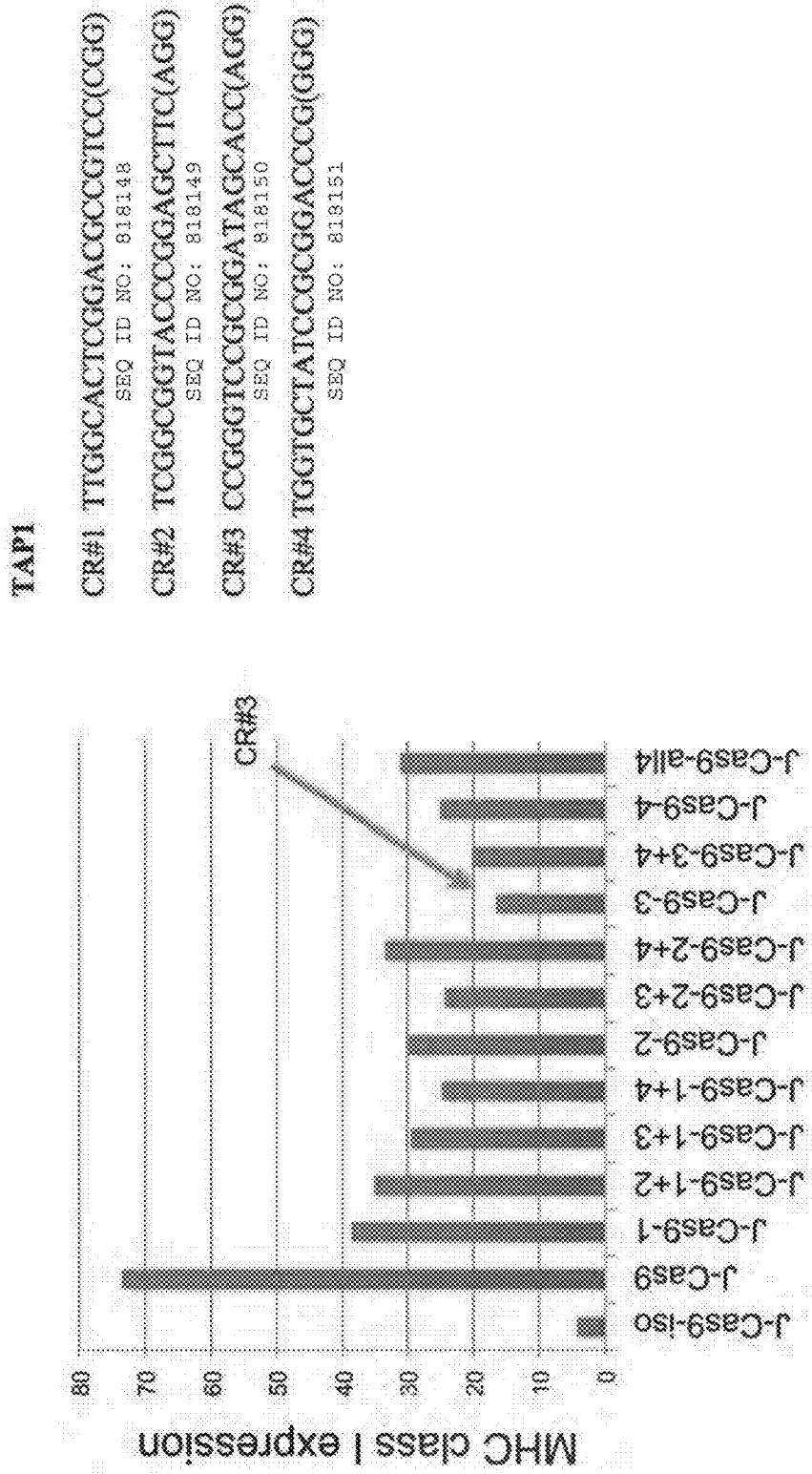
FIGS. 20A-20D show that surface trafficking of MHC class I molecules can be suppressed by disrupting the TAP1 gene, an ER-resident peptide transporter.
Figure 20B:
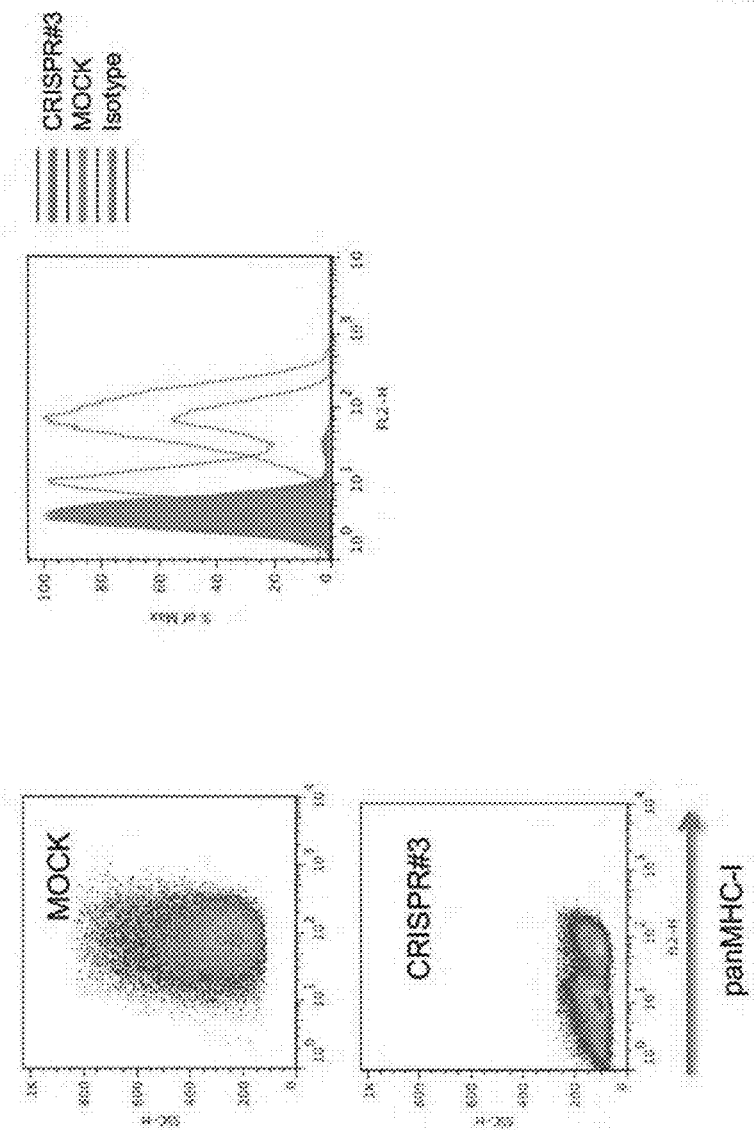
Figure 20C:
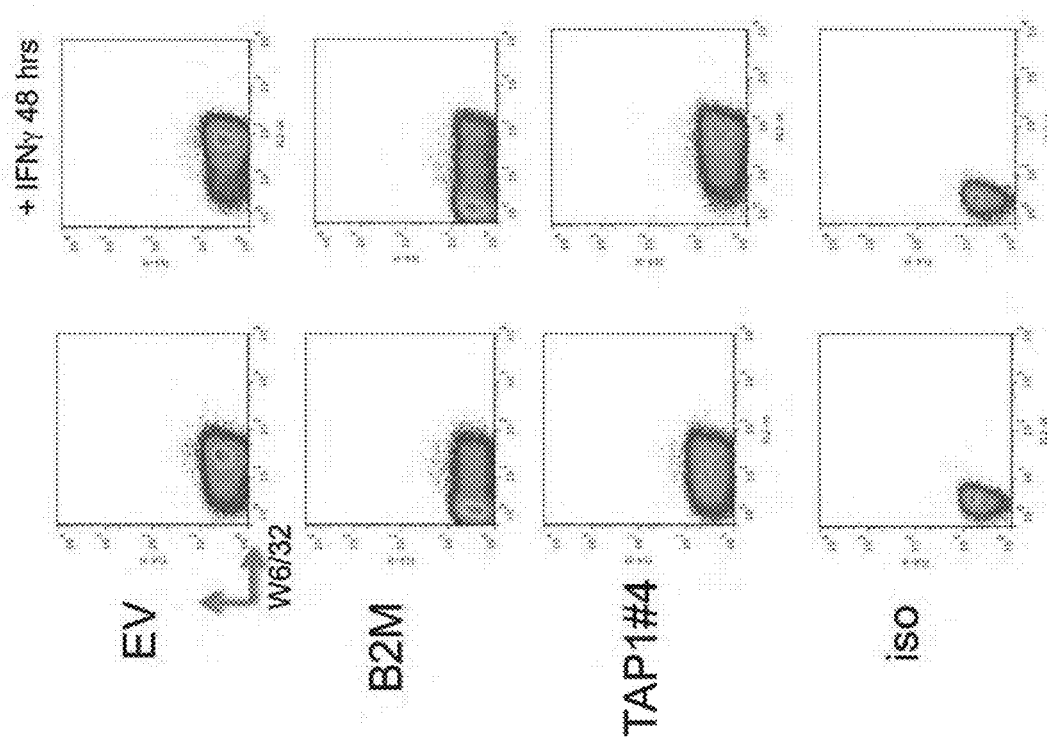
Figure 20D:
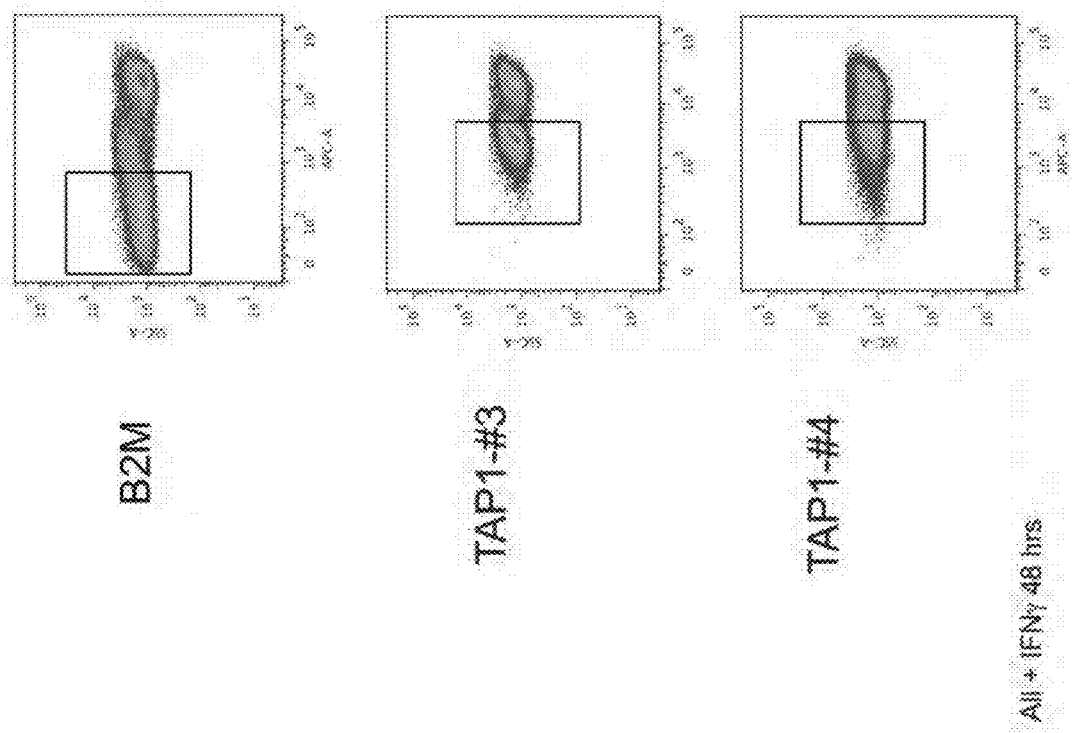

In addition, the inventors have demonstrated that surface trafficking of MHC class I molecules can be suppressed but disrupting the TAP1 gene, an ER-resident peptide transporter. For example, TAP1 CRISPR expression reduces MHC-I surface expression in Jurkat cells (FIG. 20A), as well as in Jurkat T cells (FIG. 20B), following 48 hour treatment with IFNγ. It was further demonstrated that HLA surface expression in Jurkat (Cas9) T cells could be eliminated (FIG. 20C and FIG. 20D). The Jurkat T cells were established from the peripheral blood of a 14 year old boy who had acute T cell leukemia.

HLA Razor

Figure 21C:
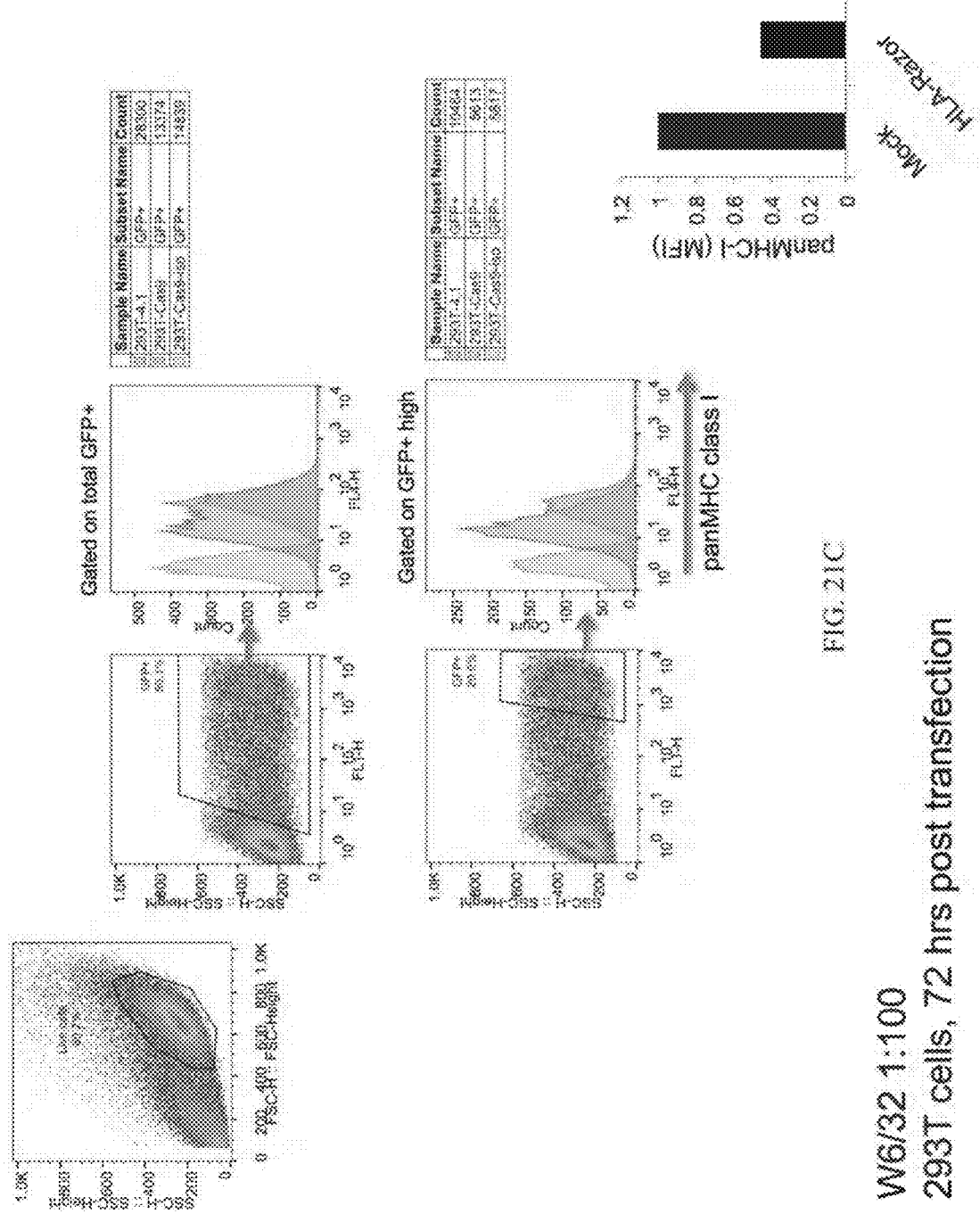
Figure 21D:
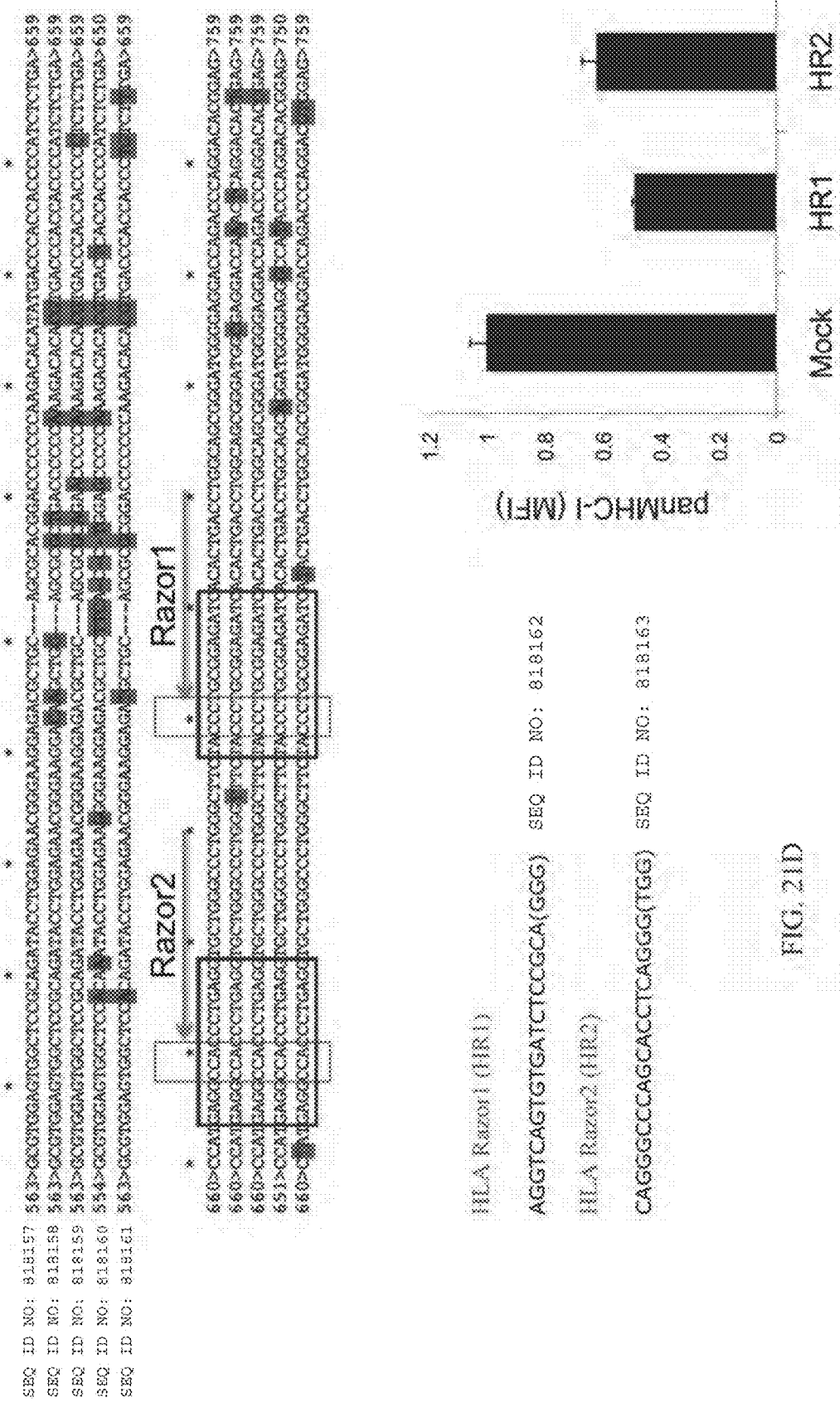

The inventors examined CRISPR guide RNAs that allow simultaneous deletion of all MHC class I alleles by targeting a conserved region in the HLA genes. A TALEN pair of guides that target the same conserved region in MHC class I genes were also identified. Any guide that targets the conserved regions may be identified or classified as an HLA Razor. The targeting of a conserved sequence found in all HLAs by CRISPR or TALENS was demonstrated in FIG. 21A. The two violet boxes indicate the binding sites for the pan-HLA TALEN pair. The blue arrow indicates the pan-HLA CRISPR tested pair, with the PAM being boxed in blue. The expression of pan-HLA-TALENs in 293T and HuES9 cells was shown in FIG. 21B at 72 hours post transfection. The HLA-Razor CRISPR blunts MHC class I expression in 293T cells as demonstrated in FIG. 21C. The 293T cells were also co-transfected with Cas9-GFP. FIG. 21D provides a comparison of the activity of two different HLA Razors targeting two different conserved regions of the HLAs.

Knock-in of PD-L1 and HLA-G

The present inventors have used a CRISPR/Cas system to facilitate the insertion of tolerogenic factors, such as the tolerogenic factors shown in Table 2, into an AAVS1 locus, to actively inhibit immune rejection. As evidenced in FIGS. 11A-11C, tolerogenic factors, such as PD-L1 and HLA-G, have been successfully expressed from the AAVS1 locus.

Figure 22A:
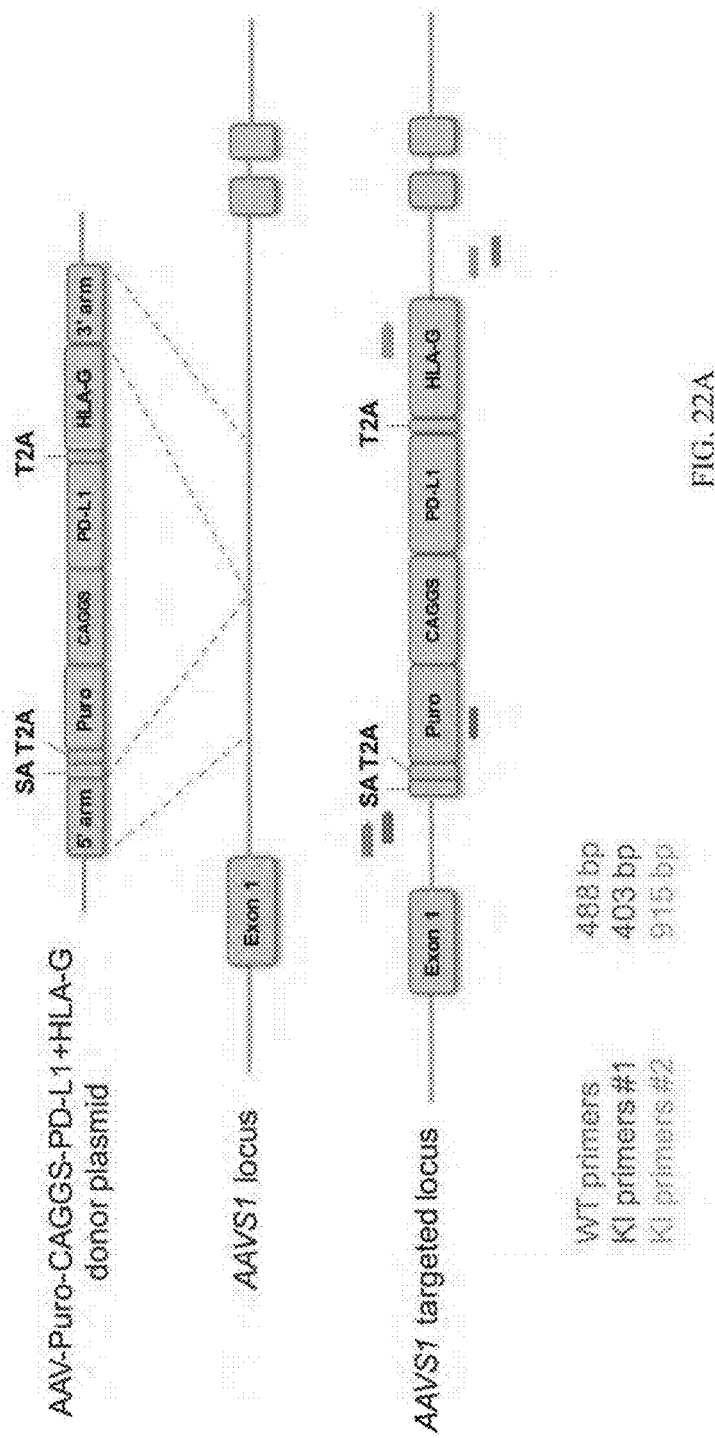
FIGS. 22A-22F show the results of a PD-L1 and HLA-G knock-in strategy.
Figure 22B:
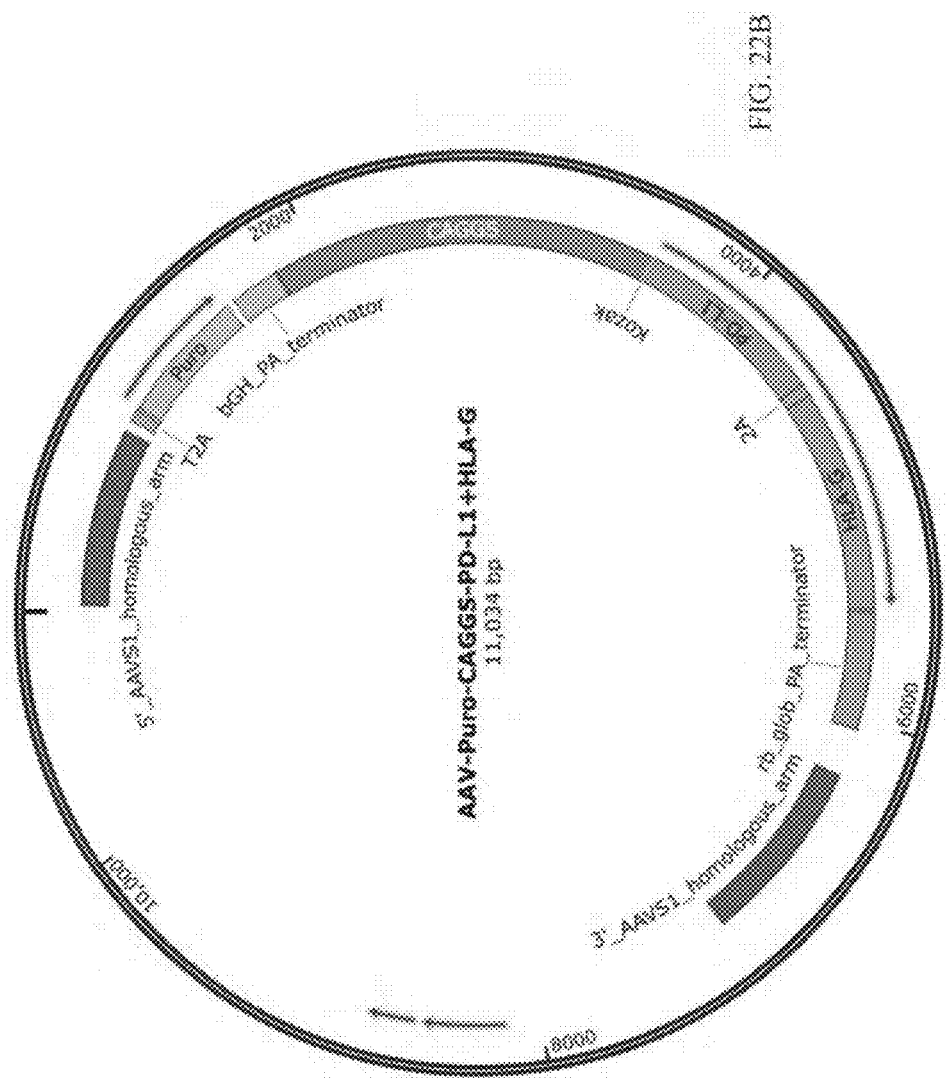

A schematic of the PD-L1 and HLA-G knock-in strategy is shown in FIG. 22A. Wild type (WT) and knock-in (KI) primers for clone screening were designed. The amplicon with WT primers is predicted as 488 bp, and the amplicons with KI primers are predicted as 403 bp and 915 bp. A design of a knock-in donor plasmid (FIG. 22B) shows that the reading frames of PD-L1 and HLA-G are linked by T2A and their expression is driven by a CAGGS promoter. Puromycin was used as a drug resistance marker following the SA-2A gene trap element.

Figure 22C:
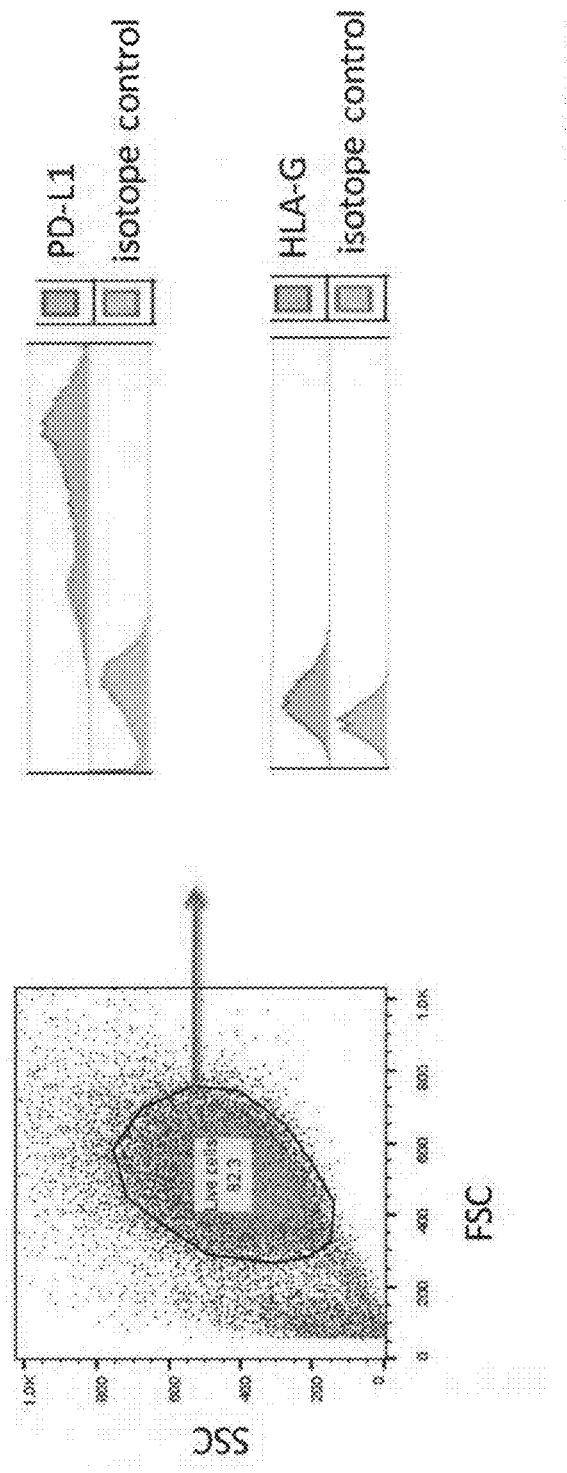
Figure 22D:
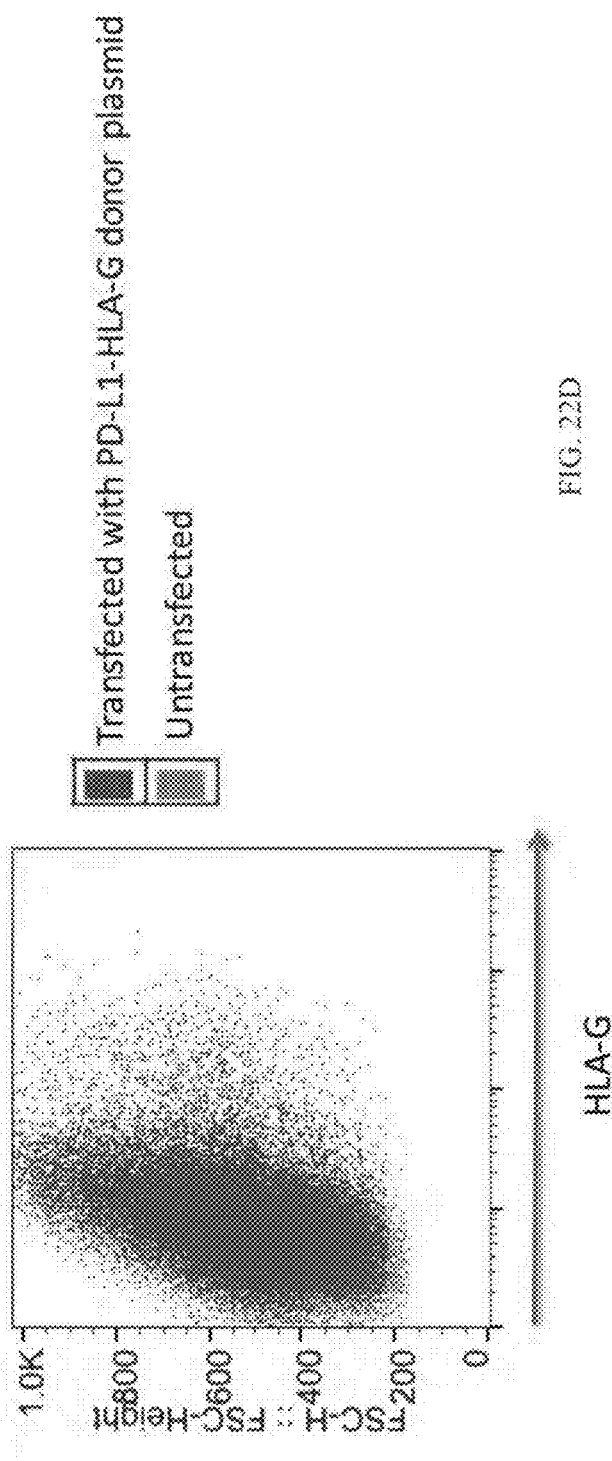
Figure 22P:
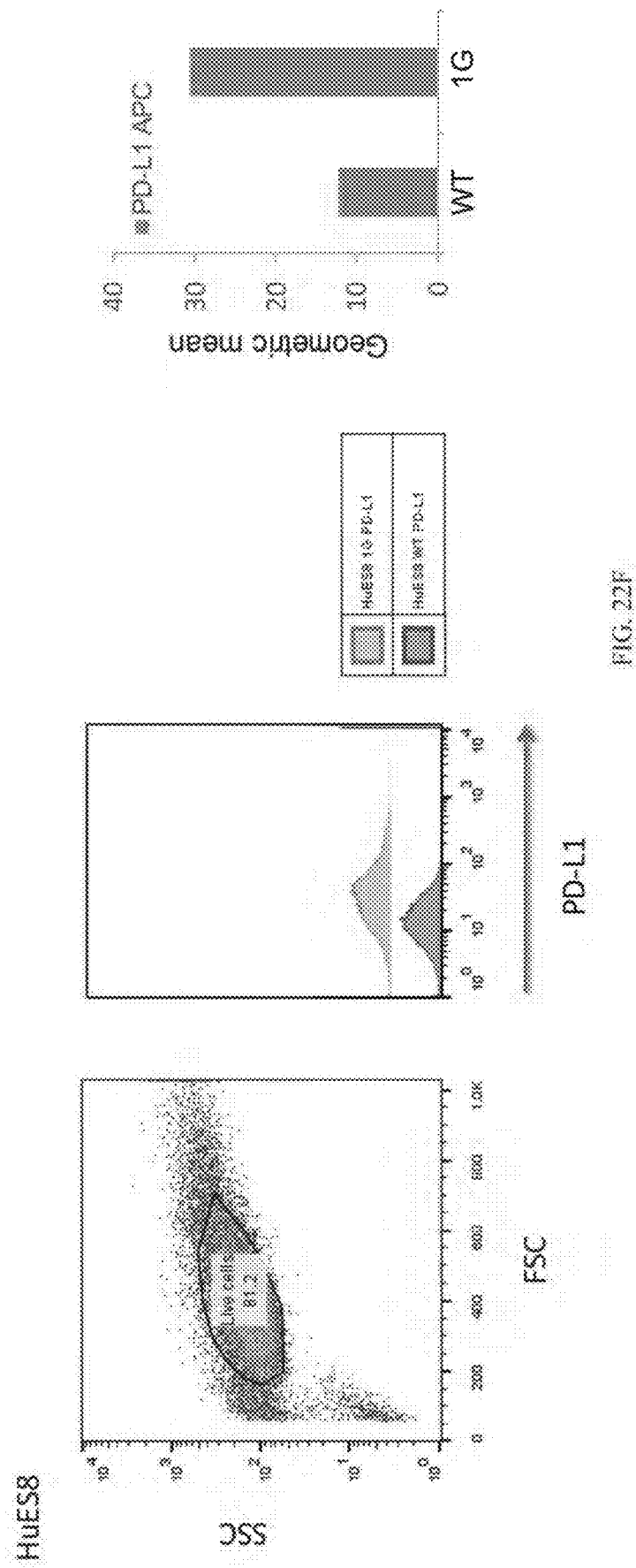

The expression of PD-L1 and HLA-G was examined in the donor plasmid-transfected 293T cells by FACS analysis. FIG. 22C shows the ectopic PD-L1 and HLA-G expression in 293T cells. APC-conjugated PD-L1 antibody and FITC-conjugated HLA-G antibody were used. In addition, the expression of ectopic HLA-G expression in JEG-3 cells is shown in FIG. 22D. The donor plasmid was transfected into an HLA-G−/− JEG-3 cell line, and ectopic HLA-G expression was examined by FACS analysis 48 hours post-transfection. A PE-conjugated HLA-G antibody (MEM/G9) was used to detect surface HLA-G surface expression.

PCR screening was performed, which confirmed that clone 1G was a heterozygous KI clone for PD-L1/HLA-G (FIG. 22E). Clone 1G was identified as a heterozygous KI clone by the presence of bands using both WT primers and KI-specific primers amplified from genomic DNA of targeted HuES8. The expression of PD-L1 was verified in HuES8 KI clone 1G by FACS analysis using an APC-conjugated PD-L1 antibody (FIG. 22F).

Knock-In of CD-47

Figure 23:
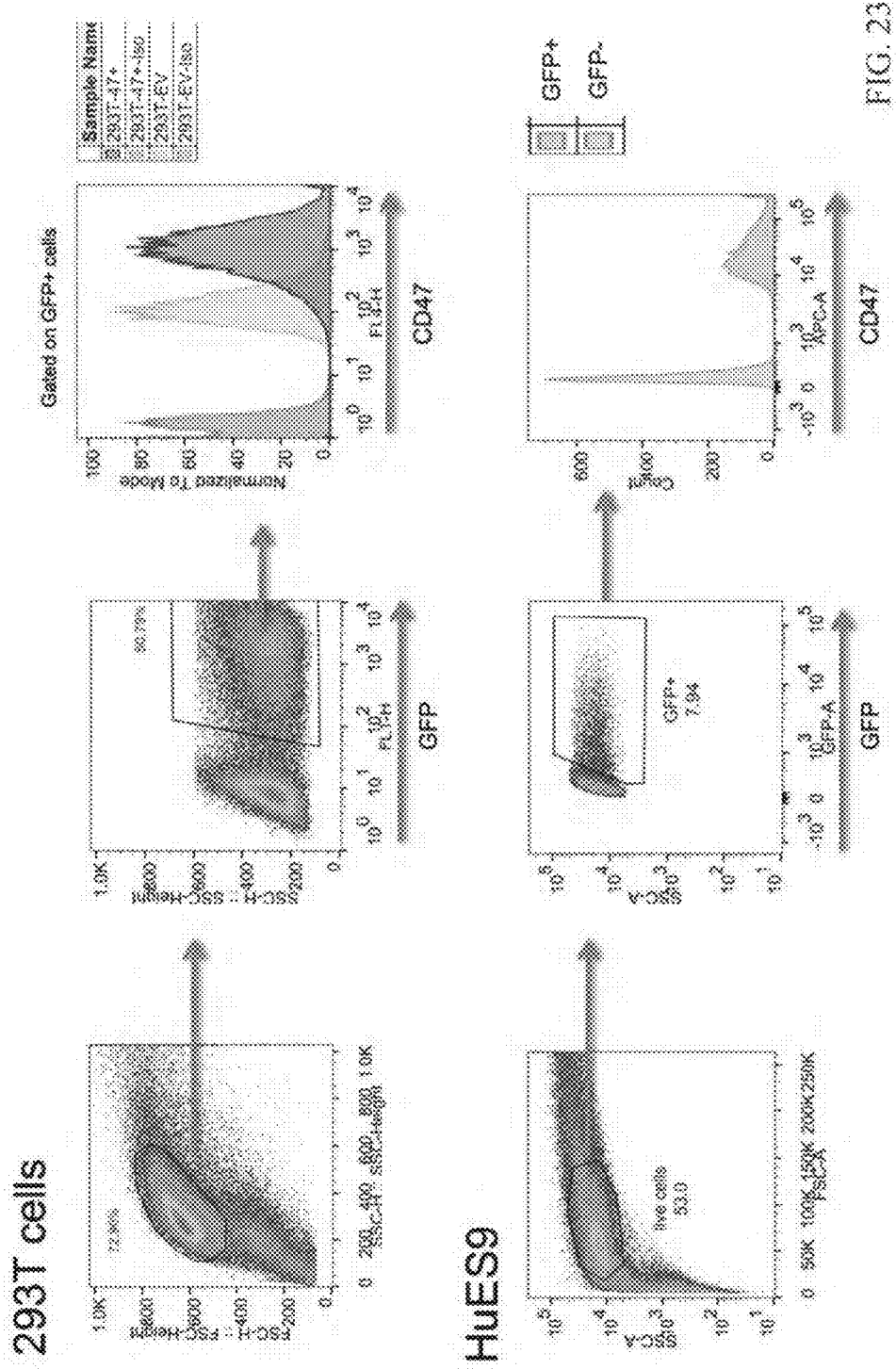
FIG. 23 demonstrates expression of CD47 in 293T cells and hPSCs using a knock-in strategy. Human CD47 was cloned into an expression plasmid driven by a CAG promoter, which in addition contains an IRES-GFP. 293T cells already express high levels of CD47, the human 'don't eat me' signal, which prevents engulfment of cells from macrophages. Expression can be increased by overexpression of CD47 in both 293T cells, as well as in human pluripotent stem cells (HuES9), as detected by FACS using a CD47-specific antibody. Overexpression of CD47 will assist engraftment of stem cell-derived transplants by protecting cells from macrophage engulfment.

In addition, a CD47 knock-in strategy was also examined. Human CD47 was cloned into an expression plasmid driven by a CAG promoter, which also contained an IRES-GFP. 293T cells already express high levels of CD47 (the human "don't eat me" signal), which prevents engulfment of cells from macrophages. Expression can be increased by overexpression of CD47 in both 293T cells, as well as in human pluripotent stem cells (HuES9), as detected by FACS using a CD47-specific antibody (FIG. 23). It is expected that overexpression of CD47 will assist engraftment of stem cell-derived transplants by protecting cells from macrophage engulfment.

Additional Targets to be Modified in Universal Donor Cells

Additional targets may be modified in universal donor cells to tailor them to a specific application. For example, additional targets may be modified in universal donor cells to tailor them to be used as universal CAR T cells. In one instance, the inventors deleted TRAC and TRBC in HuES9 to disrupt TCR expression (FIG. 24). A dual guide RNA approach was used to introduce deletions into the TRAC and TRBC loci in HuES9 cells. The TCRA wild type band is 249 bp and after deletion is 209 bp. The TCRB wild type band is 162 bp and after deletion is 140 bp. The inventors additionally targeted TCRA in HuES9 B2M−/−CIITA−/− to create a triple knock-out stem cell line for B2M−/−, CIITA−/− and TCR−/−, which upon differentiation into T cells will be devoid of MHC-I and -II and exhibit no TCR surface expression.

Figure 25B:
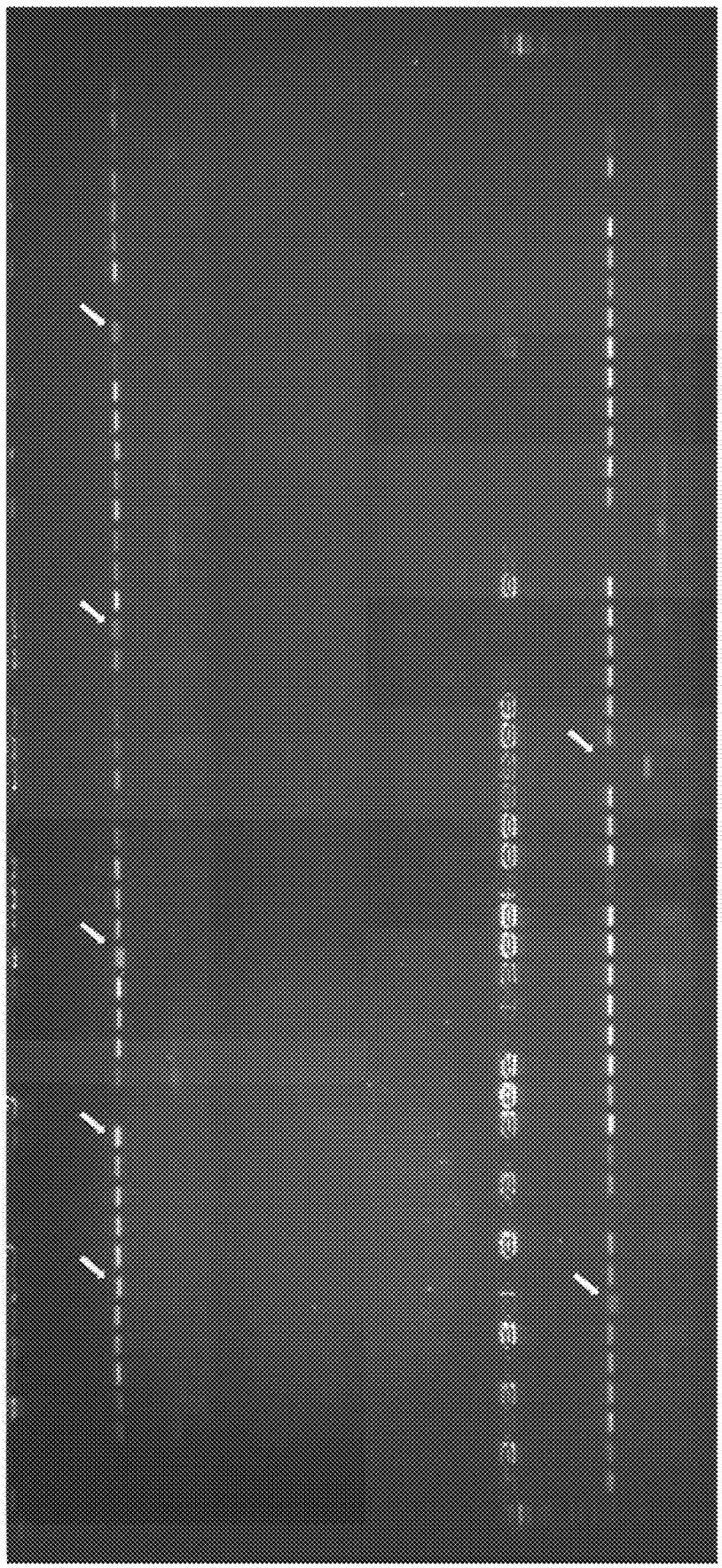
Figure 25D:
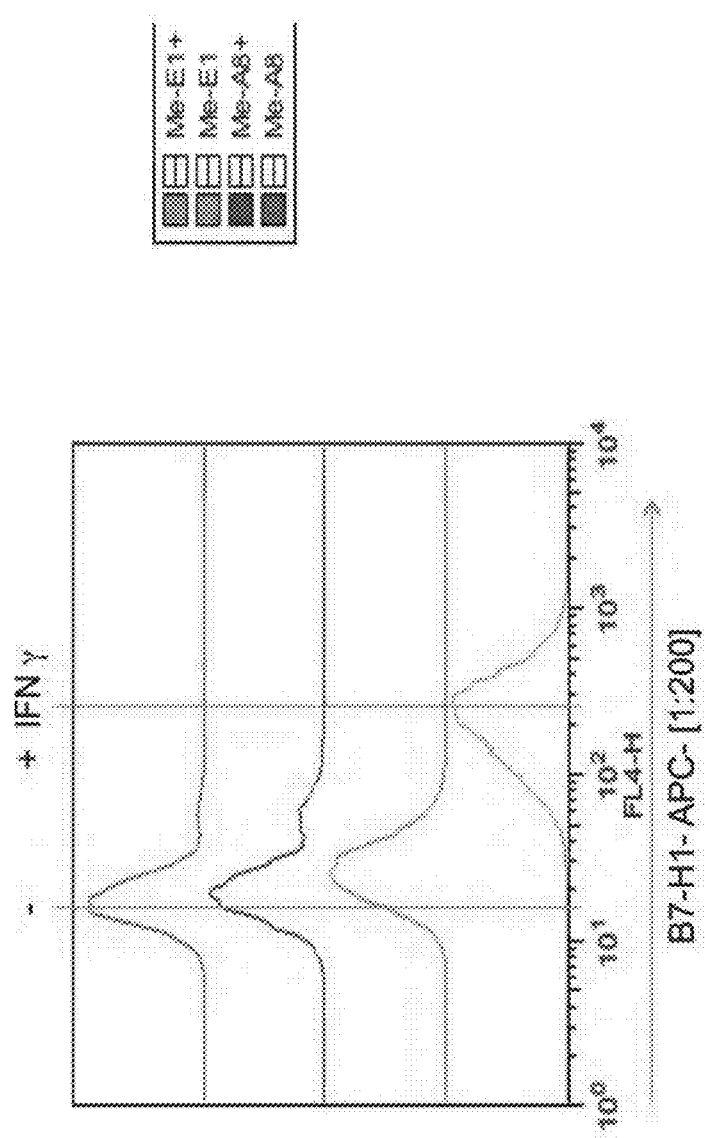

In another instance, the inventors targeted PD-L1 (FIG. 25A). It was identified that CRISPRs targeting Cd274/B7-H1/PD-L1 were very useful in breaking tolerance in cancer immunotherapy. PD-L1 knock out was demonstrated in multiple cell types, including JEG-3, a choriocarcinoma cell line, and in two melanoma cell lines, 501 and MalMe (FIGS. 25B-25D). Screening of targeted B7-H1 colonies was conducted, and it was identified that there was an 8.3% CRISPR cutting efficiency in JEG-3 cells (FIG. 25B). Additionally, reconfirmation of 501 melanoma knock out clones was shown in FIG. 25C, and reconfirmation of MalMe melanoma knock out clones was shown in FIG. 25D.

Targeting Co-Inhibitor/Co-Stimulatory Receptors or Their Ligands

Figure 26A:
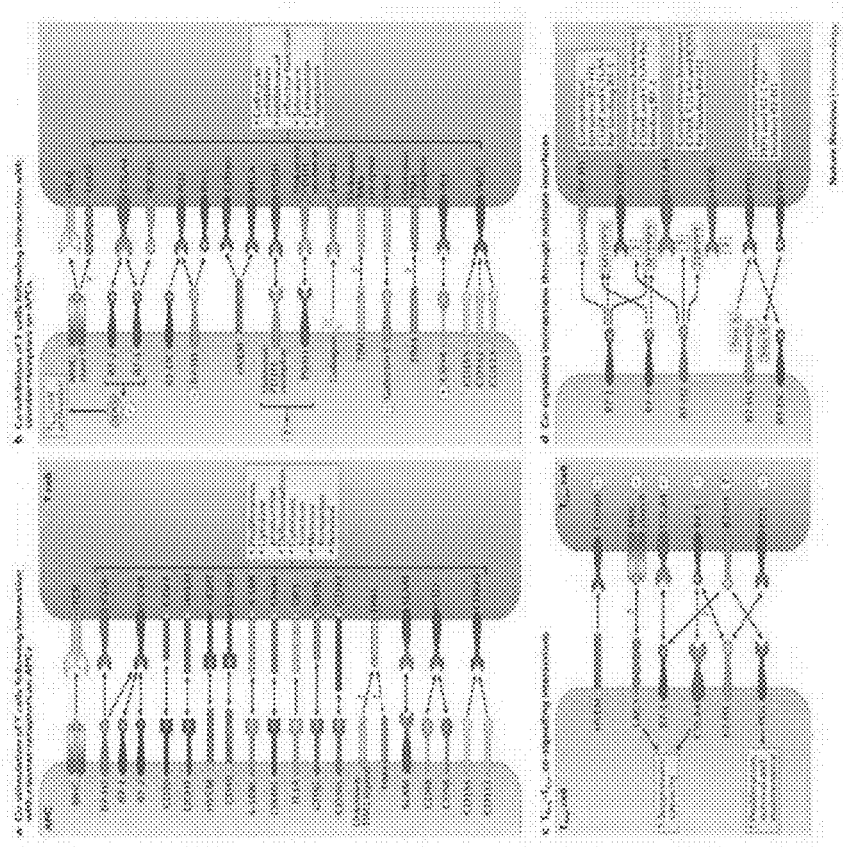
FIGS. 26A-26P demonstrate targeting of co-inhibitory/co-stimulatory receptors or their ligands. For each target, the indicated four CRISPRs have been cloned and tested for on-target activity in 293T cells. The expected size of the PCR band, when cutting of both CRISPRs occurs, is indicated below the gel picture.
Figure 26B:
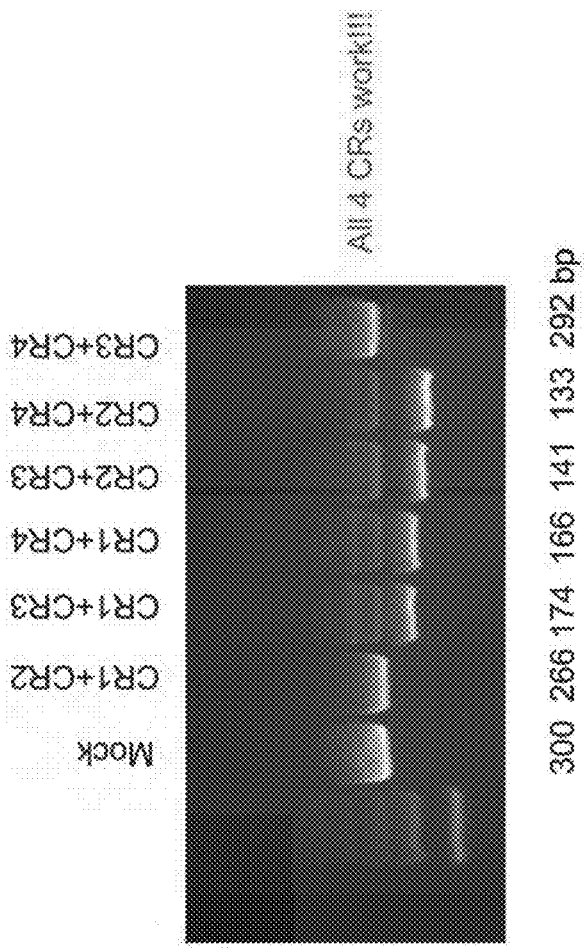
FIG. 26B demonstrates dual guide targeting of TIGIT in 293T cells. All four CRISPRS were found to work.
Figure 26C:
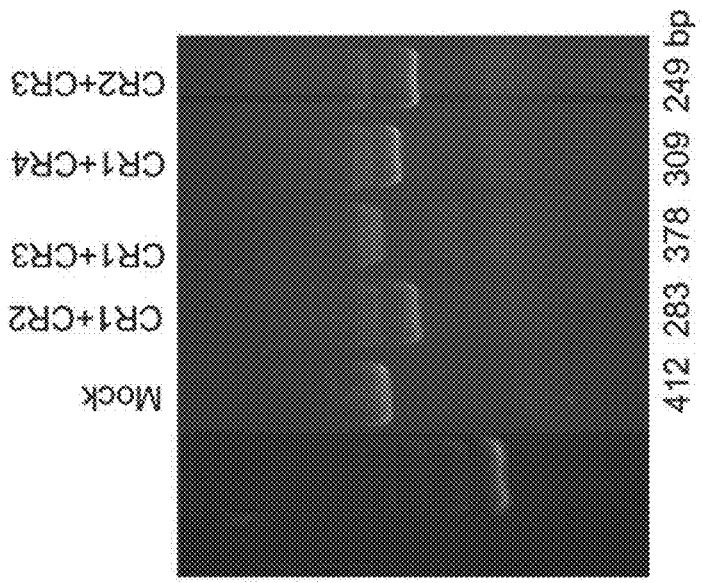
FIG. 26C demonstrates dual guide targeting of TIM3 in 293T cells. All four CRISPRs were found to work.
Figure 26D:
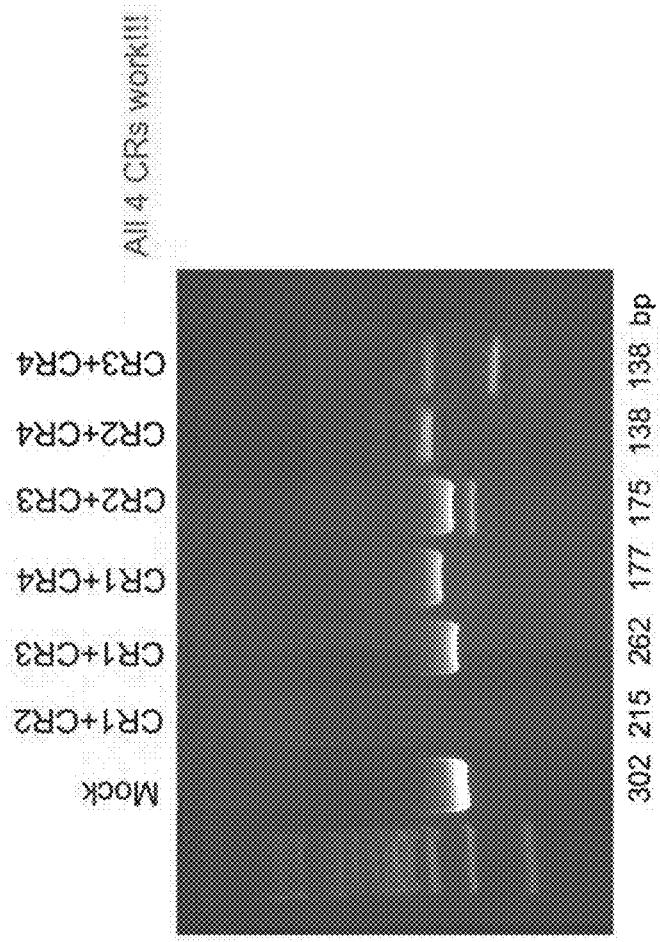
FIG. 26D demonstrates dual guide targeting of HVEM in 293T cells. All four CRISPRs were found to work.
Figure 26E:
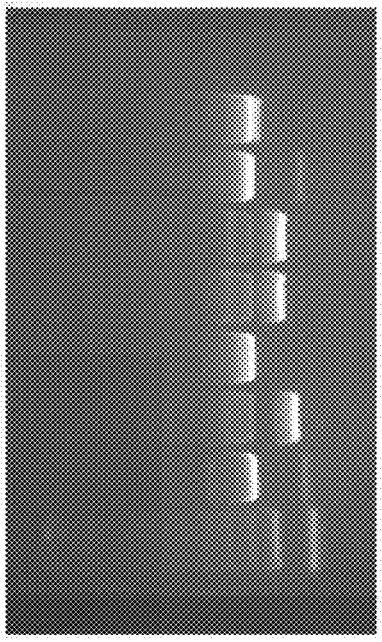
FIG. 26E demonstrates dual guide targeting of 2B4/CD244 in 293T cells. All four CRISPRs were found to work.
Figure 20F:
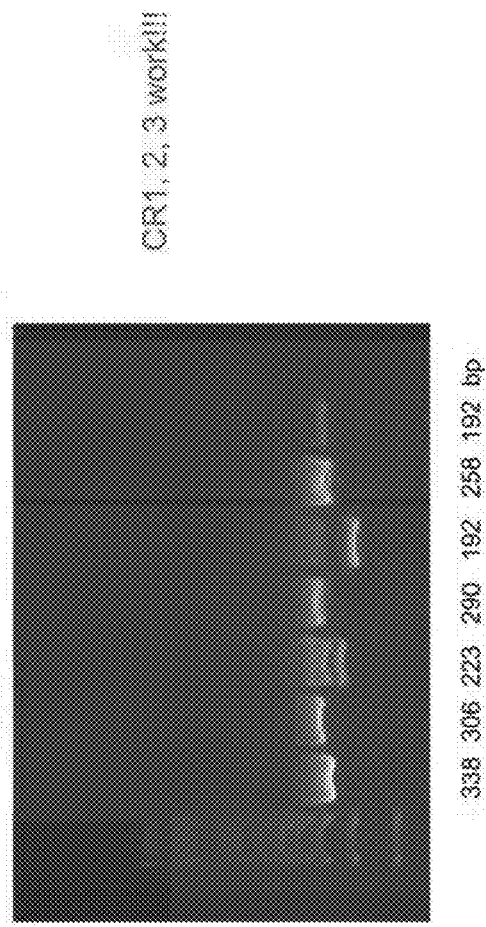
Figure 26G:
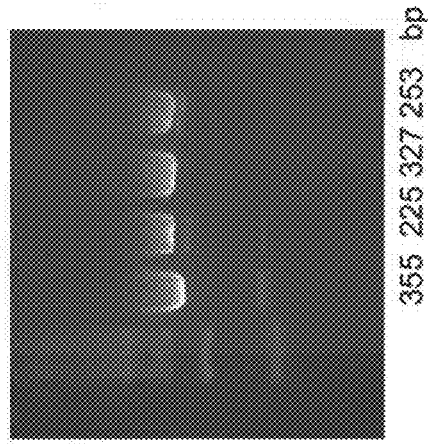
FIG. 26G demonstrates dual guide targeting of OX40 in 293T cells. CRISPRs #1, #2 and #4 were found to work.
Figure 26H:
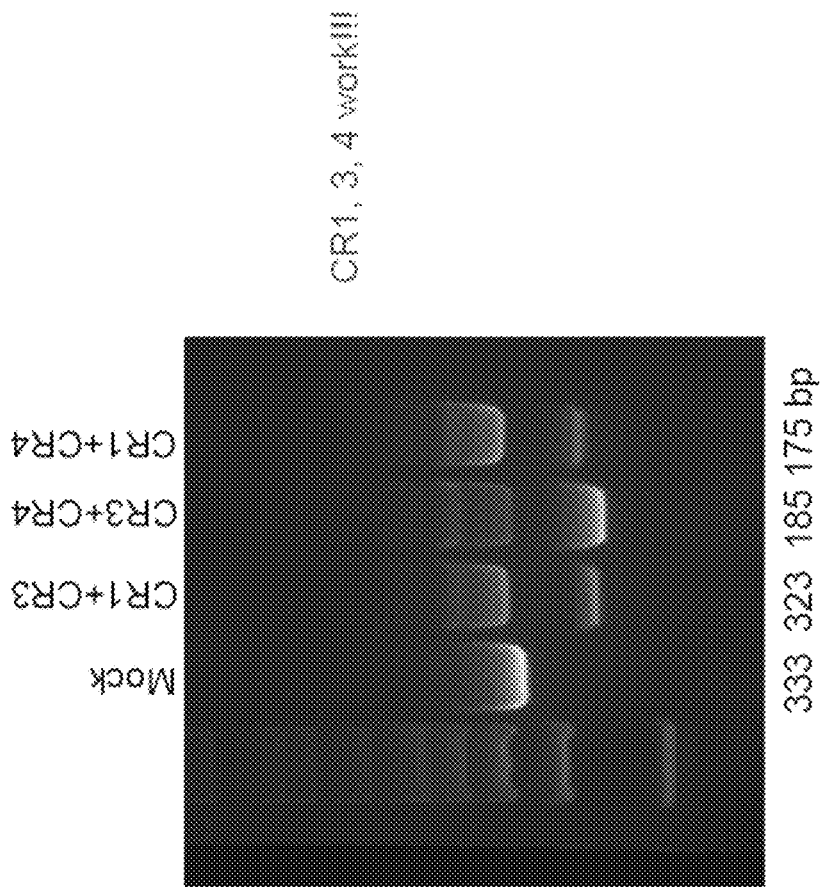
FIG. 26H demonstrates dual guide targeting of B71 in 293T cells. CRISPRs #1, #3 and #4 were found to work.
Figure 26I:
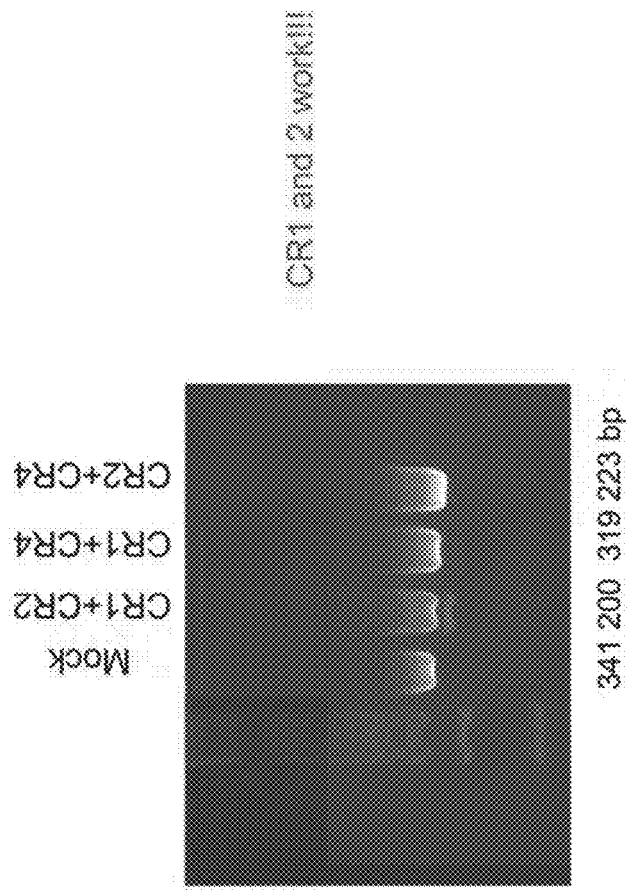
FIG. 26I demonstrates dual guide targeting of CD226 in 293T cells. CRISPRs #1 and #2 were found to work.
Figure 26J:
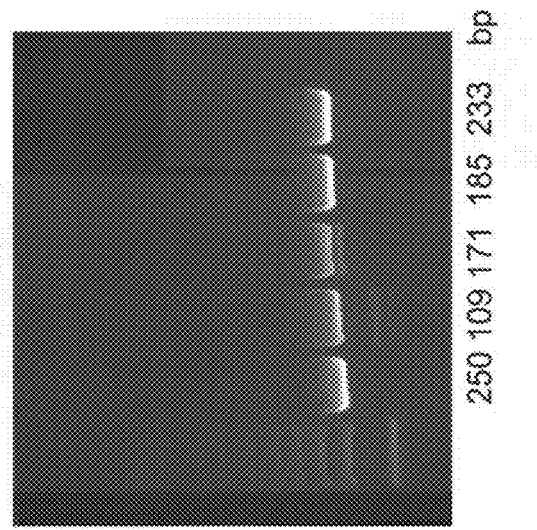
FIG. 26J demonstrates dual guide targeting of CD2 in 293T cells. CRISPRs #1, #2 and #3 were found to work.
Figure 26K:
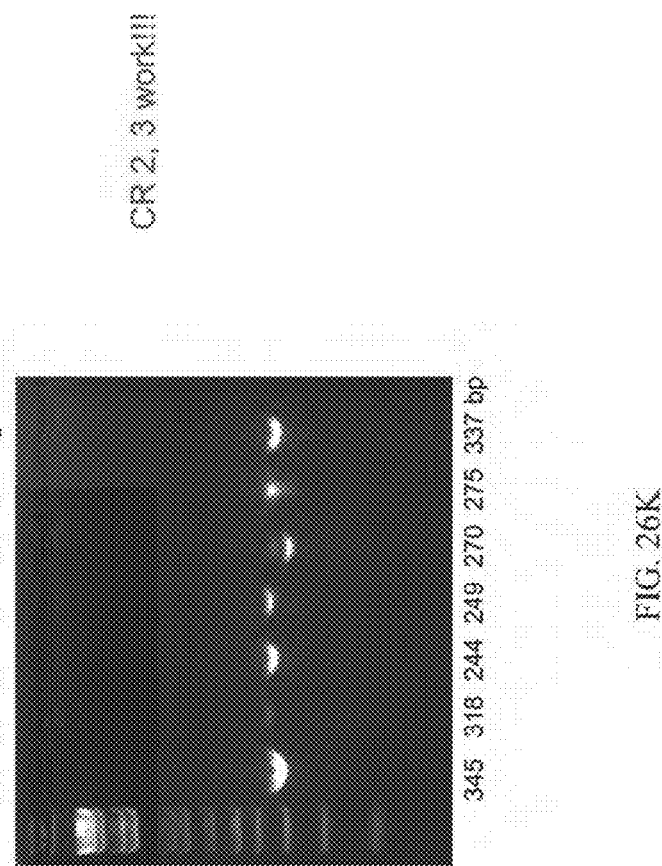
FIG. 26K demonstrates dual guide targeting of LAG3 in 293T cells. CRISPRs #2 and #3 were found to work.
Figure 26L:
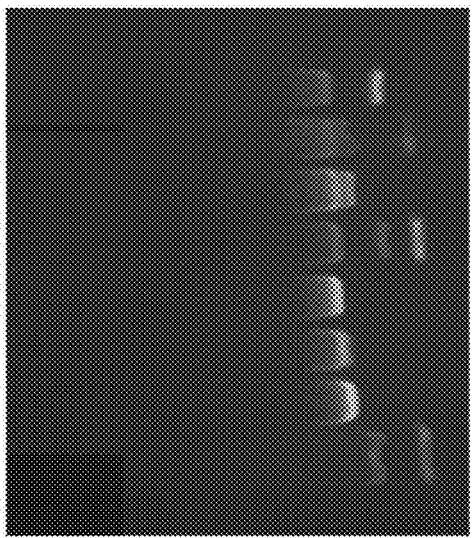
FIG. 26L demonstrates dual guide targeting of BTLA in 293T cells. All four CRISPRs were found to work.
Figure 26M:
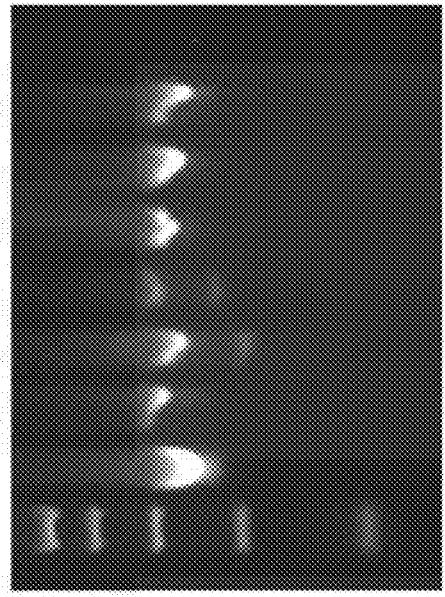
FIG. 26M demonstrates dual guide targeting of ICOS in 293T cells. CRISPRs #2, #3 and #4 were found to work.
Figure 26N:
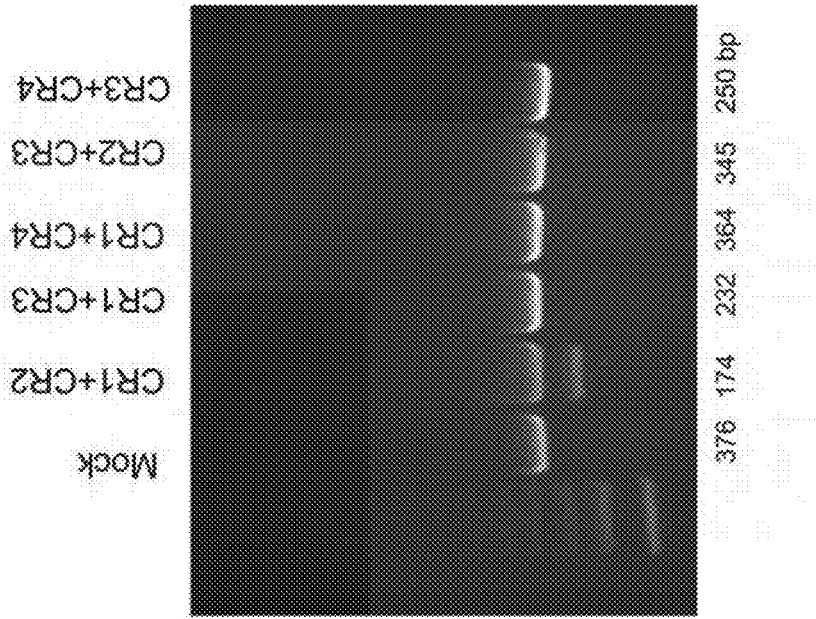
FIG. 26N demonstrates dual guide targeting of CD27 in 293T cells. CRISPRs #1 and #2 were found to work.
Figure 26P:
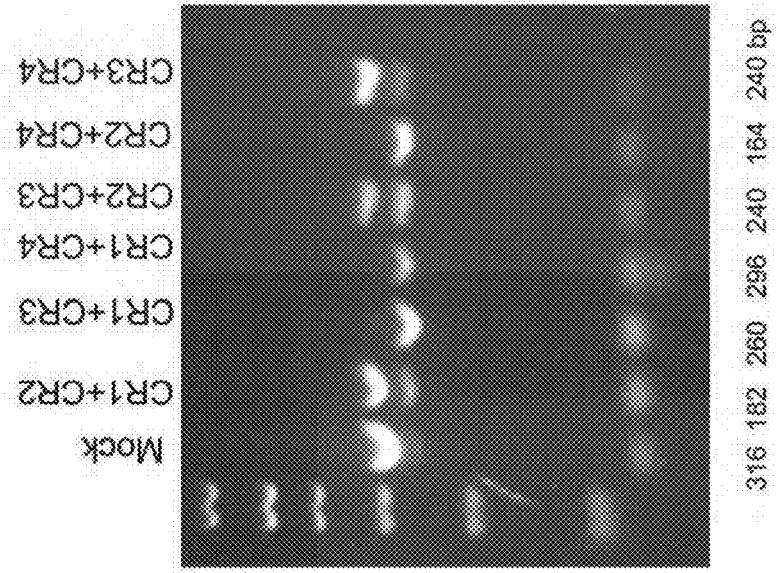

The inventors examined multiple targets utilizing CRISPR. An illustration of co-stimulatory/inhibitory molecules and their receptors on T cells is provided in FIG. 26A. For each target examined, the indicated four CRISPRs have been cloned and tested for on-target activity in 293T cells. The expected size of the PCR band, when cutting of both CRISPRs occurs, is indicated below each individual gel picture (FIGS. 26B-26P). Dual guide targeting in 293T cells was demonstrated for TIGIT (FIG. 26B), TIM3 (FIG. 26C), HVEM (FIG. 26D), 2B4/CD244 (FIG. 26E), CD28 (FIG. 26F), OX40 (FIG. 26G), B71 (FIG. 26H), CD226 (FIG. 26I), CD2 (FIG. 26J), LAG3 (FIG. 26K), BTLA (FIG. 26L), ICOS (FIG. 26M), CD27 (FIG. 26N), ST2 (FIG. 26O) and GITR (FIG. 26P).

Figure 30B:
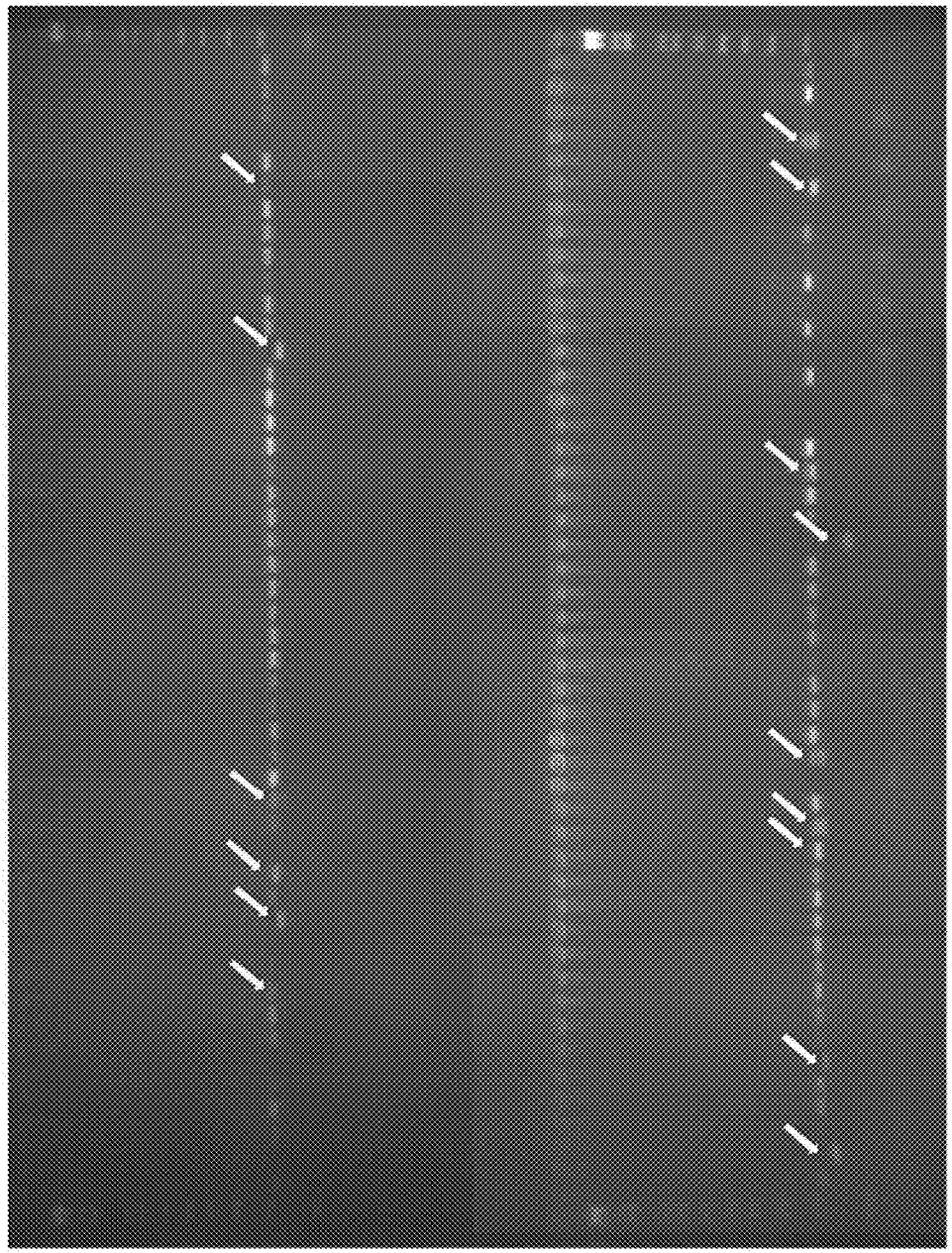
Figure 30C:
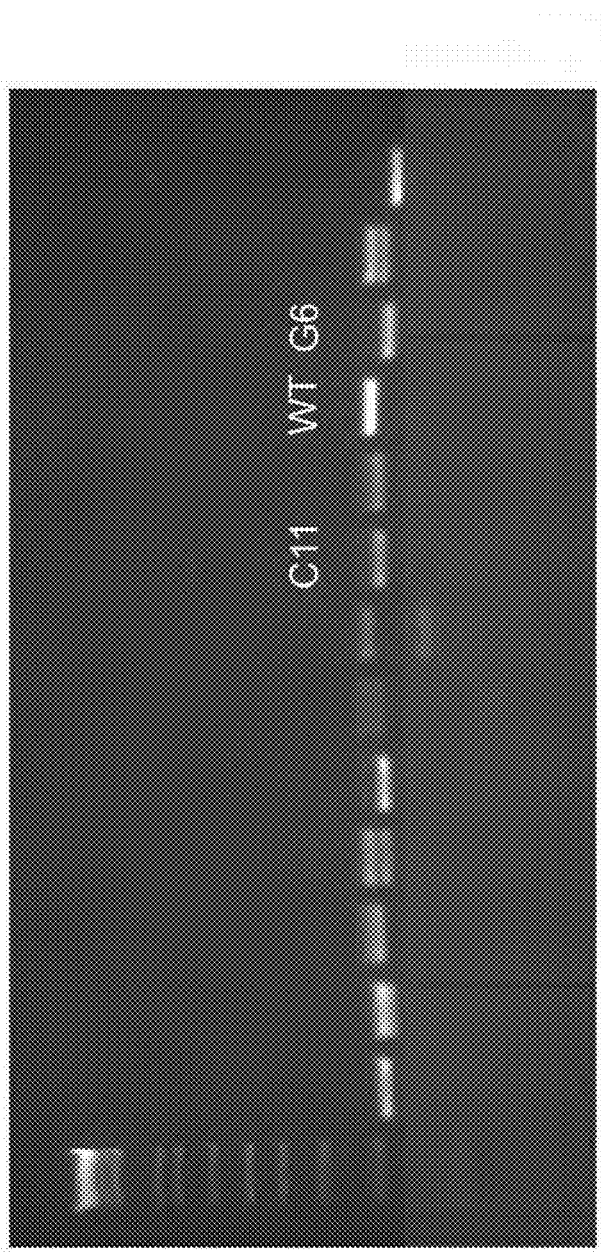
Figure 30D:
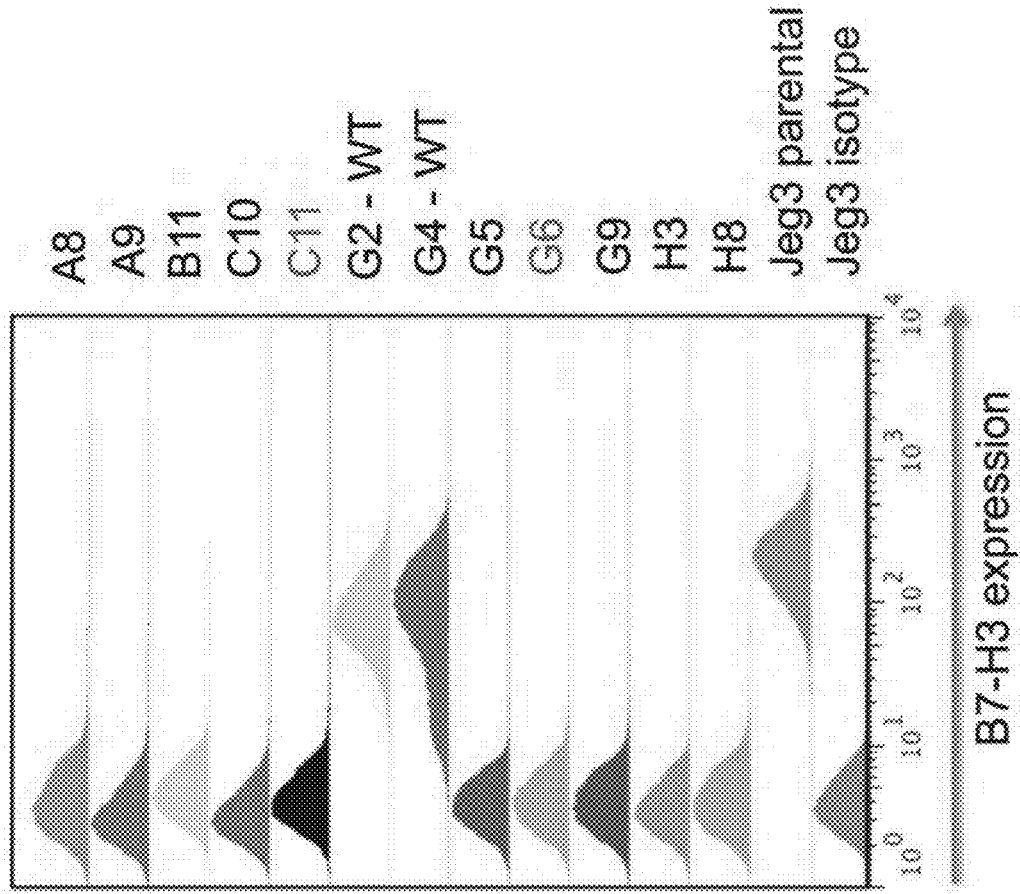

CRISPR targeting of B7-H3 was examined in JEG-3 cells (FIGS. 30A-30D). FIG. 30B shows a screening of targeted B7-H3 colonies in JEG-3 cells and identifies a CRISPR cutting efficiency of 15/80 or about 18.7%. Confirmation of the B7-H3 knock-outs through sequencing was performed (FIG. 30C) and the loss of B7-H3 surface expression in targeted Jeg3 clones was provided in FIG. 30D.

Differentiation of Modified Embryonic Stem Cells

Modified embryonic stem cells may be differentiated into a variety of different cell types, with reduced or absent HLA expression (FIG. 28A). Examples of such cell types include mesenchymal progenitors cells (MPCs), hypoimmunogenic cardiomyocytes, endothelial cells (ECs), macrophages, hepatocytes, beta cells (e.g., pancreatic beta cells), or neural progenitor cells (NPCs).

Figure 28B:
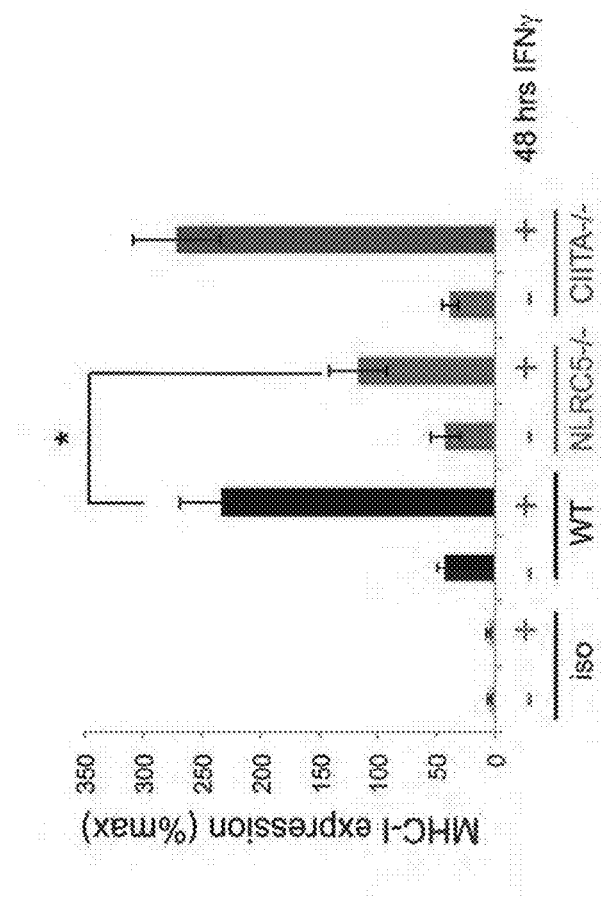

Initially, the inventors demonstrated reduced MHC-I expression in NLRC5−/− human ES cells in FIG. 28B. Low basal MHC-I expression was seen in stem cells, but expression could be increased by IFNγ stimulation. There is about a 50% reduction in IFNγ-treated NLRC5−/− cells.

Figure 28D:
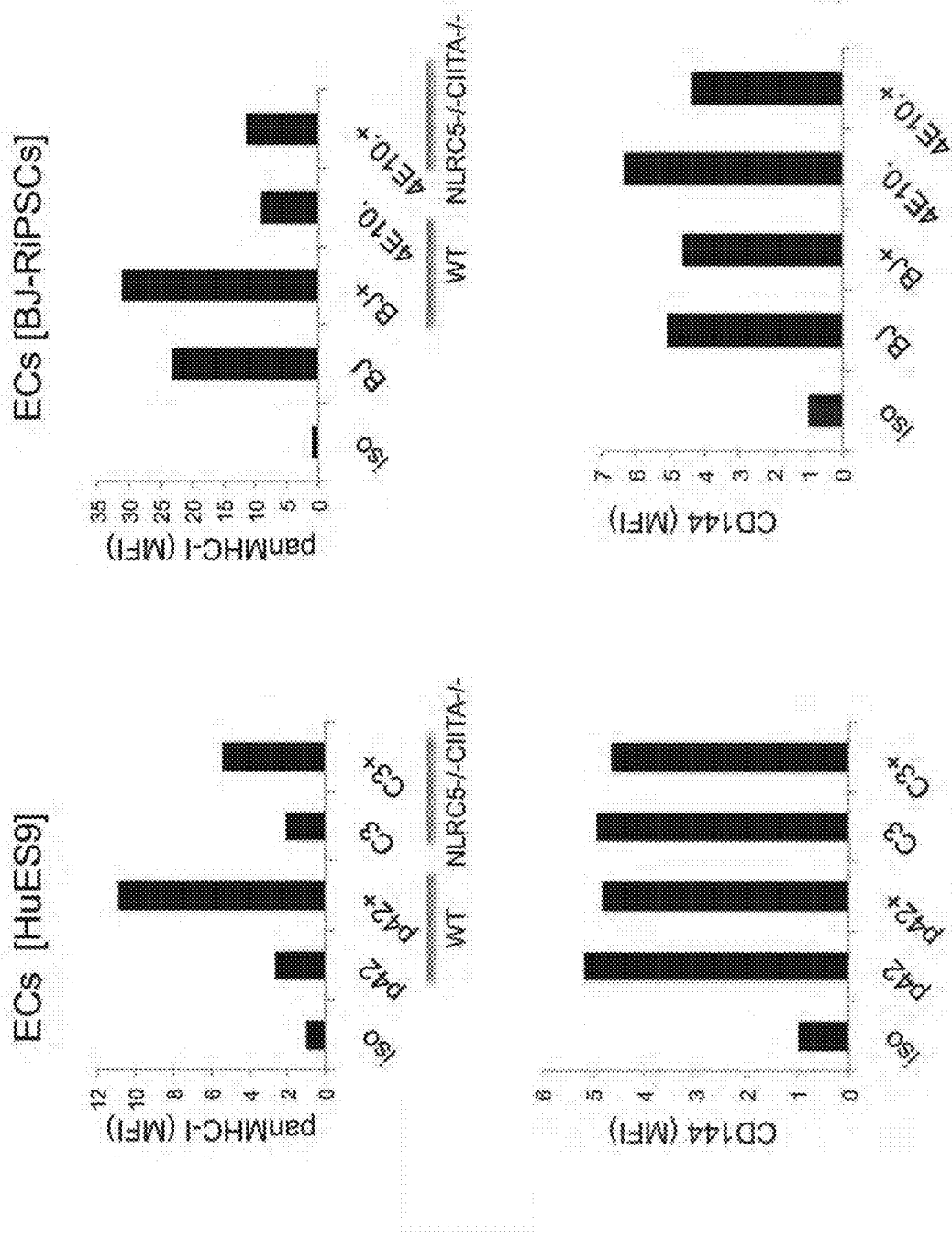
Figure 28F:
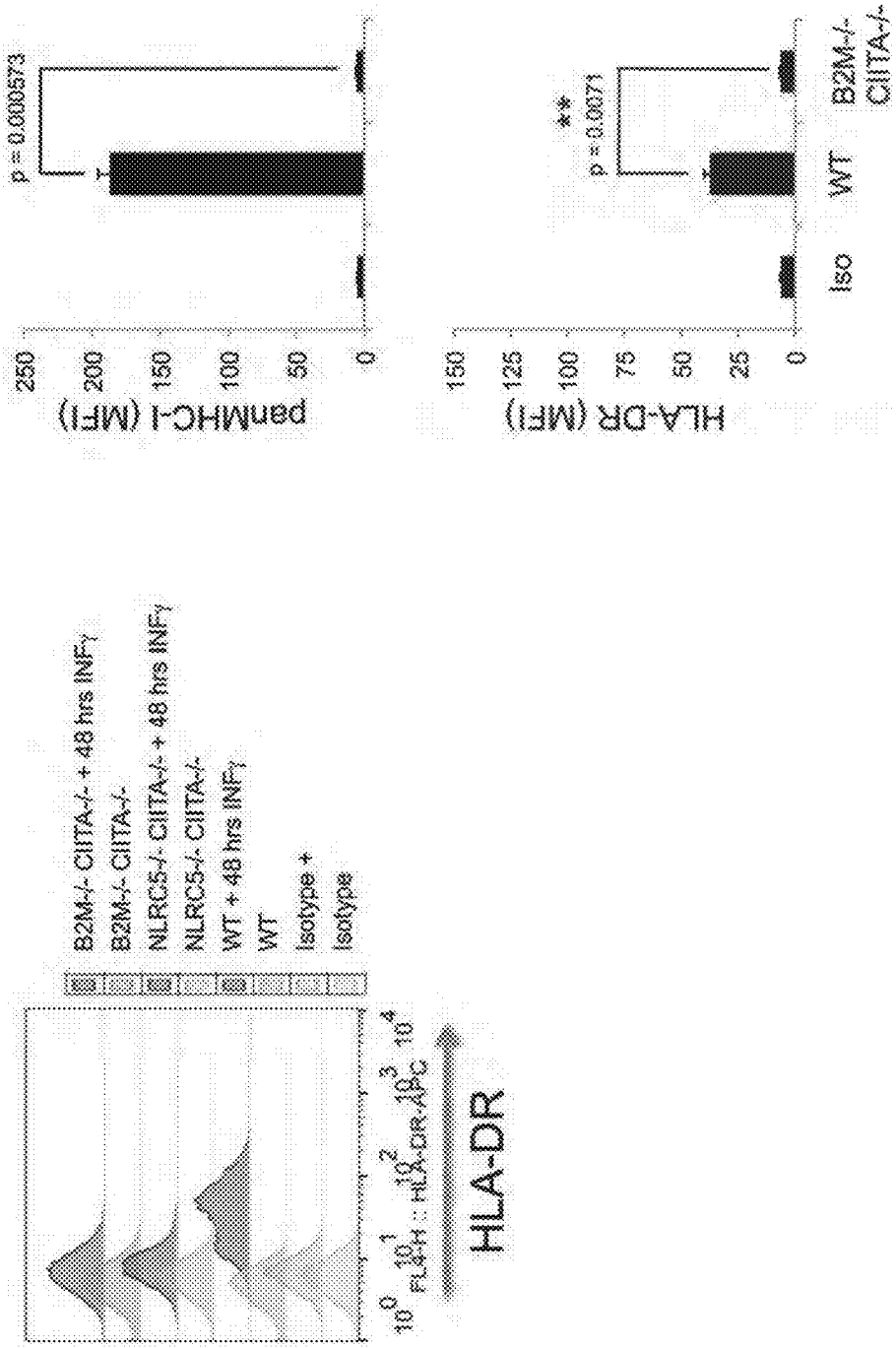

The inventors then examined MHC-I expression in various differentiated cell types. For example, FIG. 28C shows reduced MHC-I expression in NLRC5−/− human mesenchymal progenitor cells (MPCs). The graphs included in FIG. 28C demonstrate the differences between MHC-I expression in HuES9 cells and MPC cells. FIG. 28D shows reduced MHC-I expression in stem cell-derived NLRC5−/− endothelial cells (ECs). Similar differentiation efficiency for ECs was shown in FIG. 28E, and a loss of HLA expression in B2M−/−CIITA−/− ECs was shown in FIG. 28F. Next, reduced MHC class I expression in NLRC5−/− hepatocyte-like cells (HLCs) was provided (FIG. 28G). The HLCs were derived from BJ-RIPSCs.

Figure 28H:
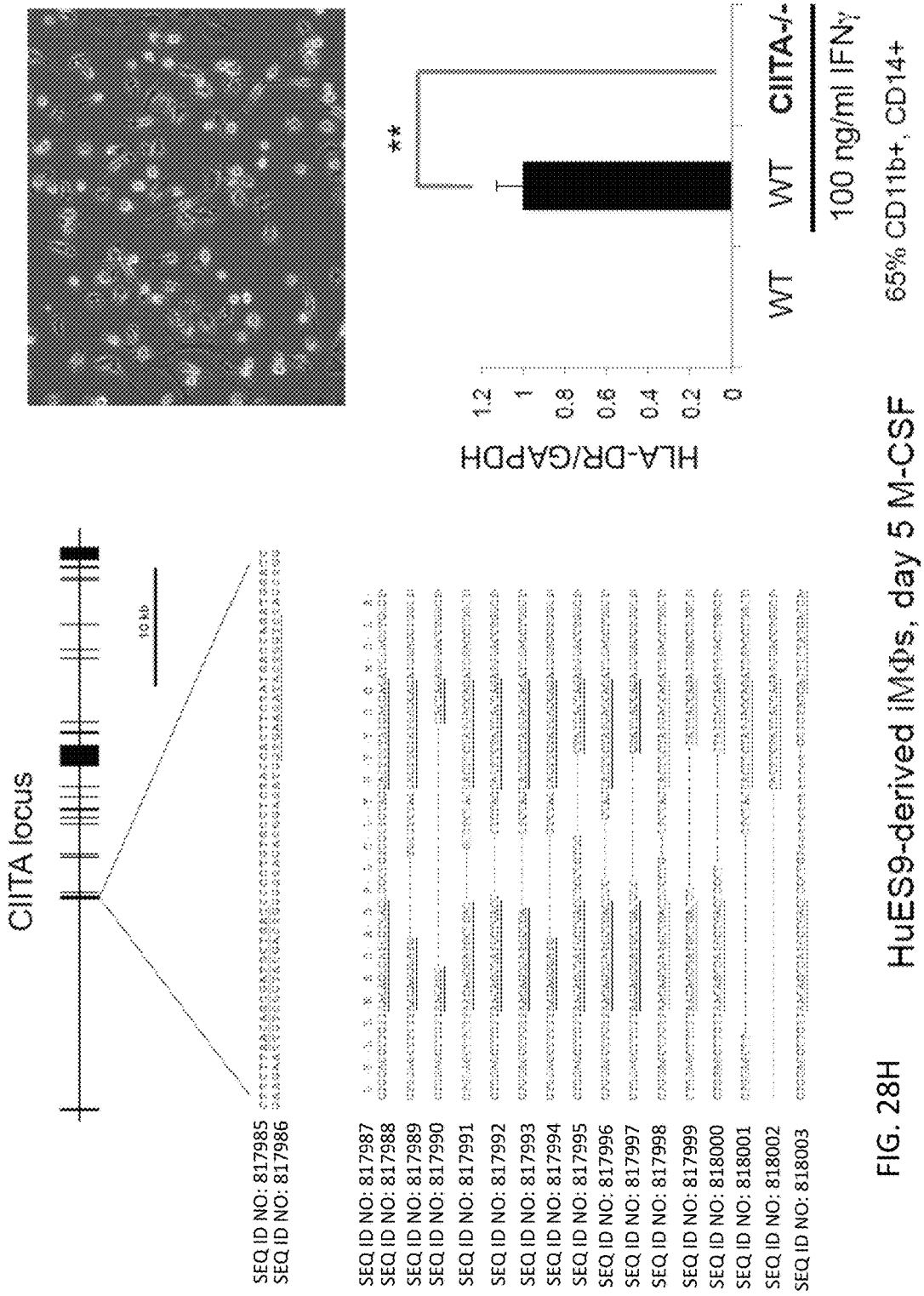
Figure 28I:
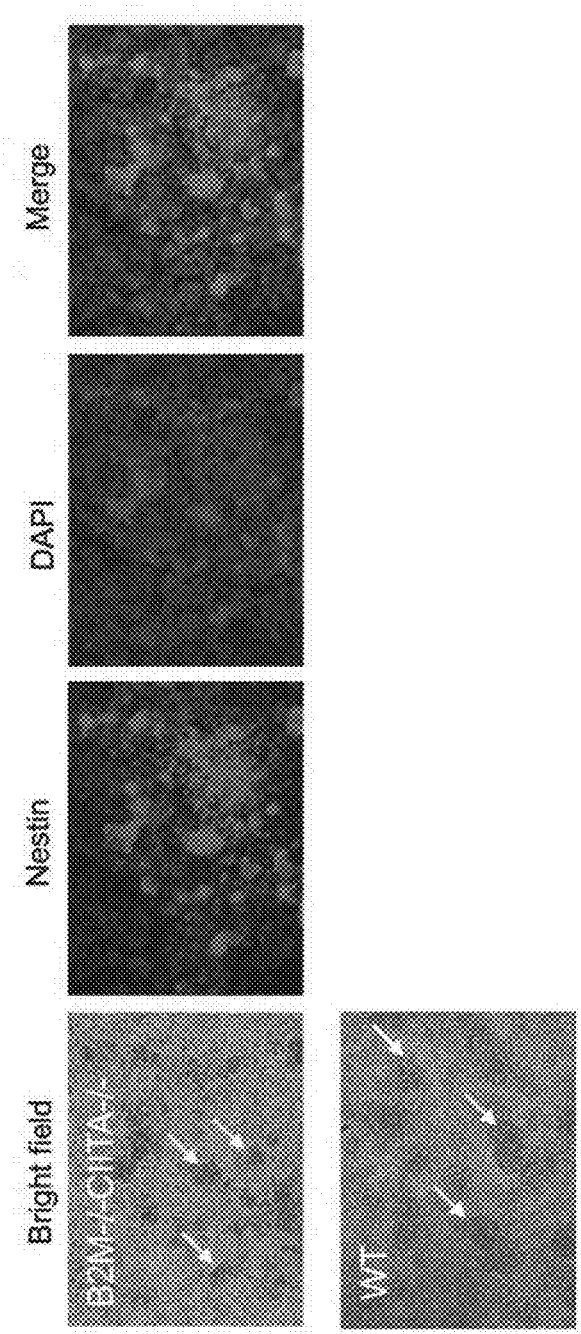
Figure 28J:
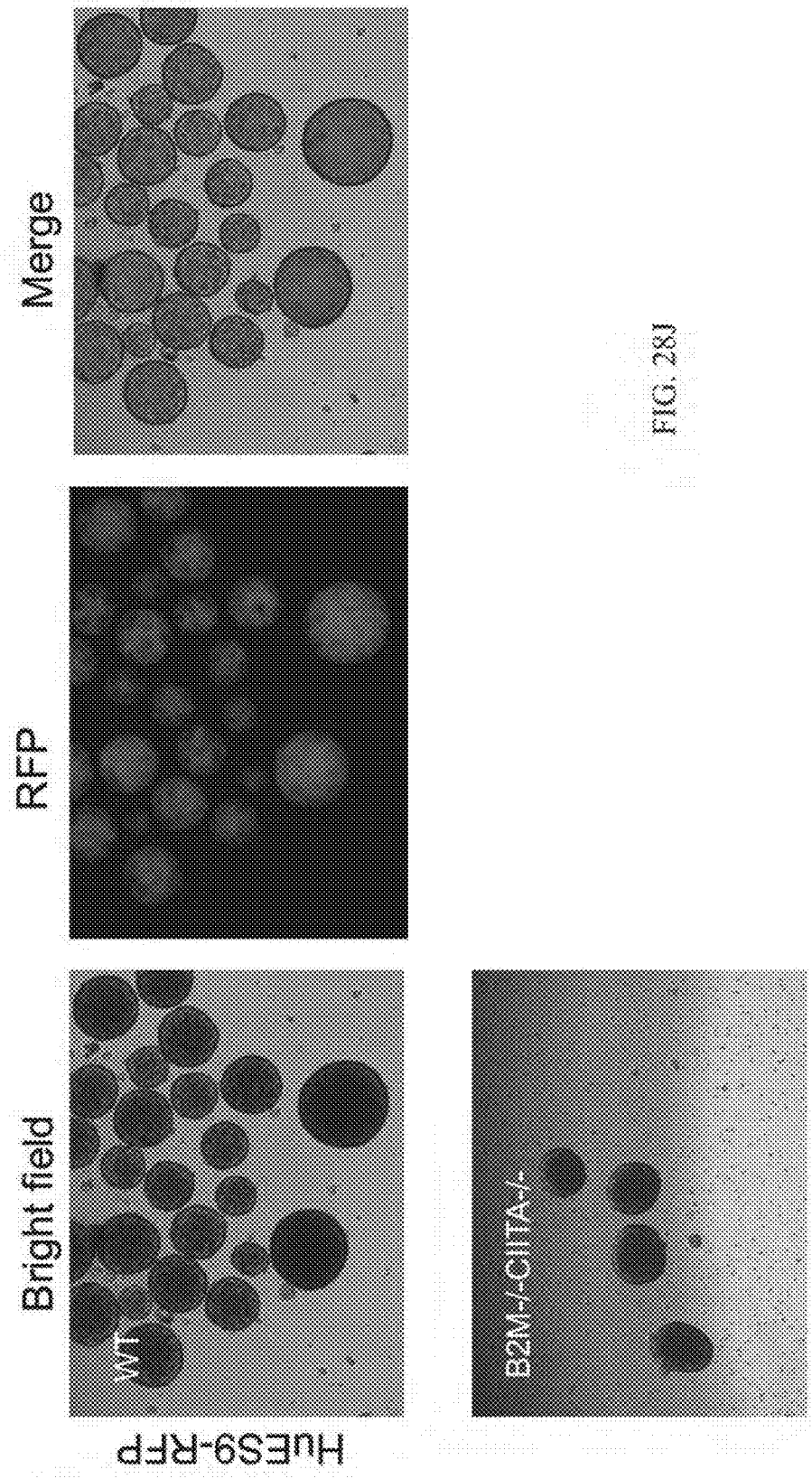

At FIG. 28H it is shown that a mutation of CIITA abrogates MHC class II expression in hESC-derived macrophages. Additionally, neural progenitor cells (NPCs) are differentiated from an embryonic stem cell (FIG. 28I). It was shown that B2M−/−CIITA−/−HuES9 cells form Nestin+ neural rosettes (white arrows in figure) as a result of differentiation. Finally, the inventors have adapted modified embryonic stem cells to spin culture so as to be utilized for beta-cell differentiation (FIG. 28J).

In Vivo Data

Figure 29B:
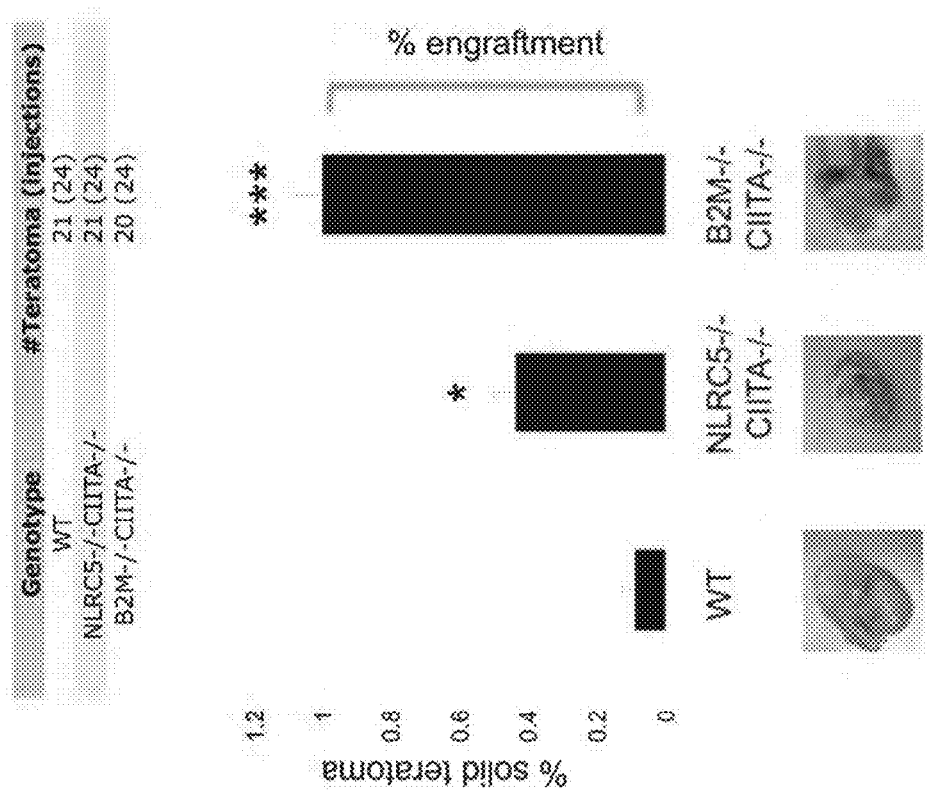

Finally, the inventors have generated 'hypoimmunogenic' DKO cell lines (FIG. 29A). The cells lines examined were WT HuES9 cells, NLRC5−/− C2TA−/− HuES9 cells and B2M−/− C2TA−/− HuES9 cells. The different cells lines showed different levels of MHC-I and MHC-II expression (FIG. 29A). For example, WT HuES9 cells exhibited expression of MHC-I and MHC-II. The NLRC5−/− C2TA−/− HuES9 cells exhibited reduced MHC-I expression and no MHC-II expression. The B2M−/− C2TA−/− HuES9 cells exhibited no MHC-I and MHC-II expression. These cells lines were then examined in humanized mice and improved engraftment of genome-edited stem cells in humanized mice was shown in FIG. 29B.

SEQUENCE LISTING (818255 sequences)

SEQ ID NO: 1 - protein, 1368 aa, Artificial [sequence omitted]

SEQ ID NO: 2 - DNA, 20 bp, Artificial
  CRISPR gRNA sequence
gggtttccagagaagccaat

SEQ ID NO: 3 - DNA, 20 bp, Artificial
  CRISPR gRNA sequence
gaagccaatcagtgtcgtcg

SEQ ID NO: 4 - DNA, 20 bp, Artificial
  CRISPR gRNA sequence
tcgtcgcggtcgctgttcta

SEQ ID NO: 5 - DNA, 20 bp, Artificial
  CRISPR gRNA sequence
taaagcccgcacgcacccac

SEQ ID NO: 6 - DNA, 20 bp, Artificial
  CRISPR gRNA sequence
aaagcccgcacgcacccacc

SEQ ID NO: 7 - DNA, 20 bp, Artificial
  CRISPR gRNA sequence
cgcacgcacccaccgggact

SEQ ID NO: 8 - DNA, 20 bp, Artificial
  CRISPR gRNA sequence
accgggactcagattctccc

SEQ ID NO: 9 - DNA, 20 bp, Artificial
  CRISPR gRNA sequence
tcagattctccccagacgcc

SEQ ID NO: 10 - DNA, 20 bp, Artificial
  CRISPR gRNA sequence
cagattctccccagacgccg

SEQ ID NO: 11 - DNA, 20 bp, Artificial
  CRISPR gRNA sequence
ttctccccagacgccgagga

SEQ ID NO: 12 - DNA, 20 bp, Artificial
  CRISPR gRNA sequence
gacgccgaggatggccgtca

SEQ ID NO: 13 - DNA, 20 bp, Artificial
  CRISPR gRNA sequence
aaccctcctcctgctactct

SEQ ID NO: 14 - DNA, 20 bp, Artificial
  CRISPR gRNA sequence
accctcctcctgctactctc

SEQ ID NO: 15 - DNA, 20 bp, Artificial
  CRISPR gRNA sequence
ccctcctcctgctactctcg

SEQ ID NO: 16 - DNA, 20 bp, Artificial
  CRISPR gRNA sequence
cctcctcctgctactctcgg

SEQ ID NO: 17 - DNA, 20 bp, Artificial
  CRISPR gRNA sequence
cctgctactctcgggggccc

SEQ ID NO: 18 - DNA, 20 bp, Artificial
  CRISPR gRNA sequence
cgggggccctggccctgacc

SEQ ID NO: 19 - DNA, 20 bp, Artificial
  CRISPR gRNA sequence
ccctggccctgacccagacc

SEQ ID NO: 20 - DNA, 20 bp, Artificial
  CRISPR gRNA sequence
cctggccctgacccagacct

SEQ ID NO: 21 - DNA, 20 bp, Artificial
  CRISPR gRNA sequence
ggccctgacccagacctggg

SEQ ID NO: 22 - DNA, 20 bp, Artificial
  CRISPR gRNA sequence
gccctgacccagacctgggc

SEQ ID NO: 23 - DNA, 20 bp, Artificial
  CRISPR gRNA sequence
tgacccagacctgggcgggt

SEQ ID NO: 24 - DNA, 20 bp, Artificial
  CRISPR gRNA sequence
cagacctgggcgggtgagtg

SEQ ID NO: 25 - DNA, 20 bp, Artificial
  CRISPR gRNA sequence
agacctgggcgggtgagtgc

SEQ ID NO: 26 - DNA, 20 bp, Artificial
  CRISPR gRNA sequence
gacctgggcgggtgagtgcg

SEQ ID NO: 27 - DNA, 20 bp, Artificial
  CRISPR gRNA sequence
tgggcgggtgagtgcggggt

SEQ ID NO: 28 - DNA, 20 bp, Artificial
  CRISPR gRNA sequence
gggcgggtgagtgcggggtc

SEQ ID NO: 29 - DNA, 20 bp, Artificial
  CRISPR gRNA sequence
gcgggtgagtgcggggtcgg

SEQ ID NO: 30 - DNA, 20 bp, Artificial
  CRISPR gRNA sequence
cgggtgagtgcggggtcggg

SEQ ID NO: 31 - DNA, 20 bp, Artificial
  CRISPR gRNA sequence
gggtgagtgcggggtcggga

SEQ ID NO: 32 - DNA, 20 bp, Artificial
  CRISPR gRNA sequence
cgggagggaaaccgcctctg

SEQ ID NO: 33 - DNA, 20 bp, Artificial
  CRISPR gRNA sequence
gggagggaaaccgcctctgc

SEQ ID NO: 34 - DNA, 20 bp, Artificial
  CRISPR gRNA sequence
ggagggaaaccgcctctgcg

SEQ ID NO: 35 - DNA, 20 bp, Artificial
  CRISPR gRNA sequence
agggaaaccgcctctgcggg

SEQ ID NO: 36 - DNA, 20 bp, Artificial
  CRISPR gRNA sequence
gaaaccgcctctgcggggag

SEQ ID NO: 37 - DNA, 20 bp, Artificial
  CRISPR gRNA sequence
ccgcctctgcggggagaagc

SEQ ID NO: 38 - DNA, 20 bp, Artificial
  CRISPR gRNA sequence
cgcctctgcggggagaagca

SEQ ID NO: 39 - DNA, 20 bp, Artificial
  CRISPR gRNA sequence
gcctctgcggggagaagcaa

SEQ ID NO: 40 - DNA, 20 bp, Artificial
  CRISPR gRNA sequence
cctctgcggggagaagcaag

SEQ ID NO: 41 - DNA, 20 bp, Artificial
  CRISPR gRNA sequence
ggagaagcaaggggccctcc

SEQ ID NO: 42 - DNA, 20 bp, Artificial
  CRISPR gRNA sequence
gaagcaaggggccctcctgg

SEQ ID NO: 43 - DNA, 20 bp, Artificial
  CRISPR gRNA sequence
aagcaaggggccctcctggc

SEQ ID NO: 44 - DNA, 20 bp, Artificial
  CRISPR gRNA sequence
agcaaggggccctcctggcg

SEQ ID NO: 45 - DNA, 20 bp, Artificial
  CRISPR gRNA sequence
gcaaggggccctcctggcgg

SEQ ID NO: 46 - DNA, 20 bp, Artificial
  CRISPR gRNA sequence
gggccctcctggcgggggcg

SEQ ID NO: 47 - DNA, 20 bp, Artificial
  CRISPR gRNA sequence
ggccctcctggcgggggcgc

SEQ ID NO: 48 - DNA, 20 bp, Artificial
  CRISPR gRNA sequence
tcctggcgggggcgcaggac

SEQ ID NO: 49 - DNA, 20 bp, Artificial
  CRISPR gRNA sequence
cctggcgggggcgcaggacc

SEQ ID NO: 50 - DNA, 20 bp, Artificial
  CRISPR gRNA sequence
ctggcgggggcgcaggaccg

SEQ ID NO: 51 - DNA, 20 bp, Artificial
  CRISPR gRNA sequence
tggcgggggcgcaggaccgg

SEQ ID NO: 52 - DNA, 20 bp, Artificial
  CRISPR gRNA sequence
gcgggggcgcaggaccgggg

SEQ ID NO: 53 - DNA, 20 bp, Artificial
  CRISPR gRNA sequence
caggaccgggggagccgcgc

SEQ ID NO: 54 - DNA, 20 bp, Artificial
  CRISPR gRNA sequence
aggaccgggggagccgcgcc

SEQ ID NO: 55 - DNA, 20 bp, Artificial
  CRISPR gRNA sequence
cgggggagccgcgccgggac

SEQ ID NO: 56 - DNA, 20 bp, Artificial
  CRISPR gRNA sequence
gggggagccgcgccgggacg

SEQ ID NO: 57 - DNA, 20 bp, Artificial
  CRISPR gRNA sequence
ggggagccgcgccgggacga

SEQ ID NO: 58 - DNA, 20 bp, Artificial
  CRISPR gRNA sequence
agccgcgccgggacgagggt

SEQ ID NO: 59 - DNA, 20 bp, Artificial
  CRISPR gRNA sequence
gccgcgccgggacgagggtc

SEQ ID NO: 60 - DNA, 20 bp, Artificial
  CRISPR gRNA sequence
gcgccgggacgagggtcggg

SEQ ID NO: 61 - DNA, 20 bp, Artificial
  CRISPR gRNA sequence
cgccgggacgagggtcgggc

SEQ ID NO: 62 - DNA, 20 bp, Artificial
  CRISPR gRNA sequence
gacgagggtcgggcaggtct

SEQ ID NO: 63 - DNA, 20 bp, Artificial
  CRISPR gRNA sequence
tctcagccactgctcgcccc

SEQ ID NO: 64 - DNA, 20 bp, Artificial
  CRISPR gRNA sequence
ctcagccactgctcgccccc

SEQ ID NO: 65 - DNA, 20 bp, Artificial
  CRISPR gRNA sequence
cccccaggctcccactccat

SEQ ID NO: 66 - DNA, 20 bp, Artificial
  CRISPR gRNA sequence
ccccaggctcccactccatg

SEQ ID NO: 67 - DNA, 20 bp, Artificial
  CRISPR gRNA sequence
atttcttcacatccgtgtcc

SEQ ID NO: 68 - DNA, 20 bp, Artificial
  CRISPR gRNA sequence
ttcacatccgtgtcccggcc

SEQ ID NO: 69 - DNA, 20 bp, Artificial
  CRISPR gRNA sequence
tccgtgtcccggcccggccg

SEQ ID NO: 70 - DNA, 20 bp, Artificial
  CRISPR gRNA sequence
ccgtgtcccggcccggccgc

SEQ ID NO: 71 - DNA, 20 bp, Artificial
  CRISPR gRNA sequence
cgtgtcccggcccggccgcg

SEQ ID NO: 72 - DNA, 20 bp, Artificial
  CRISPR gRNA sequence
tgtcccggcccggccgcggg

SEQ ID NO: 73 - DNA, 20 bp, Artificial
  CRISPR gRNA sequence
ggagccccgcttcatcgccg

SEQ ID NO: 74 - DNA, 20 bp, Artificial
  CRISPR gRNA sequence
gagccccgcttcatcgccgt

SEQ ID NO: 75 - DNA, 20 bp, Artificial
  CRISPR gRNA sequence
cttcatcgccgtgggctacg

SEQ ID NO: 76 - DNA, 20 bp, Artificial
  CRISPR gRNA sequence
tgggctacgtggacgacacg

SEQ ID NO: 77 - DNA, 20 bp, Artificial
  CRISPR gRNA sequence
tggacgacacgcagttcgtg

SEQ ID NO: 78 - DNA, 20 bp, Artificial
  CRISPR gRNA sequence
acgcagttcgtgcggttcga

SEQ ID NO: 79 - DNA, 20 bp, Artificial
  CRISPR gRNA sequence
cggttcgacagcgacgccgc

SEQ ID NO: 80 - DNA, 20 bp, Artificial
  CRISPR gRNA sequence
tcgacagcgacgccgcgagc

SEQ ID NO: 81 - DNA, 20 bp, Artificial
  CRISPR gRNA sequence
gacagcgacgccgcgagcca

SEQ ID NO: 82 - DNA, 20 bp, Artificial
  CRISPR gRNA sequence
acagcgacgccgcgagccag

SEQ ID NO: 83 - DNA, 20 bp, Artificial
  CRISPR gRNA sequence
cgacgccgcgagccagagga

SEQ ID NO: 84 - DNA, 20 bp, Artificial
  CRISPR gRNA sequence
acgccgcgagccagaggatg

SEQ ID NO: 85 - DNA, 20 bp, Artificial
  CRISPR gRNA sequence
cgagccagaggatggagccg

SEQ ID NO: 86 - DNA, 20 bp, Artificial
  CRISPR gRNA sequence
gagccagaggatggagccgc

SEQ ID NO: 87 - DNA, 20 bp, Artificial
  CRISPR gRNA sequence
ggatggagccgcgggcgccg

SEQ ID NO: 88 - DNA, 20 bp, Artificial
  CRISPR gRNA sequence
ggagccgcgggcgccgtgga

SEQ ID NO: 89 - DNA, 20 bp, Artificial
  CRISPR gRNA sequence
agccgcgggcgccgtggata

SEQ ID NO: 90 - DNA, 20 bp, Artificial
  CRISPR gRNA sequence
cgcgggcgccgtggatagag

SEQ ID NO: 91 - DNA, 20 bp, Artificial
  CRISPR gRNA sequence
gcgggcgccgtggatagagc

SEQ ID NO: 92 - DNA, 20 bp, Artificial
  CRISPR gRNA sequence
gggcgccgtggatagagcag

SEQ ID NO: 93 - DNA, 20 bp, Artificial
  CRISPR gRNA sequence
ggcgccgtggatagagcagg

SEQ ID NO: 94 - DNA, 20 bp, Artificial
  CRISPR gRNA sequence
gcgccgtggatagagcagga

SEQ ID NO: 95 - DNA, 20 bp, Artificial
  CRISPR gRNA sequence
cgccgtggatagagcaggag

SEQ ID NO: 96 - DNA, 20 bp, Artificial
  CRISPR gRNA sequence
gtggatagagcaggaggggc

SEQ ID NO: 97 - DNA, 20 bp, Artificial
  CRISPR gRNA sequence
ggatagagcaggaggggccg

SEQ ID NO: 98 - DNA, 20 bp, Artificial
  CRISPR gRNA sequence
agcaggaggggccggagtat

SEQ ID NO: 99 - DNA, 20 bp, Artificial
  CRISPR gRNA sequence
gcaggaggggccggagtatt

SEQ ID NO: 100 - DNA, 20 bp, Artificial
  CRISPR gRNA sequence
aggggccggagtattgggac

SEQ ID NO: 101 - DNA, 20 bp, Artificial
  CRISPR gRNA sequence
ggggccggagtattgggacc

SEQ ID NO: 102 - DNA, 20 bp, Artificial
  CRISPR gRNA sequence
ggccggagtattgggaccag

SEQ ID NO: 103 - DNA, 20 bp, Artificial
  CRISPR gRNA sequence
agtattgggaccaggagaca

SEQ ID NO: 104 - DNA, 20 bp, Artificial
  CRISPR gRNA sequence
accaggagacacggaatgtg

SEQ ID NO: 105 - DNA, 20 bp, Artificial
  CRISPR gRNA sequence
ccaggagacacggaatgtga

SEQ ID NO: 106 - DNA, 20 bp, Artificial
  CRISPR gRNA sequence
agacacggaatgtgaaggcc

SEQ ID NO: 107 - DNA, 20 bp, Artificial
  CRISPR gRNA sequence
ggaatgtgaaggcccagtca

SEQ ID NO: 108 - DNA, 20 bp, Artificial
  CRISPR gRNA sequence
ggcccagtcacagactgacc

SEQ ID NO: 109 - DNA, 20 bp, Artificial
  CRISPR gRNA sequence
ccagtcacagactgaccgag

SEQ ID NO: 110 - DNA, 20 bp, Artificial
  CRISPR gRNA sequence
acagactgaccgagtggacc

SEQ ID NO: 111 - DNA, 20 bp, Artificial
  CRISPR gRNA sequence
cagactgaccgagtggacct

SEQ ID NO: 112 - DNA, 20 bp, Artificial
  CRISPR gRNA sequence
agactgaccgagtggacctg

SEQ ID NO: 113 - DNA, 20 bp, Artificial
  CRISPR gRNA sequence
gtggacctggggaccctgcg

SEQ ID NO: 114 - DNA, 20 bp, Artificial
  CRISPR gRNA sequence
ccctgcgcggctactacaac

SEQ ID NO: 115 - DNA, 20 bp, Artificial
  CRISPR gRNA sequence
ctgcgcggctactacaacca

SEQ ID NO: 116 - DNA, 20 bp, Artificial
  CRISPR gRNA sequence
gcggctactacaaccagagc

SEQ ID NO: 117 - DNA, 20 bp, Artificial
  CRISPR gRNA sequence
cggctactacaaccagagcg

SEQ ID NO: 118 - DNA, 20 bp, Artificial
  CRISPR gRNA sequence
tactacaaccagagcgaggc

SEQ ID NO: 119 - DNA, 20 bp, Artificial
  CRISPR gRNA sequence
acaaccagagcgaggccggt

SEQ ID NO: 120 - DNA, 20 bp, Artificial
  CRISPR gRNA sequence
gcgaggccggtgagtgaccc

SEQ ID NO: 121 - DNA, 20 bp, Artificial
  CRISPR gRNA sequence
ggccggtgagtgaccccggc

SEQ ID NO: 122 - DNA, 20 bp, Artificial
  CRISPR gRNA sequence
gccggtgagtgaccccggcc

SEQ ID NO: 123 - DNA, 20 bp, Artificial
  CRISPR gRNA sequence
ccggtgagtgaccccggccg

SEQ ID NO: 124 - DNA, 20 bp, Artificial
  CRISPR gRNA sequence
cggtgagtgaccccggccgg

SEQ ID NO: 125 - DNA, 20 bp, Artificial
  CRISPR gRNA sequence
agtgaccccggccgggggcg

SEQ ID NO: 126 - DNA, 20 bp, Artificial
  CRISPR gRNA sequence
gtgaccccggccgggggcgc

SEQ ID NO: 127 - DNA, 20 bp, Artificial
  CRISPR gRNA sequence
ccccggccgggggcgcaggt

SEQ ID NO: 128 - DNA, 20 bp, Artificial
  CRISPR gRNA sequence
cccggccgggggcgcaggtc

SEQ ID NO: 129 - DNA, 20 bp, Artificial
  CRISPR gRNA sequence
tcaggacccctcatccccca

SEQ ID NO: 130 - DNA, 20 bp, Artificial
  CRISPR gRNA sequence
gacccctcatcccccacgga

SEQ ID NO: 131 - DNA, 20 bp, Artificial
  CRISPR gRNA sequence
acccctcatcccccacggac

SEQ ID NO: 132 - DNA, 20 bp, Artificial
  CRISPR gRNA sequence
ctcatcccccacggacgggc

SEQ ID NO: 133 - DNA, 20 bp, Artificial
  CRISPR gRNA sequence
tcatcccccacggacgggcc

SEQ ID NO: 134 - DNA, 20 bp, Artificial
  CRISPR gRNA sequence
cggacgggccaggtcgccca

SEQ ID NO: 135 - DNA, 20 bp, Artificial
  CRISPR gRNA sequence
gccaggtcgcccacagtctc

SEQ ID NO: 136 - DNA, 20 bp, Artificial
  CRISPR gRNA sequence
ccaggtcgcccacagtctcc

SEQ ID NO: 137 - DNA, 20 bp, Artificial
  CRISPR gRNA sequence
cgcccacagtctccgggtcc

SEQ ID NO: 138 - DNA, 20 bp, Artificial
  CRISPR gRNA sequence
cgggtccgagatccaccccg

SEQ ID NO: 139 - DNA, 20 bp, Artificial
  CRISPR gRNA sequence
cgagatccaccccgaagccg

SEQ ID NO: 140 - DNA, 20 bp, Artificial
  CRISPR gRNA sequence
gagatccaccccgaagccgc

SEQ ID NO: 141 - DNA, 20 bp, Artificial
  CRISPR gRNA sequence
ccccgaagccgcgggacccc

SEQ ID NO: 142 - DNA, 20 bp, Artificial
  CRISPR gRNA sequence
ggaccccgagacccttgccc

SEQ ID NO: 143 - DNA, 20 bp, Artificial
  CRISPR gRNA sequence
gaccccgagacccttgcccc

SEQ ID NO: 144 - DNA, 20 bp, Artificial
  CRISPR gRNA sequence
ccccgagacccttgccccgg

SEQ ID NO: 145 - DNA, 20 bp, Artificial
  CRISPR gRNA sequence
ccgagacccttgccccggga

SEQ ID NO: 146 - DNA, 20 bp, Artificial
  CRISPR gRNA sequence
cgagacccttgccccgggag

SEQ ID NO: 147 - DNA, 20 bp, Artificial
  CRISPR gRNA sequence
cccttgccccgggagaggcc

SEQ ID NO: 148 - DNA, 20 bp, Artificial
  CRISPR gRNA sequence
ccttgccccgggagaggccc

SEQ ID NO: 149 - DNA, 20 bp, Artificial
  CRISPR gRNA sequence
gaggcccaggcgcctttacc

SEQ ID NO: 150 - DNA, 20 bp, Artificial
  CRISPR gRNA sequence
cctttacccggtttcatttt

SEQ ID NO: 151 - DNA, 20 bp, Artificial
  CRISPR gRNA sequence
acccggtttcattttcagtt

SEQ ID NO: 152 - DNA, 20 bp, Artificial
  CRISPR gRNA sequence
cccggtttcattttcagttt

SEQ ID NO: 153 - DNA, 20 bp, Artificial
  CRISPR gRNA sequence
gtttaggccaaaaatccccc

SEQ ID NO: 154 - DNA, 20 bp, Artificial
  CRISPR gRNA sequence
tttaggccaaaaatcccccc

SEQ ID NO: 155 - DNA, 20 bp, Artificial
  CRISPR gRNA sequence
ggccaaaaatccccccgggt

SEQ ID NO: 156 - DNA, 20 bp, Artificial
  CRISPR gRNA sequence
aaaaatccccccgggttggt

SEQ ID NO: 157 - DNA, 20 bp, Artificial
  CRISPR gRNA sequence
aaaatccccccgggttggtc

SEQ ID NO: 158 - DNA, 20 bp, Artificial
  CRISPR gRNA sequence
aaatccccccgggttggtcg

SEQ ID NO: 159 - DNA, 20 bp, Artificial
  CRISPR gRNA sequence
ccccccgggttggtcggggc

SEQ ID NO: 160 - DNA, 20 bp, Artificial
  CRISPR gRNA sequence
cccccgggttggtcggggct

SEQ ID NO: 161 - DNA, 20 bp, Artificial
  CRISPR gRNA sequence
ccgggttggtcggggctggg

SEQ ID NO: 162 - DNA, 20 bp, Artificial
  CRISPR gRNA sequence
cgggttggtcggggctgggc

SEQ ID NO: 163 - DNA, 20 bp, Artificial
  CRISPR gRNA sequence
gggttggtcggggctgggcg

SEQ ID NO: 164 - DNA, 20 bp, Artificial
  CRISPR gRNA sequence
ggtcggggctgggcggggct

SEQ ID NO: 165 - DNA, 20 bp, Artificial
  CRISPR gRNA sequence
gtcggggctgggcggggctc

SEQ ID NO: 166 - DNA, 20 bp, Artificial
  CRISPR gRNA sequence
tcggggctgggcggggctcg

SEQ ID NO: 167 - DNA, 20 bp, Artificial
  CRISPR gRNA sequence
cggggctgggcggggctcgg

SEQ ID NO: 168 - DNA, 20 bp, Artificial
  CRISPR gRNA sequence
ctgggcggggctcgggggac

SEQ ID NO: 169 - DNA, 20 bp, Artificial
  CRISPR gRNA sequence
tgggcggggctcgggggact

SEQ ID NO: 170 - DNA, 20 bp, Artificial
  CRISPR gRNA sequence
tcgggggactgggctgaccg

SEQ ID NO: 171 - DNA, 20 bp, Artificial
  CRISPR gRNA sequence
cgggggactgggctgaccgc

SEQ ID NO: 172 - DNA, 20 bp, Artificial
  CRISPR gRNA sequence
gggggactgggctgaccgcg

SEQ ID NO: 173 - DNA, 20 bp, Artificial
  CRISPR gRNA sequence
gactgggctgaccgcggggt

SEQ ID NO: 174 - DNA, 20 bp, Artificial
  CRISPR gRNA sequence
actgggctgaccgcggggtc

SEQ ID NO: 175 - DNA, 20 bp, Artificial
  CRISPR gRNA sequence
ctgggctgaccgcggggtcg

SEQ ID NO: 176 - DNA, 20 bp, Artificial
  CRISPR gRNA sequence
gctgaccgcggggtcggggc

SEQ ID NO: 177 - DNA, 20 bp, Artificial
  CRISPR gRNA sequence
ctgaccgcggggtcggggcc

SEQ ID NO: 178 - DNA, 20 bp, Artificial
  CRISPR gRNA sequence
ggccaggttctcacaccatc

SEQ ID NO: 179 - DNA, 20 bp, Artificial
  CRISPR gRNA sequence
cacaccatccagataatgta

SEQ ID NO: 180 - DNA, 20 bp, Artificial
  CRISPR gRNA sequence
gataatgtatggctgcgacg

SEQ ID NO: 181 - DNA, 20 bp, Artificial
  CRISPR gRNA sequence
ataatgtatggctgcgacgt

SEQ ID NO: 182 - DNA, 20 bp, Artificial
  CRISPR gRNA sequence
taatgtatggctgcgacgtg

SEQ ID NO: 183 - DNA, 20 bp, Artificial
  CRISPR gRNA sequence
gtatggctgcgacgtggggt

SEQ ID NO: 184 - DNA, 20 bp, Artificial
  CRISPR gRNA sequence
ggctgcgacgtggggtcgga

SEQ ID NO: 185 - DNA, 20 bp, Artificial
  CRISPR gRNA sequence
gctgcgacgtggggtcggac

SEQ ID NO: 186 - DNA, 20 bp, Artificial
  CRISPR gRNA sequence
tcggacgggcgcttcctccg

SEQ ID NO: 187 - DNA, 20 bp, Artificial
  CRISPR gRNA sequence
cggacgggcgcttcctccgc

SEQ ID NO: 188 - DNA, 20 bp, Artificial
  CRISPR gRNA sequence
ggcgcttcctccgcgggtac

SEQ ID NO: 189 - DNA, 20 bp, Artificial
  CRISPR gRNA sequence
gcttcctccgcgggtaccgg

SEQ ID NO: 190 - DNA, 20 bp, Artificial
  CRISPR gRNA sequence
cttcctccgcgggtaccggc

SEQ ID NO: 191 - DNA, 20 bp, Artificial
  CRISPR gRNA sequence
taccggcaggacgcctacga

SEQ ID NO: 192 - DNA, 20 bp, Artificial
  CRISPR gRNA sequence
ggcaggacgcctacgacggc

SEQ ID NO: 193 - DNA, 20 bp, Artificial
  CRISPR gRNA sequence
gcaggacgcctacgacggca

SEQ ID NO: 194 - DNA, 20 bp, Artificial
  CRISPR gRNA sequence
aggattacatcgccctgaac

SEQ ID NO: 195 - DNA, 20 bp, Artificial
  CRISPR gRNA sequence
ggattacatcgccctgaacg

SEQ ID NO: 196 - DNA, 20 bp, Artificial
  CRISPR gRNA sequence
tgaacgaggacctgcgctct

SEQ ID NO: 197 - DNA, 20 bp, Artificial
  CRISPR gRNA sequence
ggacctgcgctcttggaccg

SEQ ID NO: 198 - DNA, 20 bp, Artificial
  CRISPR gRNA sequence
cctgcgctcttggaccgcgg

SEQ ID NO: 199 - DNA, 20 bp, Artificial
  CRISPR gRNA sequence
ctcttggaccgcggcggaca

SEQ ID NO: 200 - DNA, 20 bp, Artificial
  CRISPR gRNA sequence
ttggaccgcggcggacatgg

SEQ ID NO: 201 - DNA, 20 bp, Artificial
  CRISPR gRNA sequence
ccgcggcggacatggcggct

SEQ ID NO: 202 - DNA, 20 bp, Artificial
  CRISPR gRNA sequence
acatggcggctcagatcacc

SEQ ID NO: 203 - DNA, 20 bp, Artificial
  CRISPR gRNA sequence
cggctcagatcaccaagcgc

SEQ ID NO: 204 - DNA, 20 bp, Artificial
  CRISPR gRNA sequence
ctcagatcaccaagcgcaag

SEQ ID NO: 205 - DNA, 20 bp, Artificial
  CRISPR gRNA sequence
tcagatcaccaagcgcaagt

SEQ ID NO: 206 - DNA, 20 bp, Artificial
  CRISPR gRNA sequence
agatcaccaagcgcaagtgg

SEQ ID NO: 207 - DNA, 20 bp, Artificial
  CRISPR gRNA sequence
gatcaccaagcgcaagtggg

SEQ ID NO: 208 - DNA, 20 bp, Artificial
  CRISPR gRNA sequence
caccaagcgcaagtgggagg

SEQ ID NO: 209 - DNA, 20 bp, Artificial
  CRISPR gRNA sequence
gcaagtgggaggcggcccat

SEQ ID NO: 210 - DNA, 20 bp, Artificial
  CRISPR gRNA sequence
caagtgggaggcggcccatg

SEQ ID NO: 211 - DNA, 20 bp, Artificial
  CRISPR gRNA sequence
gtgggaggcggcccatgagg

SEQ ID NO: 212 - DNA, 20 bp, Artificial
  CRISPR gRNA sequence
gggaggcggcccatgaggcg

SEQ ID NO: 213 - DNA, 20 bp, Artificial
  CRISPR gRNA sequence
aggcggcccatgaggcggag

SEQ ID NO: 214 - DNA, 20 bp, Artificial
  CRISPR gRNA sequence
gcccatgaggcggagcagtt

SEQ ID NO: 215 - DNA, 20 bp, Artificial
  CRISPR gRNA sequence
ccatgaggcggagcagttga

SEQ ID NO: 216 - DNA, 20 bp, Artificial
  CRISPR gRNA sequence
ggagcagttgagagcctacc

SEQ ID NO: 217 - DNA, 20 bp, Artificial
  CRISPR gRNA sequence
cagttgagagcctacctgga

SEQ ID NO: 218 - DNA, 20 bp, Artificial
  CRISPR gRNA sequence
ctacctggatggcacgtgcg

SEQ ID NO: 219 - DNA, 20 bp, Artificial
  CRISPR gRNA sequence
acctggatggcacgtgcgtg

SEQ ID NO: 220 - DNA, 20 bp, Artificial
  CRISPR gRNA sequence
tggatggcacgtgcgtggag

SEQ ID NO: 221 - DNA, 20 bp, Artificial
  CRISPR gRNA sequence
acgtgcgtggagtggctccg

SEQ ID NO: 222 - DNA, 20 bp, Artificial
  CRISPR gRNA sequence
ggagtggctccgcagatacc

SEQ ID NO: 223 - DNA, 20 bp, Artificial
  CRISPR gRNA sequence
agtggctccgcagatacctg

SEQ ID NO: 224 - DNA, 20 bp, Artificial
  CRISPR gRNA sequence
ctccgcagatacctggagaa

SEQ ID NO: 225 - DNA, 20 bp, Artificial
  CRISPR gRNA sequence
tccgcagatacctggagaac

SEQ ID NO: 226 - DNA, 20 bp, Artificial
  CRISPR gRNA sequence
gcagatacctggagaacggg

SEQ ID NO: 227 - DNA, 20 bp, Artificial
  CRISPR gRNA sequence
cagatacctggagaacggga

SEQ ID NO: 228 - DNA, 20 bp, Artificial
  CRISPR gRNA sequence
gatacctggagaacgggaag

SEQ ID NO: 229 - DNA, 20 bp, Artificial
  CRISPR gRNA sequence
agaacgggaaggagacgctg

SEQ ID NO: 230 - DNA, 20 bp, Artificial
  CRISPR gRNA sequence
gaaggagacgctgcagcgca

SEQ ID NO: 231 - DNA, 20 bp, Artificial
  CRISPR gRNA sequence
aaggagacgctgcagcgcac

SEQ ID NO: 232 - DNA, 20 bp, Artificial
  CRISPR gRNA sequence
acgctgcagcgcacgggtac

SEQ ID NO: 233 - DNA, 20 bp, Artificial
  CRISPR gRNA sequence
cgctgcagcgcacgggtacc

SEQ ID NO: 234 - DNA, 20 bp, Artificial
  CRISPR gRNA sequence
gctgcagcgcacgggtacca

SEQ ID NO: 235 - DNA, 20 bp, Artificial
  CRISPR gRNA sequence
ctgcagcgcacgggtaccag

SEQ ID NO: 236 - DNA, 20 bp, Artificial
  CRISPR gRNA sequence
cgcacgggtaccaggggcca

SEQ ID NO: 237 - DNA, 20 bp, Artificial
  CRISPR gRNA sequence
gcacgggtaccaggggccac

SEQ ID NO: 238 - DNA, 20 bp, Artificial
  CRISPR gRNA sequence
cacgggtaccaggggccacg

SEQ ID NO: 239 - DNA, 20 bp, Artificial
  CRISPR gRNA sequence
ggcgcctccctgatcgcctg

SEQ ID NO: 240 - DNA, 20 bp, Artificial
  CRISPR gRNA sequence
ctgatcgcctgtagatctcc

SEQ ID NO: 241 - DNA, 20 bp, Artificial
  CRISPR gRNA sequence
tgatcgcctgtagatctccc

SEQ ID NO: 242 - DNA, 20 bp, Artificial
  CRISPR gRNA sequence
cgcctgtagatctcccgggc

SEQ ID NO: 243 - DNA, 20 bp, Artificial
  CRISPR gRNA sequence
ctcccgggctggcctcccac

SEQ ID NO: 244 - DNA, 20 bp, Artificial
  CRISPR gRNA sequence
tcccgggctggcctcccaca

SEQ ID NO: 245 - DNA, 20 bp, Artificial
  CRISPR gRNA sequence
ccgggctggcctcccacaag

SEQ ID NO: 246 - DNA, 20 bp, Artificial
  CRISPR gRNA sequence
cgggctggcctcccacaagg

SEQ ID NO: 247 - DNA, 20 bp, Artificial
  CRISPR gRNA sequence
gggctggcctcccacaagga

SEQ ID NO: 248 - DNA, 20 bp, Artificial
  CRISPR gRNA sequence
ggctggcctcccacaaggag

SEQ ID NO: 249 - DNA, 20 bp, Artificial
  CRISPR gRNA sequence
ctggcctcccacaaggaggg

SEQ ID NO: 250 - DNA, 20 bp, Artificial
  CRISPR gRNA sequence
ccacaaggaggggagacaat

SEQ ID NO: 251 - DNA, 20 bp, Artificial
  CRISPR gRNA sequence
cacaaggaggggagacaatt

SEQ ID NO: 252 - DNA, 20 bp, Artificial
  CRISPR gRNA sequence
gagacaattgggaccaacac

SEQ ID NO: 253 - DNA, 20 bp, Artificial
  CRISPR gRNA sequence
ctagaatatcaccctccctc

SEQ ID NO: 254 - DNA, 20 bp, Artificial
  CRISPR gRNA sequence
atcaccctccctctggtcct

SEQ ID NO: 255 - DNA, 20 bp, Artificial
  CRISPR gRNA sequence
tcaccctccctctggtcctg

SEQ ID NO: 256 - DNA, 20 bp, Artificial
  CRISPR gRNA sequence
caccctccctctggtcctga

SEQ ID NO: 257 - DNA, 20 bp, Artificial
  CRISPR gRNA sequence
ccctccctctggtcctgagg

SEQ ID NO: 258 - DNA, 20 bp, Artificial
  CRISPR gRNA sequence
ctccctctggtcctgaggga

SEQ ID NO: 259 - DNA, 20 bp, Artificial
  CRISPR gRNA sequence
tccctctggtcctgagggag

SEQ ID NO: 260 - DNA, 20 bp, Artificial
  CRISPR gRNA sequence
ctgagggagaggaatcctcc

SEQ ID NO: 261 - DNA, 20 bp, Artificial
  CRISPR gRNA sequence
tgagggagaggaatcctcct

SEQ ID NO: 262 - DNA, 20 bp, Artificial
  CRISPR gRNA sequence
agaggaatcctcctgggttc

SEQ ID NO: 263 - DNA, 20 bp, Artificial
  CRISPR gRNA sequence
ctgggttccagatcctgtac

SEQ ID NO: 264 - DNA, 20 bp, Artificial
  CRISPR gRNA sequence
gggttccagatcctgtacca

SEQ ID NO: 265 - DNA, 20 bp, Artificial
  CRISPR gRNA sequence
gttccagatcctgtaccaga

SEQ ID NO: 266 - DNA, 20 bp, Artificial
  CRISPR gRNA sequence
ctgtaccagagagtgactct

SEQ ID NO: 267 - DNA, 20 bp, Artificial
  CRISPR gRNA sequence
tgtaccagagagtgactctg

SEQ ID NO: 268 - DNA, 20 bp, Artificial
  CRISPR gRNA sequence
ccctgctctctgacacaatt

SEQ ID NO: 269 - DNA, 20 bp, Artificial
  CRISPR gRNA sequence
cctgctctctgacacaatta

SEQ ID NO: 270 - DNA, 20 bp, Artificial
  CRISPR gRNA sequence
ctgctctctgacacaattaa

SEQ ID NO: 271 - DNA, 20 bp, Artificial
  CRISPR gRNA sequence
attaagggataaaatctctg

SEQ ID NO: 272 - DNA, 20 bp, Artificial
  CRISPR gRNA sequence
ttaagggataaaatctctga

SEQ ID NO: 273 - DNA, 20 bp, Artificial
  CRISPR gRNA sequence
aagggataaaatctctgaag

SEQ ID NO: 274 - DNA, 20 bp, Artificial
  CRISPR gRNA sequence
taaaatctctgaaggagtga

SEQ ID NO: 275 - DNA, 20 bp, Artificial
  CRISPR gRNA sequence
aaaatctctgaaggagtgac

SEQ ID NO: 276 - DNA, 20 bp, Artificial
  CRISPR gRNA sequence
atctctgaaggagtgacggg

SEQ ID NO: 277 - DNA, 20 bp, Artificial
  CRISPR gRNA sequence
acgatccctcgaatactgat

SEQ ID NO: 278 - DNA, 20 bp, Artificial
  CRISPR gRNA sequence
atccctcgaatactgatgag

SEQ ID NO: 279 - DNA, 20 bp, Artificial
  CRISPR gRNA sequence
tgagtggttccctttgacac

SEQ ID NO: 280 - DNA, 20 bp, Artificial
  CRISPR gRNA sequence
gtggttccctttgacaccgg

SEQ ID NO: 281 - DNA, 20 bp, Artificial
  CRISPR gRNA sequence
gttccctttgacaccggcag

SEQ ID NO: 282 - DNA, 20 bp, Artificial
  CRISPR gRNA sequence
tttgacaccggcagcagcct

SEQ ID NO: 283 - DNA, 20 bp, Artificial
  CRISPR gRNA sequence
ttgacaccggcagcagcctt

SEQ ID NO: 284 - DNA, 20 bp, Artificial
  CRISPR gRNA sequence
gggcccgtgacttttcctct

SEQ ID NO: 285 - DNA, 20 bp, Artificial
  CRISPR gRNA sequence
ggcccgtgacttttcctctc

SEQ ID NO: 286 - DNA, 20 bp, Artificial
  CRISPR gRNA sequence
tgcttcacactcaatgtgtg

SEQ ID NO: 287 - DNA, 20 bp, Artificial
  CRISPR gRNA sequence
gcttcacactcaatgtgtgt

SEQ ID NO: 288 - DNA, 20 bp, Artificial
  CRISPR gRNA sequence
cttcacactcaatgtgtgtg

SEQ ID NO: 289 - DNA, 20 bp, Artificial
  CRISPR gRNA sequence
ttcacactcaatgtgtgtgg

SEQ ID NO: 290 - DNA, 20 bp, Artificial
  CRISPR gRNA sequence
ctcaatgtgtgtgggggtct

SEQ ID NO: 291 - DNA, 20 bp, Artificial
  CRISPR gRNA sequence
tgtgtgtgggggtctgagtc

SEQ ID NO: 292 - DNA, 20 bp, Artificial
  CRISPR gRNA sequence
ggtctgagtccagcacttct

SEQ ID NO: 293 - DNA, 20 bp, Artificial
  CRISPR gRNA sequence
tccagcacttctgagtccct

SEQ ID NO: 294 - DNA, 20 bp, Artificial
  CRISPR gRNA sequence
tgagtccctcagcctccact

SEQ ID NO: 295 - DNA, 20 bp, Artificial
  CRISPR gRNA sequence
gagtccctcagcctccactc

SEQ ID NO: 296 - DNA, 20 bp, Artificial
  CRISPR gRNA sequence
ccctcagcctccactcaggt

SEQ ID NO: 297 - DNA, 20 bp, Artificial
  CRISPR gRNA sequence
cctcagcctccactcaggtc

SEQ ID NO: 298 - DNA, 20 bp, Artificial
  CRISPR gRNA sequence
gcctccactcaggtcaggac

SEQ ID NO: 299 - DNA, 20 bp, Artificial
  CRISPR gRNA sequence
tccactcaggtcaggaccag

SEQ ID NO: 300 - DNA, 20 bp, Artificial
  CRISPR gRNA sequence
agaagtcgctgttcccttct

SEQ ID NO: 301 - DNA, 20 bp, Artificial
  CRISPR gRNA sequence
gaagtcgctgttcccttctc

SEQ ID NO: 302 - DNA, 20 bp, Artificial
  CRISPR gRNA sequence
aagtcgctgttcccttctca

SEQ ID NO: 303 - DNA, 20 bp, Artificial
  CRISPR gRNA sequence
gctgttcccttctcagggaa

SEQ ID NO: 304 - DNA, 20 bp, Artificial
  CRISPR gRNA sequence
gttcccttctcagggaatag

SEQ ID NO: 305 - DNA, 20 bp, Artificial
  CRISPR gRNA sequence
cagggaatagaagattatcc

SEQ ID NO: 306 - DNA, 20 bp, Artificial
  CRISPR gRNA sequence
agggaatagaagattatccc

SEQ ID NO: 307 - DNA, 20 bp, Artificial
  CRISPR gRNA sequence
ttatcccaggtgcctgtgtc

SEQ ID NO: 308 - DNA, 20 bp, Artificial
  CRISPR gRNA sequence
tatcccaggtgcctgtgtcc

SEQ ID NO: 309 - DNA, 20 bp, Artificial
  CRISPR gRNA sequence
ccaggtgcctgtgtccaggc

SEQ ID NO: 310 - DNA, 20 bp, Artificial
  CRISPR gRNA sequence
cctgtgtccaggctggtgtc

SEQ ID NO: 311 - DNA, 20 bp, Artificial
  CRISPR gRNA sequence
ctgtgtccaggctggtgtct

SEQ ID NO: 312 - DNA, 20 bp, Artificial
  CRISPR gRNA sequence
ctgtgctctcttccccatcc

SEQ ID NO: 313 - DNA, 20 bp, Artificial
  CRISPR gRNA sequence
tgtgctctcttccccatccc

SEQ ID NO: 314 - DNA, 20 bp, Artificial
  CRISPR gRNA sequence
cgggtgtcctgtccattctc

SEQ ID NO: 315 - DNA, 20 bp, Artificial
  CRISPR gRNA sequence
tgtcctgtccattctcaaga

SEQ ID NO: 316 - DNA, 20 bp, Artificial
  CRISPR gRNA sequence
caagatggccacatgcgtgc

SEQ ID NO: 317 - DNA, 20 bp, Artificial
  CRISPR gRNA sequence
gatggccacatgcgtgctgg

SEQ ID NO: 318 - DNA, 20 bp, Artificial
  CRISPR gRNA sequence
tggccacatgcgtgctggtg

SEQ ID NO: 319 - DNA, 20 bp, Artificial
  CRISPR gRNA sequence
gctggtggagtgtcccatga

SEQ ID NO: 320 - DNA, 20 bp, Artificial
  CRISPR gRNA sequence
aattttctgactcttcccgt

SEQ ID NO: 321 - DNA, 20 bp, Artificial
  CRISPR gRNA sequence
tcttcccgtcagaccccccc

SEQ ID NO: 322 - DNA, 20 bp, Artificial
  CRISPR gRNA sequence
accaccccatctctgaccat

SEQ ID NO: 323 - DNA, 20 bp, Artificial
  CRISPR gRNA sequence
ccaccccatctctgaccatg

SEQ ID NO: 324 - DNA, 20 bp, Artificial
  CRISPR gRNA sequence
tctgaccatgaggccaccct

SEQ ID NO: 325 - DNA, 20 bp, Artificial
  CRISPR gRNA sequence
ctgaccatgaggccaccctg

SEQ ID NO: 326 - DNA, 20 bp, Artificial
  CRISPR gRNA sequence
atgaggccaccctgaggtgc

SEQ ID NO: 327 - DNA, 20 bp, Artificial
  CRISPR gRNA sequence
tgaggccaccctgaggtgct

SEQ ID NO: 328 - DNA, 20 bp, Artificial
  CRISPR gRNA sequence
caccctgaggtgctgggccc

SEQ ID NO: 329 - DNA, 20 bp, Artificial
  CRISPR gRNA sequence
accctgaggtgctgggccct

SEQ ID NO: 330 - DNA, 20 bp, Artificial
  CRISPR gRNA sequence
ggccctgggcttctaccctg

SEQ ID NO: 331 - DNA, 20 bp, Artificial
  CRISPR gRNA sequence
ccctgggcttctaccctgcg

SEQ ID NO: 332 - DNA, 20 bp, Artificial
  CRISPR gRNA sequence
ctgcggagatcacactgacc

SEQ ID NO: 333 - DNA, 20 bp, Artificial
  CRISPR gRNA sequence
cggagatcacactgacctgg

SEQ ID NO: 334 - DNA, 20 bp, Artificial
  CRISPR gRNA sequence
agatcacactgacctggcag

SEQ ID NO: 335 - DNA, 20 bp, Artificial
  CRISPR gRNA sequence
gatcacactgacctggcagc

SEQ ID NO: 336 - DNA, 20 bp, Artificial
  CRISPR gRNA sequence
acactgacctggcagcggga

SEQ ID NO: 337 - DNA, 20 bp, Artificial
  CRISPR gRNA sequence
cactgacctggcagcgggat

SEQ ID NO: 338 - DNA, 20 bp, Artificial
  CRISPR gRNA sequence
actgacctggcagcgggatg

SEQ ID NO: 339 - DNA, 20 bp, Artificial
  CRISPR gRNA sequence
tgacctggcagcgggatggg

SEQ ID NO: 340 - DNA, 20 bp, Artificial
  CRISPR gRNA sequence
gacctggcagcgggatgggg

SEQ ID NO: 341 - DNA, 20 bp, Artificial
  CRISPR gRNA sequence
ggcagcgggatggggaggac

SEQ ID NO: 342 - DNA, 20 bp, Artificial
  CRISPR gRNA sequence
gggatggggaggaccagacc

SEQ ID NO: 343 - DNA, 20 bp, Artificial
  CRISPR gRNA sequence
ggatggggaggaccagaccc

SEQ ID NO: 344 - DNA, 20 bp, Artificial
  CRISPR gRNA sequence
ggaggaccagacccaggaca

SEQ ID NO: 345 - DNA, 20 bp, Artificial
  CRISPR gRNA sequence
aggaccagacccaggacacg

SEQ ID NO: 346 - DNA, 20 bp, Artificial
  CRISPR gRNA sequence
gacccaggacacggagctcg

SEQ ID NO: 347 - DNA, 20 bp, Artificial
  CRISPR gRNA sequence
cccaggacacggagctcgtg

SEQ ID NO: 348 - DNA, 20 bp, Artificial
  CRISPR gRNA sequence
gacacggagctcgtggagac

SEQ ID NO: 349 - DNA, 20 bp, Artificial
  CRISPR gRNA sequence
acacggagctcgtggagacc

SEQ ID NO: 350 - DNA, 20 bp, Artificial
  CRISPR gRNA sequence
gctcgtggagaccaggcctg

SEQ ID NO: 351 - DNA, 20 bp, Artificial
  CRISPR gRNA sequence
ctcgtggagaccaggcctgc

SEQ ID NO: 352 - DNA, 20 bp, Artificial
  CRISPR gRNA sequence
tcgtggagaccaggcctgca

SEQ ID NO: 353 - DNA, 20 bp, Artificial
  CRISPR gRNA sequence
cgtggagaccaggcctgcag

SEQ ID NO: 354 - DNA, 20 bp, Artificial
  CRISPR gRNA sequence
gagaccaggcctgcagggga

SEQ ID NO: 355 - DNA, 20 bp, Artificial
  CRISPR gRNA sequence
ctgcaggggatggaaccttc

SEQ ID NO: 356 - DNA, 20 bp, Artificial
  CRISPR gRNA sequence
caggggatggaaccttccag

SEQ ID NO: 357 - DNA, 20 bp, Artificial
  CRISPR gRNA sequence
gggatggaaccttccagaag

SEQ ID NO: 358 - DNA, 20 bp, Artificial
  CRISPR gRNA sequence
ggatggaaccttccagaagt

SEQ ID NO: 359 - DNA, 20 bp, Artificial
  CRISPR gRNA sequence
tggaaccttccagaagtggg

SEQ ID NO: 360 - DNA, 20 bp, Artificial
  CRISPR gRNA sequence
cttccagaagtgggcggctg

SEQ ID NO: 361 - DNA, 20 bp, Artificial
  CRISPR gRNA sequence
ccagaagtgggcggctgtgg

SEQ ID NO: 362 - DNA, 20 bp, Artificial
  CRISPR gRNA sequence
gcggctgtggtggtgccttc

SEQ ID NO: 363 - DNA, 20 bp, Artificial
  CRISPR gRNA sequence
ggctgtggtggtgccttctg

SEQ ID NO: 364 - DNA, 20 bp, Artificial
  CRISPR gRNA sequence
ctgtggtggtgccttctgga

SEQ ID NO: 365 - DNA, 20 bp, Artificial
  CRISPR gRNA sequence
tgtggtggtgccttctggag

SEQ ID NO: 366 - DNA, 20 bp, Artificial
  CRISPR gRNA sequence
tggtggtgccttctggagag

SEQ ID NO: 367 - DNA, 20 bp, Artificial
  CRISPR gRNA sequence
tggtgccttctggagaggag

SEQ ID NO: 368 - DNA, 20 bp, Artificial
  CRISPR gRNA sequence
gtgccttctggagaggagca

SEQ ID NO: 369 - DNA, 20 bp, Artificial
  CRISPR gRNA sequence
agagatacacctgccatgtg

SEQ ID NO: 370 - DNA, 20 bp, Artificial
  CRISPR gRNA sequence
acacctgccatgtgcagcat

SEQ ID NO: 371 - DNA, 20 bp, Artificial
  CRISPR gRNA sequence
cacctgccatgtgcagcatg

SEQ ID NO: 372 - DNA, 20 bp, Artificial
  CRISPR gRNA sequence
acctgccatgtgcagcatga

SEQ ID NO: 373 - DNA, 20 bp, Artificial
  CRISPR gRNA sequence
tgcagcatgagggtctgccc

SEQ ID NO: 374 - DNA, 20 bp, Artificial
  CRISPR gRNA sequence
ctgcccaagcccctcaccct

SEQ ID NO: 375 - DNA, 20 bp, Artificial
  CRISPR gRNA sequence
ccaagcccctcaccctgaga

SEQ ID NO: 376 - DNA, 20 bp, Artificial
  CRISPR gRNA sequence
caagcccctcaccctgagat

SEQ ID NO: 377 - DNA, 20 bp, Artificial
  CRISPR gRNA sequence
aagcccctcaccctgagatg

SEQ ID NO: 378 - DNA, 20 bp, Artificial
  CRISPR gRNA sequence
ccctcaccctgagatggggt

SEQ ID NO: 379 - DNA, 20 bp, Artificial
  CRISPR gRNA sequence
cctcaccctgagatggggta

SEQ ID NO: 380 - DNA, 20 bp, Artificial
  CRISPR gRNA sequence
tcaccctgagatggggtaag

SEQ ID NO: 381 - DNA, 20 bp, Artificial
  CRISPR gRNA sequence
caccctgagatggggtaagg

SEQ ID NO: 382 - DNA, 20 bp, Artificial
  CRISPR gRNA sequence
accctgagatggggtaagga

SEQ ID NO: 383 - DNA, 20 bp, Artificial
  CRISPR gRNA sequence
cctgagatggggtaaggagg

SEQ ID NO: 384 - DNA, 20 bp, Artificial
  CRISPR gRNA sequence
agatggggtaaggagggaga

SEQ ID NO: 385 - DNA, 20 bp, Artificial
  CRISPR gRNA sequence
gatggggtaaggagggagat

SEQ ID NO: 386 - DNA, 20 bp, Artificial
  CRISPR gRNA sequence
atggggtaaggagggagatg

SEQ ID NO: 387 - DNA, 20 bp, Artificial
  CRISPR gRNA sequence
tggggtaaggagggagatgg

SEQ ID NO: 388 - DNA, 20 bp, Artificial
  CRISPR gRNA sequence
gatgggggtgtcatgtctct

SEQ ID NO: 389 - DNA, 20 bp, Artificial
  CRISPR gRNA sequence
atgggggtgtcatgtctctt

SEQ ID NO: 390 - DNA, 20 bp, Artificial
  CRISPR gRNA sequence
tgggggtgtcatgtctctta

SEQ ID NO: 391 - DNA, 20 bp, Artificial
  CRISPR gRNA sequence
ggtgtcatgtctcttaggga

SEQ ID NO: 392 - DNA, 20 bp, Artificial
  CRISPR gRNA sequence
gtcatgtctcttagggaaag

SEQ ID NO: 393 - DNA, 20 bp, Artificial
  CRISPR gRNA sequence
tcatgtctcttagggaaagc

SEQ ID NO: 394 - DNA, 20 bp, Artificial
  CRISPR gRNA sequence
atgtctcttagggaaagcag

SEQ ID NO: 395 - DNA, 20 bp, Artificial
  CRISPR gRNA sequence
agggaaagcaggagcctctc

SEQ ID NO: 396 - DNA, 20 bp, Artificial
  CRISPR gRNA sequence
ggaaagcaggagcctctctg

SEQ ID NO: 397 - DNA, 20 bp, Artificial
  CRISPR gRNA sequence
ggagcctctctggagacctt

SEQ ID NO: 398 - DNA, 20 bp, Artificial
  CRISPR gRNA sequence
gcctctctggagacctttag

SEQ ID NO: 399 - DNA, 20 bp, Artificial
  CRISPR gRNA sequence
cctctctggagacctttagc

SEQ ID NO: 400 - DNA, 20 bp, Artificial
  CRISPR gRNA sequence
ctctctggagacctttagca

SEQ ID NO: 401 - DNA, 20 bp, Artificial
  CRISPR gRNA sequence
ctggagacctttagcagggt

SEQ ID NO: 402 - DNA, 20 bp, Artificial
  CRISPR gRNA sequence
tggagacctttagcagggtc

SEQ ID NO: 403 - DNA, 20 bp, Artificial
  CRISPR gRNA sequence
ggagacctttagcagggtca

SEQ ID NO: 404 - DNA, 20 bp, Artificial
  CRISPR gRNA sequence
ctcaccttcccctcttttcc

SEQ ID NO: 405 - DNA, 20 bp, Artificial
  CRISPR gRNA sequence
caccttcccctcttttccca

SEQ ID NO: 406 - DNA, 20 bp, Artificial
  CRISPR gRNA sequence
ttttcccagagctgtcttcc

SEQ ID NO: 407 - DNA, 20 bp, Artificial
  CRISPR gRNA sequence
ccagcccaccatccccatcg

SEQ ID NO: 408 - DNA, 20 bp, Artificial
  CRISPR gRNA sequence
cagcccaccatccccatcgt

SEQ ID NO: 409 - DNA, 20 bp, Artificial
  CRISPR gRNA sequence
cccatcgtgggcatcattgc

SEQ ID NO: 410 - DNA, 20 bp, Artificial
  CRISPR gRNA sequence
cgtgggcatcattgctggcc

SEQ ID NO: 411 - DNA, 20 bp, Artificial
  CRISPR gRNA sequence
attgctggcctggttctcct

SEQ ID NO: 412 - DNA, 20 bp, Artificial
  CRISPR gRNA sequence
tgctggcctggttctccttg

SEQ ID NO: 413 - DNA, 20 bp, Artificial
  CRISPR gRNA sequence
ctccttggagctgtgatcac

SEQ ID NO: 414 - DNA, 20 bp, Artificial
  CRISPR gRNA sequence
ccttggagctgtgatcactg

SEQ ID NO: 415 - DNA, 20 bp, Artificial
  CRISPR gRNA sequence
agctgtgatcactggagctg

SEQ ID NO: 416 - DNA, 20 bp, Artificial
  CRISPR gRNA sequence
ctgtggtcgctgccgtgatg

SEQ ID NO: 417 - DNA, 20 bp, Artificial
  CRISPR gRNA sequence
gtggtcgctgccgtgatgtg

SEQ ID NO: 418 - DNA, 20 bp, Artificial
  CRISPR gRNA sequence
tggtcgctgccgtgatgtgg

SEQ ID NO: 419 - DNA, 20 bp, Artificial
  CRISPR gRNA sequence
gtcgctgccgtgatgtggag

SEQ ID NO: 420 - DNA, 20 bp, Artificial
  CRISPR gRNA sequence
tcgctgccgtgatgtggagg

SEQ ID NO: 421 - DNA, 20 bp, Artificial
  CRISPR gRNA sequence
ctgccgtgatgtggaggagg

SEQ ID NO: 422 - DNA, 20 bp, Artificial
  CRISPR gRNA sequence
gccgtgatgtggaggaggaa

SEQ ID NO: 423 - DNA, 20 bp, Artificial
  CRISPR gRNA sequence
gatgtggaggaggaagagct

SEQ ID NO: 424 - DNA, 20 bp, Artificial
  CRISPR gRNA sequence
atgtggaggaggaagagctc

SEQ ID NO: 425 - DNA, 20 bp, Artificial
  CRISPR gRNA sequence
tggaggaggaagagctcagg

SEQ ID NO: 426 - DNA, 20 bp, Artificial
  CRISPR gRNA sequence
gaggaggaagagctcaggtg

SEQ ID NO: 427 - DNA, 20 bp, Artificial
  CRISPR gRNA sequence
gaggaagagctcaggtggag

SEQ ID NO: 428 - DNA, 20 bp, Artificial
  CRISPR gRNA sequence
aggaagagctcaggtggaga

SEQ ID NO: 429 - DNA, 20 bp, Artificial
  CRISPR gRNA sequence
ggaagagctcaggtggagaa

SEQ ID NO: 430 - DNA, 20 bp, Artificial
  CRISPR gRNA sequence
gaagagctcaggtggagaag

SEQ ID NO: 431 - DNA, 20 bp, Artificial
  CRISPR gRNA sequence
gctcaggtggagaaggggtg

SEQ ID NO: 432 - DNA, 20 bp, Artificial
  CRISPR gRNA sequence
ctcaggtggagaaggggtga

SEQ ID NO: 433 - DNA, 20 bp, Artificial
  CRISPR gRNA sequence
tcaggtggagaaggggtgaa

SEQ ID NO: 434 - DNA, 20 bp, Artificial
  CRISPR gRNA sequence
ggtggagaaggggtgaaggg

SEQ ID NO: 435 - DNA, 20 bp, Artificial
  CRISPR gRNA sequence
gtggagaaggggtgaagggt

SEQ ID NO: 436 - DNA, 20 bp, Artificial
  CRISPR gRNA sequence
tggagaaggggtgaagggtg

SEQ ID NO: 437 - DNA, 20 bp, Artificial
  CRISPR gRNA sequence
aggggtgaagggtggggtct

SEQ ID NO: 438 - DNA, 20 bp, Artificial
  CRISPR gRNA sequence
ctgagatttcttgtctcact

SEQ ID NO: 439 - DNA, 20 bp, Artificial
  CRISPR gRNA sequence
tgagatttcttgtctcactg

SEQ ID NO: 440 - DNA, 20 bp, Artificial
  CRISPR gRNA sequence
gagatttcttgtctcactga

SEQ ID NO: 441 - DNA, 20 bp, Artificial
  CRISPR gRNA sequence
cttgtctcactgagggttcc

SEQ ID NO: 442 - DNA, 20 bp, Artificial
  CRISPR gRNA sequence
tcactgagggttccaagccc

SEQ ID NO: 443 - DNA, 20 bp, Artificial
  CRISPR gRNA sequence
tgagggttccaagccccagc

SEQ ID NO: 444 - DNA, 20 bp, Artificial
  CRISPR gRNA sequence
aatgtgccctgtctcattac

SEQ ID NO: 445 - DNA, 20 bp, Artificial
  CRISPR gRNA sequence
atgtgccctgtctcattact

SEQ ID NO: 446 - DNA, 20 bp, Artificial
  CRISPR gRNA sequence
tgccctgtctcattactggg

SEQ ID NO: 447 - DNA, 20 bp, Artificial
  CRISPR gRNA sequence
ggtgcttcccagtaatgaga

SEQ ID NO: 448 - DNA, 20 bp, Artificial
  CRISPR gRNA sequence
gtgcttcccagtaatgagac

SEQ ID NO: 449 - DNA, 20 bp, Artificial
  CRISPR gRNA sequence
tgcttcccagtaatgagaca

SEQ ID NO: 450 - DNA, 20 bp, Artificial
  CRISPR gRNA sequence
aatgagacagggcacatttc

SEQ ID NO: 451 - DNA, 20 bp, Artificial
  CRISPR gRNA sequence
agacagggcacatttctagc

SEQ ID NO: 452 - DNA, 20 bp, Artificial
  CRISPR gRNA sequence
gacagggcacatttctagct

SEQ ID NO: 453 - DNA, 20 bp, Artificial
  CRISPR gRNA sequence
acagggcacatttctagctg

SEQ ID NO: 454 - DNA, 20 bp, Artificial
  CRISPR gRNA sequence
gcacatttctagctggggct

SEQ ID NO: 455 - DNA, 20 bp, Artificial
  CRISPR gRNA sequence
tagctggggcttggaaccct

SEQ ID NO: 456 - DNA, 20 bp, Artificial
  CRISPR gRNA sequence
tggggcttggaaccctcagt

SEQ ID NO: 457 - DNA, 20 bp, Artificial
  CRISPR gRNA sequence
cttggaaccctcagtgagac

SEQ ID NO: 458 - DNA, 20 bp, Artificial
  CRISPR gRNA sequence
ctcagtgagacaagaaatct

SEQ ID NO: 459 - DNA, 20 bp, Artificial
  CRISPR gRNA sequence
ccttcaccccttctccacct

SEQ ID NO: 460 - DNA, 20 bp, Artificial
  CRISPR gRNA sequence
gctcttcctcctccacatca

SEQ ID NO: 461 - DNA, 20 bp, Artificial
  CRISPR gRNA sequence
cttcctcctccacatcacgg

SEQ ID NO: 462 - DNA, 20 bp, Artificial
  CRISPR gRNA sequence
ccacatcacggcagcgacca

SEQ ID NO: 463 - DNA, 20 bp, Artificial
  CRISPR gRNA sequence
cacggcagcgaccacagctc

SEQ ID NO: 464 - DNA, 20 bp, Artificial
  CRISPR gRNA sequence
gaccacagctccagtgatca

SEQ ID NO: 465 - DNA, 20 bp, Artificial
  CRISPR gRNA sequence
gctccagtgatcacagctcc

SEQ ID NO: 466 - DNA, 20 bp, Artificial
  CRISPR gRNA sequence
ctccagtgatcacagctcca

SEQ ID NO: 467 - DNA, 20 bp, Artificial
  CRISPR gRNA sequence
ccagtgatcacagctccaag

SEQ ID NO: 468 - DNA, 20 bp, Artificial
  CRISPR gRNA sequence
atcacagctccaaggagaac

SEQ ID NO: 469 - DNA, 20 bp, Artificial
  CRISPR gRNA sequence
tcacagctccaaggagaacc

SEQ ID NO: 470 - DNA, 20 bp, Artificial
  CRISPR gRNA sequence
agctccaaggagaaccaggc

SEQ ID NO: 471 - DNA, 20 bp, Artificial
  CRISPR gRNA sequence
gccagcaatgatgcccacga

SEQ ID NO: 472 - DNA, 20 bp, Artificial
  CRISPR gRNA sequence
ccagcaatgatgcccacgat

SEQ ID NO: 473 - DNA, 20 bp, Artificial
  CRISPR gRNA sequence
cagcaatgatgcccacgatg

SEQ ID NO: 474 - DNA, 20 bp, Artificial
  CRISPR gRNA sequence
aatgatgcccacgatgggga

SEQ ID NO: 475 - DNA, 20 bp, Artificial
  CRISPR gRNA sequence
gatgcccacgatggggatgg

SEQ ID NO: 476 - DNA, 20 bp, Artificial
  CRISPR gRNA sequence
atgcccacgatggggatggt

SEQ ID NO: 477 - DNA, 20 bp, Artificial
  CRISPR gRNA sequence
ccacgatggggatggtgggc

SEQ ID NO: 478 - DNA, 20 bp, Artificial
  CRISPR gRNA sequence
cacgatggggatggtgggct

SEQ ID NO: 479 - DNA, 20 bp, Artificial
  CRISPR gRNA sequence
gatggggatggtgggctggg

SEQ ID NO: 480 - DNA, 20 bp, Artificial
  CRISPR gRNA sequence
gggatggtgggctgggaaga

SEQ ID NO: 481 - DNA, 20 bp, Artificial
  CRISPR gRNA sequence
gtgggctgggaagacagctc

SEQ ID NO: 482 - DNA, 20 bp, Artificial
  CRISPR gRNA sequence
tgggctgggaagacagctct

SEQ ID NO: 483 - DNA, 20 bp, Artificial
  CRISPR gRNA sequence
tgggaagacagctctgggaa

SEQ ID NO: 484 - DNA, 20 bp, Artificial
  CRISPR gRNA sequence
ggaagacagctctgggaaaa

SEQ ID NO: 485 - DNA, 20 bp, Artificial
  CRISPR gRNA sequence
gaagacagctctgggaaaag

SEQ ID NO: 486 - DNA, 20 bp, Artificial
  CRISPR gRNA sequence
aagacagctctgggaaaaga

SEQ ID NO: 487 - DNA, 20 bp, Artificial
  CRISPR gRNA sequence
agacagctctgggaaaagag

SEQ ID NO: 488 - DNA, 20 bp, Artificial
  CRISPR gRNA sequence
cagctctgggaaaagagggg

SEQ ID NO: 489 - DNA, 20 bp, Artificial
  CRISPR gRNA sequence
agctctgggaaaagagggga

SEQ ID NO: 490 - DNA, 20 bp, Artificial
  CRISPR gRNA sequence
ctgggaaaagaggggaaggt

SEQ ID NO: 491 - DNA, 20 bp, Artificial
  CRISPR gRNA sequence
tgggaaaagaggggaaggtg

SEQ ID NO: 492 - DNA, 20 bp, Artificial
  CRISPR gRNA sequence
gggaaaagaggggaaggtga

SEQ ID NO: 493 - DNA, 20 bp, Artificial
  CRISPR gRNA sequence
ggaaaagaggggaaggtgag

SEQ ID NO: 494 - DNA, 20 bp, Artificial
  CRISPR gRNA sequence
gaggggccctgaccctgcta

SEQ ID NO: 495 - DNA, 20 bp, Artificial
  CRISPR gRNA sequence
aggggccctgaccctgctaa

SEQ ID NO: 496 - DNA, 20 bp, Artificial
  CRISPR gRNA sequence
ctgaccctgctaaaggtctc

SEQ ID NO: 497 - DNA, 20 bp, Artificial
  CRISPR gRNA sequence
gaccctgctaaaggtctcca

SEQ ID NO: 498 - DNA, 20 bp, Artificial
  CRISPR gRNA sequence
ccctgctaaaggtctccaga

SEQ ID NO: 499 - DNA, 20 bp, Artificial
  CRISPR gRNA sequence
cctgctaaaggtctccagag

SEQ ID NO: 500 - DNA, 20 bp, Artificial
  CRISPR gRNA sequence
gagaggctcctgctttccct

SEQ ID NO: 501 - DNA, 20 bp, Artificial
  CRISPR gRNA sequence
gaggctcctgctttccctaa

SEQ ID NO: 502 - DNA, 20 bp, Artificial
  CRISPR gRNA sequence
tctccctccttaccccatct

SEQ ID NO: 503 - DNA, 20 bp, Artificial
  CRISPR gRNA sequence
ctccctccttaccccatctc

SEQ ID NO: 504 - DNA, 20 bp, Artificial
  CRISPR gRNA sequence
tccctccttaccccatctca

SEQ ID NO: 505 - DNA, 20 bp, Artificial
  CRISPR gRNA sequence
tccttaccccatctcagggt

SEQ ID NO: 506 - DNA, 20 bp, Artificial
  CRISPR gRNA sequence
ccttaccccatctcagggtg

SEQ ID NO: 507 - DNA, 20 bp, Artificial
  CRISPR gRNA sequence
cttaccccatctcagggtga

SEQ ID NO: 508 - DNA, 20 bp, Artificial
  CRISPR gRNA sequence
ttaccccatctcagggtgag

SEQ ID NO: 509 - DNA, 20 bp, Artificial
  CRISPR gRNA sequence
ccatctcagggtgaggggct

SEQ ID NO: 510 - DNA, 20 bp, Artificial
  CRISPR gRNA sequence
catctcagggtgaggggctt

SEQ ID NO: 511 - DNA, 20 bp, Artificial
  CRISPR gRNA sequence
ctcagggtgaggggcttggg

SEQ ID NO: 512 - DNA, 20 bp, Artificial
  CRISPR gRNA sequence
gcagaccctcatgctgcaca

SEQ ID NO: 513 - DNA, 20 bp, Artificial
  CRISPR gRNA sequence
gaccctcatgctgcacatgg

SEQ ID NO: 514 - DNA, 20 bp, Artificial
  CRISPR gRNA sequence
accctcatgctgcacatggc

SEQ ID NO: 515 - DNA, 20 bp, Artificial
  CRISPR gRNA sequence
ggtgtatctctgctcctctc

SEQ ID NO: 516 - DNA, 20 bp, Artificial
  CRISPR gRNA sequence
gtatctctgctcctctccag

SEQ ID NO: 517 - DNA, 20 bp, Artificial
  CRISPR gRNA sequence
tatctctgctcctctccaga

SEQ ID NO: 518 - DNA, 20 bp, Artificial
  CRISPR gRNA sequence
ctctccagaaggcaccacca

SEQ ID NO: 519 - DNA, 20 bp, Artificial
  CRISPR gRNA sequence
ccaccacagccgcccacttc

SEQ ID NO: 520 - DNA, 20 bp, Artificial
  CRISPR gRNA sequence
ccacagccgcccacttctgg

SEQ ID NO: 521 - DNA, 20 bp, Artificial
  CRISPR gRNA sequence
cacagccgcccacttctgga

SEQ ID NO: 522 - DNA, 20 bp, Artificial
  CRISPR gRNA sequence
ctggaaggttccatcccctg

SEQ ID NO: 523 - DNA, 20 bp, Artificial
  CRISPR gRNA sequence
tggaaggttccatcccctgc

SEQ ID NO: 524 - DNA, 20 bp, Artificial
  CRISPR gRNA sequence
ggttccatcccctgcaggcc

SEQ ID NO: 525 - DNA, 20 bp, Artificial
  CRISPR gRNA sequence
cctgcaggcctggtctccac

SEQ ID NO: 526 - DNA, 20 bp, Artificial
  CRISPR gRNA sequence
tctccacgagctccgtgtcc

SEQ ID NO: 527 - DNA, 20 bp, Artificial
  CRISPR gRNA sequence
ctccacgagctccgtgtcct

SEQ ID NO: 528 - DNA, 20 bp, Artificial
  CRISPR gRNA sequence
cgagctccgtgtcctgggtc

SEQ ID NO: 529 - DNA, 20 bp, Artificial
  CRISPR gRNA sequence
ggtcctccccatcccgctgc

SEQ ID NO: 530 - DNA, 20 bp, Artificial
  CRISPR gRNA sequence
gtcctccccatcccgctgcc

SEQ ID NO: 531 - DNA, 20 bp, Artificial
  CRISPR gRNA sequence
tccccatcccgctgccaggt

SEQ ID NO: 532 - DNA, 20 bp, Artificial
  CRISPR gRNA sequence
ccaggtcagtgtgatctccg

SEQ ID NO: 533 - DNA, 20 bp, Artificial
  CRISPR gRNA sequence
caggtcagtgtgatctccgc

SEQ ID NO: 534 - DNA, 20 bp, Artificial
  CRISPR gRNA sequence
aggtcagtgtgatctccgca

SEQ ID NO: 535 - DNA, 20 bp, Artificial
  CRISPR gRNA sequence
tcagtgtgatctccgcaggg

SEQ ID NO: 536 - DNA, 20 bp, Artificial
  CRISPR gRNA sequence
gtgtgatctccgcagggtag

SEQ ID NO: 537 - DNA, 20 bp, Artificial
  CRISPR gRNA sequence
atctccgcagggtagaagcc

SEQ ID NO: 538 - DNA, 20 bp, Artificial
  CRISPR gRNA sequence
tctccgcagggtagaagccc

SEQ ID NO: 539 - DNA, 20 bp, Artificial
  CRISPR gRNA sequence
ctccgcagggtagaagccca

SEQ ID NO: 540 - DNA, 20 bp, Artificial
  CRISPR gRNA sequence
cagggtagaagcccagggcc

SEQ ID NO: 541 - DNA, 20 bp, Artificial
  CRISPR gRNA sequence
aagcccagggcccagcacct

SEQ ID NO: 542 - DNA, 20 bp, Artificial
  CRISPR gRNA sequence
agcccagggcccagcacctc

SEQ ID NO: 543 - DNA, 20 bp, Artificial
  CRISPR gRNA sequence
gcccagggcccagcacctca

SEQ ID NO: 544 - DNA, 20 bp, Artificial
  CRISPR gRNA sequence
cagggcccagcacctcaggg

SEQ ID NO: 545 - DNA, 20 bp, Artificial
  CRISPR gRNA sequence
agcacctcagggtggcctca

SEQ ID NO: 546 - DNA, 20 bp, Artificial
  CRISPR gRNA sequence
cctcagggtggcctcatggt

SEQ ID NO: 547 - DNA, 20 bp, Artificial
  CRISPR gRNA sequence
tcagggtggcctcatggtca

SEQ ID NO: 548 - DNA, 20 bp, Artificial
  CRISPR gRNA sequence
ggtggcctcatggtcagaga

SEQ ID NO: 549 - DNA, 20 bp, Artificial
  CRISPR gRNA sequence
gtggcctcatggtcagagat

SEQ ID NO: 550 - DNA, 20 bp, Artificial
  CRISPR gRNA sequence
tggcctcatggtcagagatg

SEQ ID NO: 551 - DNA, 20 bp, Artificial
  CRISPR gRNA sequence
cctcatggtcagagatgggg

SEQ ID NO: 552 - DNA, 20 bp, Artificial
  CRISPR gRNA sequence
catggtcagagatggggtgg

SEQ ID NO: 553 - DNA, 20 bp, Artificial
  CRISPR gRNA sequence
atggtcagagatggggtggt

SEQ ID NO: 554 - DNA, 20 bp, Artificial
  CRISPR gRNA sequence
gtggtgggtcatatgtgtct

SEQ ID NO: 555 - DNA, 20 bp, Artificial
  CRISPR gRNA sequence
tggtgggtcatatgtgtctt

SEQ ID NO: 556 - DNA, 20 bp, Artificial
  CRISPR gRNA sequence
ggtgggtcatatgtgtcttg

SEQ ID NO: 557 - DNA, 20 bp, Artificial
  CRISPR gRNA sequence
gtgggtcatatgtgtcttgg

SEQ ID NO: 558 - DNA, 20 bp, Artificial
  CRISPR gRNA sequence
tgggtcatatgtgtcttggg

SEQ ID NO: 559 - DNA, 20 bp, Artificial
  CRISPR gRNA sequence
gggtcatatgtgtcttgggg

SEQ ID NO: 560 - DNA, 20 bp, Artificial
  CRISPR gRNA sequence
tgtgtcttgggggggtctga

SEQ ID NO: 561 - DNA, 20 bp, Artificial
  CRISPR gRNA sequence
gtgtcttgggggggtctgac

SEQ ID NO: 562 - DNA, 20 bp, Artificial
  CRISPR gRNA sequence
tcttgggggggtctgacggg

SEQ ID NO: 563 - DNA, 20 bp, Artificial
  CRISPR gRNA sequence
ttgggggggtctgacgggaa

SEQ ID NO: 564 - DNA, 20 bp, Artificial
  CRISPR gRNA sequence
gggggtctgacgggaagagt

SEQ ID NO: 565 - DNA, 20 bp, Artificial
  CRISPR gRNA sequence
acgggaagagtcagaaaatt

SEQ ID NO: 566 - DNA, 20 bp, Artificial
  CRISPR gRNA sequence
cgggaagagtcagaaaattc

SEQ ID NO: 567 - DNA, 20 bp, Artificial
  CRISPR gRNA sequence
caggcattttgcatctgtca

SEQ ID NO: 568 - DNA, 20 bp, Artificial
  CRISPR gRNA sequence
aggcattttgcatctgtcat

SEQ ID NO: 569 - DNA, 20 bp, Artificial
  CRISPR gRNA sequence
tctgtcatgggacactccac

SEQ ID NO: 570 - DNA, 20 bp, Artificial
  CRISPR gRNA sequence
acactccaccagcacgcatg

SEQ ID NO: 571 - DNA, 20 bp, Artificial
  CRISPR gRNA sequence
agcacgcatgtggccatctt

SEQ ID NO: 572 - DNA, 20 bp, Artificial
  CRISPR gRNA sequence
gcatgtggccatcttgagaa

SEQ ID NO: 573 - DNA, 20 bp, Artificial
  CRISPR gRNA sequence
gtggccatcttgagaatgga

SEQ ID NO: 574 - DNA, 20 bp, Artificial
  CRISPR gRNA sequence
tggccatcttgagaatggac

SEQ ID NO: 575 - DNA, 20 bp, Artificial
  CRISPR gRNA sequence
ttgagaatggacaggacacc

SEQ ID NO: 576 - DNA, 20 bp, Artificial
  CRISPR gRNA sequence
tgagaatggacaggacaccc

SEQ ID NO: 577 - DNA, 20 bp, Artificial
  CRISPR gRNA sequence
aatggacaggacacccggga

SEQ ID NO: 578 - DNA, 20 bp, Artificial
  CRISPR gRNA sequence
atggacaggacacccgggat

SEQ ID NO: 579 - DNA, 20 bp, Artificial
  CRISPR gRNA sequence
tggacaggacacccgggatg

SEQ ID NO: 580 - DNA, 20 bp, Artificial
  CRISPR gRNA sequence
acaggacacccgggatgggg

SEQ ID NO: 581 - DNA, 20 bp, Artificial
  CRISPR gRNA sequence
aggacacccgggatggggaa

SEQ ID NO: 582 - DNA, 20 bp, Artificial
  CRISPR gRNA sequence
gacacccgggatggggaaga

SEQ ID NO: 583 - DNA, 20 bp, Artificial
  CRISPR gRNA sequence
ccgggatggggaagagagca

SEQ ID NO: 584 - DNA, 20 bp, Artificial
  CRISPR gRNA sequence
ggggaagagagcacagaacc

SEQ ID NO: 585 - DNA, 20 bp, Artificial
  CRISPR gRNA sequence
agagcacagaacccagacac

SEQ ID NO: 586 - DNA, 20 bp, Artificial
  CRISPR gRNA sequence
acagaacccagacaccagcc

SEQ ID NO: 587 - DNA, 20 bp, Artificial
  CRISPR gRNA sequence
cccagacaccagcctggaca

SEQ ID NO: 588 - DNA, 20 bp, Artificial
  CRISPR gRNA sequence
ccagacaccagcctggacac

SEQ ID NO: 589 - DNA, 20 bp, Artificial
  CRISPR gRNA sequence
ccagcctggacacaggcacc

SEQ ID NO: 590 - DNA, 20 bp, Artificial
  CRISPR gRNA sequence
cagcctggacacaggcacct

SEQ ID NO: 591 - DNA, 20 bp, Artificial
  CRISPR gRNA sequence
gggataatcttctattccct

SEQ ID NO: 592 - DNA, 20 bp, Artificial
  CRISPR gRNA sequence
ataatcttctattccctgag

SEQ ID NO: 593 - DNA, 20 bp, Artificial
  CRISPR gRNA sequence
taatcttctattccctgaga

SEQ ID NO: 594 - DNA, 20 bp, Artificial
  CRISPR gRNA sequence
aatcttctattccctgagaa

SEQ ID NO: 595 - DNA, 20 bp, Artificial
  CRISPR gRNA sequence
tctattccctgagaagggaa

SEQ ID NO: 596 - DNA, 20 bp, Artificial
  CRISPR gRNA sequence
gagaagggaacagcgacttc

SEQ ID NO: 597 - DNA, 20 bp, Artificial
  CRISPR gRNA sequence
gcgacttctggtcctgacct

SEQ ID NO: 598 - DNA, 20 bp, Artificial
  CRISPR gRNA sequence
acttctggtcctgacctgag

SEQ ID NO: 599 - DNA, 20 bp, Artificial
  CRISPR gRNA sequence
ttctggtcctgacctgagtg

SEQ ID NO: 600 - DNA, 20 bp, Artificial
  CRISPR gRNA sequence
tctggtcctgacctgagtgg

SEQ ID NO: 601 - DNA, 20 bp, Artificial
  CRISPR gRNA sequence
tcctgacctgagtggaggct

SEQ ID NO: 602 - DNA, 20 bp, Artificial
  CRISPR gRNA sequence
cctgacctgagtggaggctg

SEQ ID NO: 603 - DNA, 20 bp, Artificial
  CRISPR gRNA sequence
ctgacctgagtggaggctga

SEQ ID NO: 604 - DNA, 20 bp, Artificial
  CRISPR gRNA sequence
tgagtggaggctgagggact

SEQ ID NO: 605 - DNA, 20 bp, Artificial
  CRISPR gRNA sequence
gtggaggctgagggactcag

SEQ ID NO: 606 - DNA, 20 bp, Artificial
  CRISPR gRNA sequence
gctgagggactcagaagtgc

SEQ ID NO: 607 - DNA, 20 bp, Artificial
  CRISPR gRNA sequence
ggactcagaagtgctggact

SEQ ID NO: 608 - DNA, 20 bp, Artificial
  CRISPR gRNA sequence
ctcagacccccacacacatt

SEQ ID NO: 609 - DNA, 20 bp, Artificial
  CRISPR gRNA sequence
ccccacacacattgagtgtg

SEQ ID NO: 610 - DNA, 20 bp, Artificial
  CRISPR gRNA sequence
cacacacattgagtgtgaag

SEQ ID NO: 611 - DNA, 20 bp, Artificial
  CRISPR gRNA sequence
cacacattgagtgtgaagca

SEQ ID NO: 612 - DNA, 20 bp, Artificial
  CRISPR gRNA sequence
ttgagtgtgaagcagagaac

SEQ ID NO: 613 - DNA, 20 bp, Artificial
  CRISPR gRNA sequence
tgagtgtgaagcagagaaca

SEQ ID NO: 614 - DNA, 20 bp, Artificial
  CRISPR gRNA sequence
tgaagcagagaacaaggcct

SEQ ID NO: 615 - DNA, 20 bp, Artificial
  CRISPR gRNA sequence
aagcagagaacaaggcctga

SEQ ID NO: 616 - DNA, 20 bp, Artificial
  CRISPR gRNA sequence
agcagagaacaaggcctgag

SEQ ID NO: 617 - DNA, 20 bp, Artificial
  CRISPR gRNA sequence
agaacaaggcctgagaggaa

SEQ ID NO: 618 - DNA, 20 bp, Artificial
  CRISPR gRNA sequence
aggcctgagaggaaaagtca

SEQ ID NO: 619 - DNA, 20 bp, Artificial
  CRISPR gRNA sequence
ggcctgagaggaaaagtcac

SEQ ID NO: 620 - DNA, 20 bp, Artificial
  CRISPR gRNA sequence
agaggaaaagtcacgggccc

SEQ ID NO: 621 - DNA, 20 bp, Artificial
  CRISPR gRNA sequence
gaggaaaagtcacgggccca

SEQ ID NO: 622 - DNA, 20 bp, Artificial
  CRISPR gRNA sequence
cacgggcccaaggctgctgc

SEQ ID NO: 623 - DNA, 20 bp, Artificial
  CRISPR gRNA sequence
caaggctgctgccggtgtca

SEQ ID NO: 624 - DNA, 20 bp, Artificial
  CRISPR gRNA sequence
aaggctgctgccggtgtcaa

SEQ ID NO: 625 - DNA, 20 bp, Artificial
  CRISPR gRNA sequence
aggctgctgccggtgtcaaa

SEQ ID NO: 626 - DNA, 20 bp, Artificial
  CRISPR gRNA sequence
tgtcaaagggaaccactcat

SEQ ID NO: 627 - DNA, 20 bp, Artificial
  CRISPR gRNA sequence
ggaaccactcatcagtattc

SEQ ID NO: 628 - DNA, 20 bp, Artificial
  CRISPR gRNA sequence
gaaccactcatcagtattcg

SEQ ID NO: 629 - DNA, 20 bp, Artificial
  CRISPR gRNA sequence
aaccactcatcagtattcga

SEQ ID NO: 630 - DNA, 20 bp, Artificial
  CRISPR gRNA sequence
tcgtcttcccgtcactcctt

SEQ ID NO: 631 - DNA, 20 bp, Artificial
  CRISPR gRNA sequence
gtcttcccgtcactccttca

SEQ ID NO: 632 - DNA, 20 bp, Artificial
  CRISPR gRNA sequence
attttatcccttaattgtgt

SEQ ID NO: 633 - DNA, 20 bp, Artificial
  CRISPR gRNA sequence
tttatcccttaattgtgtca

SEQ ID NO: 634 - DNA, 20 bp, Artificial
  CRISPR gRNA sequence
tatcccttaattgtgtcaga

SEQ ID NO: 635 - DNA, 20 bp, Artificial
  CRISPR gRNA sequence
cccttaattgtgtcagagag

SEQ ID NO: 636 - DNA, 20 bp, Artificial
  CRISPR gRNA sequence
ccttaattgtgtcagagagc

SEQ ID NO: 637 - DNA, 20 bp, Artificial
  CRISPR gRNA sequence
cttaattgtgtcagagagca

SEQ ID NO: 638 - DNA, 20 bp, Artificial
  CRISPR gRNA sequence
aattgtgtcagagagcaggg

SEQ ID NO: 639 - DNA, 20 bp, Artificial
  CRISPR gRNA sequence
cagagagcagggcggaacct

SEQ ID NO: 640 - DNA, 20 bp, Artificial
  CRISPR gRNA sequence
gagagcagggcggaacctca

SEQ ID NO: 641 - DNA, 20 bp, Artificial
  CRISPR gRNA sequence
ggaacctcagagtcactctc

SEQ ID NO: 642 - DNA, 20 bp, Artificial
  CRISPR gRNA sequence
ctcagagtcactctctggta

SEQ ID NO: 643 - DNA, 20 bp, Artificial
  CRISPR gRNA sequence
tcagagtcactctctggtac

SEQ ID NO: 644 - DNA, 20 bp, Artificial
  CRISPR gRNA sequence
tcactctctggtacaggatc

SEQ ID NO: 645 - DNA, 20 bp, Artificial
  CRISPR gRNA sequence
ctggtacaggatctggaacc

SEQ ID NO: 646 - DNA, 20 bp, Artificial
  CRISPR gRNA sequence
tggtacaggatctggaaccc

SEQ ID NO: 647 - DNA, 20 bp, Artificial
  CRISPR gRNA sequence
gtacaggatctggaacccag

SEQ ID NO: 648 - DNA, 20 bp, Artificial
  CRISPR gRNA sequence
tacaggatctggaacccagg

SEQ ID NO: 649 - DNA, 20 bp, Artificial
  CRISPR gRNA sequence
ccaggaggattcctctccct

SEQ ID NO: 650 - DNA, 20 bp, Artificial
  CRISPR gRNA sequence
caggaggattcctctccctc

SEQ ID NO: 651 - DNA, 20 bp, Artificial
  CRISPR gRNA sequence
ggattcctctccctcaggac

SEQ ID NO: 652 - DNA, 20 bp, Artificial
  CRISPR gRNA sequence
attcctctccctcaggacca

SEQ ID NO: 653 - DNA, 20 bp, Artificial
  CRISPR gRNA sequence
ttcctctccctcaggaccag

SEQ ID NO: 654 - DNA, 20 bp, Artificial
  CRISPR gRNA sequence
tcctctccctcaggaccaga

SEQ ID NO: 655 - DNA, 20 bp, Artificial
  CRISPR gRNA sequence
ctctccctcaggaccagagg

SEQ ID NO: 656 - DNA, 20 bp, Artificial
  CRISPR gRNA sequence
tctccctcaggaccagaggg

SEQ ID NO: 657 - DNA, 20 bp, Artificial
  CRISPR gRNA sequence
ctccctcaggaccagaggga

SEQ ID NO: 658 - DNA, 20 bp, Artificial
  CRISPR gRNA sequence
ccagagggagggtgatattc

SEQ ID NO: 659 - DNA, 20 bp, Artificial
  CRISPR gRNA sequence
ggagggtgatattctagtgt

SEQ ID NO: 660 - DNA, 20 bp, Artificial
  CRISPR gRNA sequence
ccaattgtctcccctccttg

SEQ ID NO: 661 - DNA, 20 bp, Artificial
  CRISPR gRNA sequence
caattgtctcccctccttgt

SEQ ID NO: 662 - DNA, 20 bp, Artificial
  CRISPR gRNA sequence
attgtctcccctccttgtgg

SEQ ID NO: 663 - DNA, 20 bp, Artificial
  CRISPR gRNA sequence
ttgtctcccctccttgtggg

SEQ ID NO: 664 - DNA, 20 bp, Artificial
  CRISPR gRNA sequence
ctcccctccttgtgggaggc

SEQ ID NO: 665 - DNA, 20 bp, Artificial
  CRISPR gRNA sequence
ctccttgtgggaggccagcc

SEQ ID NO: 666 - DNA, 20 bp, Artificial
  CRISPR gRNA sequence
tccttgtgggaggccagccc

SEQ ID NO: 667 - DNA, 20 bp, Artificial
  CRISPR gRNA sequence
cttgtgggaggccagcccgg

SEQ ID NO: 668 - DNA, 20 bp, Artificial
  CRISPR gRNA sequence
aggccagcccgggagatcta

SEQ ID NO: 669 - DNA, 20 bp, Artificial
  CRISPR gRNA sequence
ggccagcccgggagatctac

SEQ ID NO: 670 - DNA, 20 bp, Artificial
  CRISPR gRNA sequence
ccgggagatctacaggcgat

SEQ ID NO: 671 - DNA, 20 bp, Artificial
  CRISPR gRNA sequence
cgggagatctacaggcgatc

SEQ ID NO: 672 - DNA, 20 bp, Artificial
  CRISPR gRNA sequence
gggagatctacaggcgatca

SEQ ID NO: 673 - DNA, 20 bp, Artificial
  CRISPR gRNA sequence
gagatctacaggcgatcagg

SEQ ID NO: 674 - DNA, 20 bp, Artificial
  CRISPR gRNA sequence
agatctacaggcgatcaggg

SEQ ID NO: 675 - DNA, 20 bp, Artificial
  CRISPR gRNA sequence
gcgatcagggaggcgccccg

SEQ ID NO: 676 - DNA, 20 bp, Artificial
  CRISPR gRNA sequence
gggaggcgccccgtggcccc

SEQ ID NO: 677 - DNA, 20 bp, Artificial
  CRISPR gRNA sequence
cccctggtacccgtgcgctg

SEQ ID NO: 678 - DNA, 20 bp, Artificial
  CRISPR gRNA sequence
agcgtctccttcccgttctc

SEQ ID NO: 679 - DNA, 20 bp, Artificial
  CRISPR gRNA sequence
gcgtctccttcccgttctcc

SEQ ID NO: 680 - DNA, 20 bp, Artificial
  CRISPR gRNA sequence
tcccgttctccaggtatctg

SEQ ID NO: 681 - DNA, 20 bp, Artificial
  CRISPR gRNA sequence
ccgttctccaggtatctgcg

SEQ ID NO: 682 - DNA, 20 bp, Artificial
  CRISPR gRNA sequence
cactccacgcacgtgccatc

SEQ ID NO: 683 - DNA, 20 bp, Artificial
  CRISPR gRNA sequence
actccacgcacgtgccatcc

SEQ ID NO: 684 - DNA, 20 bp, Artificial
  CRISPR gRNA sequence
ccacgcacgtgccatccagg

SEQ ID NO: 685 - DNA, 20 bp, Artificial
  CRISPR gRNA sequence
cacgcacgtgccatccaggt

SEQ ID NO: 686 - DNA, 20 bp, Artificial
  CRISPR gRNA sequence
ctctcaactgctccgcctca

SEQ ID NO: 687 - DNA, 20 bp, Artificial
  CRISPR gRNA sequence
tctcaactgctccgcctcat

SEQ ID NO: 688 - DNA, 20 bp, Artificial
  CRISPR gRNA sequence
ggccgcctcccacttgcgct

SEQ ID NO: 689 - DNA, 20 bp, Artificial
  CRISPR gRNA sequence
ccacttgcgcttggtgatct

SEQ ID NO: 690 - DNA, 20 bp, Artificial
  CRISPR gRNA sequence
ctgagccgccatgtccgccg

SEQ ID NO: 691 - DNA, 20 bp, Artificial
  CRISPR gRNA sequence
cgccatgtccgccgcggtcc

SEQ ID NO: 692 - DNA, 20 bp, Artificial
  CRISPR gRNA sequence
ccatgtccgccgcggtccaa

SEQ ID NO: 693 - DNA, 20 bp, Artificial
  CRISPR gRNA sequence
tccgccgcggtccaagagcg

SEQ ID NO: 694 - DNA, 20 bp, Artificial
  CRISPR gRNA sequence
ccgccgcggtccaagagcgc

SEQ ID NO: 695 - DNA, 20 bp, Artificial
  CRISPR gRNA sequence
caagagcgcaggtcctcgtt

SEQ ID NO: 696 - DNA, 20 bp, Artificial
  CRISPR gRNA sequence
aagagcgcaggtcctcgttc

SEQ ID NO: 697 - DNA, 20 bp, Artificial
  CRISPR gRNA sequence
agagcgcaggtcctcgttca

SEQ ID NO: 698 - DNA, 20 bp, Artificial
  CRISPR gRNA sequence
cgatgtaatccttgccgtcg

SEQ ID NO: 699 - DNA, 20 bp, Artificial
  CRISPR gRNA sequence
gatgtaatccttgccgtcgt

SEQ ID NO: 700 - DNA, 20 bp, Artificial
  CRISPR gRNA sequence
tgccgtcgtaggcgtcctgc

SEQ ID NO: 701 - DNA, 20 bp, Artificial
  CRISPR gRNA sequence
aggcgtcctgccggtacccg

SEQ ID NO: 702 - DNA, 20 bp, Artificial
  CRISPR gRNA sequence
gcgtcctgccggtacccgcg

SEQ ID NO: 703 - DNA, 20 bp, Artificial
  CRISPR gRNA sequence
cgtcctgccggtacccgcgg

SEQ ID NO: 704 - DNA, 20 bp, Artificial
  CRISPR gRNA sequence
cctgccggtacccgcggagg

SEQ ID NO: 705 - DNA, 20 bp, Artificial
  CRISPR gRNA sequence
gcccgtccgaccccacgtcg

SEQ ID NO: 706 - DNA, 20 bp, Artificial
  CRISPR gRNA sequence
cgtcgcagccatacattatc

SEQ ID NO: 707 - DNA, 20 bp, Artificial
  CRISPR gRNA sequence
gcagccatacattatctgga

SEQ ID NO: 708 - DNA, 20 bp, Artificial
  CRISPR gRNA sequence
atacattatctggatggtgt

SEQ ID NO: 709 - DNA, 20 bp, Artificial
  CRISPR gRNA sequence
atctggatggtgtgagaacc

SEQ ID NO: 710 - DNA, 20 bp, Artificial
  CRISPR gRNA sequence
agaacctggccccgaccccg

SEQ ID NO: 711 - DNA, 20 bp, Artificial
  CRISPR gRNA sequence
cctggccccgaccccgcggt

SEQ ID NO: 712 - DNA, 20 bp, Artificial
  CRISPR gRNA sequence
ccccgaccccgcggtcagcc

SEQ ID NO: 713 - DNA, 20 bp, Artificial
  CRISPR gRNA sequence
cgcggtcagcccagtccccc

SEQ ID NO: 714 - DNA, 20 bp, Artificial
  CRISPR gRNA sequence
ccagtcccccgagccccgcc

SEQ ID NO: 715 - DNA, 20 bp, Artificial
  CRISPR gRNA sequence
ccgcccagccccgaccaacc

SEQ ID NO: 716 - DNA, 20 bp, Artificial
  CRISPR gRNA sequence
cgcccagccccgaccaaccc

SEQ ID NO: 717 - DNA, 20 bp, Artificial
  CRISPR gRNA sequence
gcccagccccgaccaacccg

SEQ ID NO: 718 - DNA, 20 bp, Artificial
  CRISPR gRNA sequence
cccagccccgaccaacccgg

SEQ ID NO: 719 - DNA, 20 bp, Artificial
  CRISPR gRNA sequence
ccagccccgaccaacccggg

SEQ ID NO: 720 - DNA, 20 bp, Artificial
  CRISPR gRNA sequence
gaccaacccggggggatttt

SEQ ID NO: 721 - DNA, 20 bp, Artificial
  CRISPR gRNA sequence
gcctaaactgaaaatgaaac

SEQ ID NO: 722 - DNA, 20 bp, Artificial
  CRISPR gRNA sequence
cctaaactgaaaatgaaacc

SEQ ID NO: 723 - DNA, 20 bp, Artificial
  CRISPR gRNA sequence
actgaaaatgaaaccgggta

SEQ ID NO: 724 - DNA, 20 bp, Artificial
  CRISPR gRNA sequence
ctgaaaatgaaaccgggtaa

SEQ ID NO: 725 - DNA, 20 bp, Artificial
  CRISPR gRNA sequence
tgaaaccgggtaaaggcgcc

SEQ ID NO: 726 - DNA, 20 bp, Artificial
  CRISPR gRNA sequence
gaaaccgggtaaaggcgcct

SEQ ID NO: 727 - DNA, 20 bp, Artificial
  CRISPR gRNA sequence
aaaggcgcctgggcctctcc

SEQ ID NO: 728 - DNA, 20 bp, Artificial
  CRISPR gRNA sequence
aaggcgcctgggcctctccc

SEQ ID NO: 729 - DNA, 20 bp, Artificial
  CRISPR gRNA sequence
aggcgcctgggcctctcccg

SEQ ID NO: 730 - DNA, 20 bp, Artificial
  CRISPR gRNA sequence
gcctgggcctctcccggggc

SEQ ID NO: 731 - DNA, 20 bp, Artificial
  CRISPR gRNA sequence
cctgggcctctcccggggca

SEQ ID NO: 732 - DNA, 20 bp, Artificial
  CRISPR gRNA sequence
ctgggcctctcccggggcaa

SEQ ID NO: 733 - DNA, 20 bp, Artificial
  CRISPR gRNA sequence
ctctcccggggcaagggtct

SEQ ID NO: 734 - DNA, 20 bp, Artificial
  CRISPR gRNA sequence
tctcccggggcaagggtctc

SEQ ID NO: 735 - DNA, 20 bp, Artificial
  CRISPR gRNA sequence
ctcccggggcaagggtctcg

SEQ ID NO: 736 - DNA, 20 bp, Artificial
  CRISPR gRNA sequence
gcaagggtctcggggtcccg

SEQ ID NO: 737 - DNA, 20 bp, Artificial
  CRISPR gRNA sequence
gtctcggggtcccgcggctt

SEQ ID NO: 738 - DNA, 20 bp, Artificial
  CRISPR gRNA sequence
tctcggggtcccgcggcttc

SEQ ID NO: 739 - DNA, 20 bp, Artificial
  CRISPR gRNA sequence
ctcggggtcccgcggcttcg

SEQ ID NO: 740 - DNA, 20 bp, Artificial
  CRISPR gRNA sequence
ggggtcccgcggcttcgggg

SEQ ID NO: 741 - DNA, 20 bp, Artificial
  CRISPR gRNA sequence
cgcggcttcggggtggatct

SEQ ID NO: 742 - DNA, 20 bp, Artificial
  CRISPR gRNA sequence
ttcggggtggatctcggacc

SEQ ID NO: 743 - DNA, 20 bp, Artificial
  CRISPR gRNA sequence
cggggtggatctcggacccg

SEQ ID NO: 744 - DNA, 20 bp, Artificial
  CRISPR gRNA sequence
gatctcggacccggagactg

SEQ ID NO: 745 - DNA, 20 bp, Artificial
  CRISPR gRNA sequence
atctcggacccggagactgt

SEQ ID NO: 746 - DNA, 20 bp, Artificial
  CRISPR gRNA sequence
cccggagactgtgggcgacc

SEQ ID NO: 747 - DNA, 20 bp, Artificial
  CRISPR gRNA sequence
tgggcgacctggcccgtccg

SEQ ID NO: 748 - DNA, 20 bp, Artificial
  CRISPR gRNA sequence
gggcgacctggcccgtccgt

SEQ ID NO: 749 - DNA, 20 bp, Artificial
  CRISPR gRNA sequence
ggcgacctggcccgtccgtg

SEQ ID NO: 750 - DNA, 20 bp, Artificial
  CRISPR gRNA sequence
gcgacctggcccgtccgtgg

SEQ ID NO: 751 - DNA, 20 bp, Artificial
  CRISPR gRNA sequence
ctggcccgtccgtgggggat

SEQ ID NO: 752 - DNA, 20 bp, Artificial
  CRISPR gRNA sequence
tggcccgtccgtgggggatg

SEQ ID NO: 753 - DNA, 20 bp, Artificial
  CRISPR gRNA sequence
ggcccgtccgtgggggatga

SEQ ID NO: 754 - DNA, 20 bp, Artificial
  CRISPR gRNA sequence
gcccgtccgtgggggatgag

SEQ ID NO: 755 - DNA, 20 bp, Artificial
  CRISPR gRNA sequence
ggggtcctgacctgcgcccc

SEQ ID NO: 756 - DNA, 20 bp, Artificial
  CRISPR gRNA sequence
tcctgacctgcgcccccggc

SEQ ID NO: 757 - DNA, 20 bp, Artificial
  CRISPR gRNA sequence
cctgacctgcgcccccggcc

SEQ ID NO: 758 - DNA, 20 bp, Artificial
  CRISPR gRNA sequence
ctgacctgcgcccccggccg

SEQ ID NO: 759 - DNA, 20 bp, Artificial
  CRISPR gRNA sequence
ccccggccggggtcactcac

SEQ ID NO: 760 - DNA, 20 bp, Artificial
  CRISPR gRNA sequence
gtcactcaccggcctcgctc

SEQ ID NO: 761 - DNA, 20 bp, Artificial
  CRISPR gRNA sequence
caccggcctcgctctggttg

SEQ ID NO: 762 - DNA, 20 bp, Artificial
  CRISPR gRNA sequence
cggcctcgctctggttgtag

SEQ ID NO: 763 - DNA, 20 bp, Artificial
  CRISPR gRNA sequence
ctctggttgtagtagccgcg

SEQ ID NO: 764 - DNA, 20 bp, Artificial
  CRISPR gRNA sequence
tctggttgtagtagccgcgc

SEQ ID NO: 765 - DNA, 20 bp, Artificial
  CRISPR gRNA sequence
ctggttgtagtagccgcgca

SEQ ID NO: 766 - DNA, 20 bp, Artificial
  CRISPR gRNA sequence
tagtagccgcgcagggtccc

SEQ ID NO: 767 - DNA, 20 bp, Artificial
  CRISPR gRNA sequence
agtagccgcgcagggtcccc

SEQ ID NO: 768 - DNA, 20 bp, Artificial
  CRISPR gRNA sequence
gcagggtccccaggtccact

SEQ ID NO: 769 - DNA, 20 bp, Artificial
  CRISPR gRNA sequence
ggtccccaggtccactcggt

SEQ ID NO: 770 - DNA, 20 bp, Artificial
  CRISPR gRNA sequence
ccactcggtcagtctgtgac

SEQ ID NO: 771 - DNA, 20 bp, Artificial
  CRISPR gRNA sequence
cactcggtcagtctgtgact

SEQ ID NO: 772 - DNA, 20 bp, Artificial
  CRISPR gRNA sequence
ccttcacattccgtgtctcc

SEQ ID NO: 773 - DNA, 20 bp, Artificial
  CRISPR gRNA sequence
gtctcctggtcccaatactc

SEQ ID NO: 774 - DNA, 20 bp, Artificial
  CRISPR gRNA sequence
ggcccctcctgctctatcca

SEQ ID NO: 775 - DNA, 20 bp, Artificial
  CRISPR gRNA sequence
tgctctatccacggcgcccg

SEQ ID NO: 776 - DNA, 20 bp, Artificial
  CRISPR gRNA sequence
gcgcccgcggctccatcctc

SEQ ID NO: 777 - DNA, 20 bp, Artificial
  CRISPR gRNA sequence
cggctccatcctctggctcg

SEQ ID NO: 778 - DNA, 20 bp, Artificial
  CRISPR gRNA sequence
cgaactgcgtgtcgtccacg

SEQ ID NO: 779 - DNA, 20 bp, Artificial
  CRISPR gRNA sequence
cgtgtcgtccacgtagccca

SEQ ID NO: 780 - DNA, 20 bp, Artificial
  CRISPR gRNA sequence
ccacgtagcccacggcgatg

SEQ ID NO: 781 - DNA, 20 bp, Artificial
  CRISPR gRNA sequence
cgtagcccacggcgatgaag

SEQ ID NO: 782 - DNA, 20 bp, Artificial
  CRISPR gRNA sequence
gtagcccacggcgatgaagc

SEQ ID NO: 783 - DNA, 20 bp, Artificial
  CRISPR gRNA sequence
tagcccacggcgatgaagcg

SEQ ID NO: 784 - DNA, 20 bp, Artificial
  CRISPR gRNA sequence
cgatgaagcggggctccccg

SEQ ID NO: 785 - DNA, 20 bp, Artificial
  CRISPR gRNA sequence
gaagcggggctccccgcggc

SEQ ID NO: 786 - DNA, 20 bp, Artificial
  CRISPR gRNA sequence
aagcggggctccccgcggcc

SEQ ID NO: 787 - DNA, 20 bp, Artificial
  CRISPR gRNA sequence
ggggctccccgcggccgggc

SEQ ID NO: 788 - DNA, 20 bp, Artificial
  CRISPR gRNA sequence
gggctccccgcggccgggcc

SEQ ID NO: 789 - DNA, 20 bp, Artificial
  CRISPR gRNA sequence
cccgcggccgggccgggaca

SEQ ID NO: 790 - DNA, 20 bp, Artificial
  CRISPR gRNA sequence
cgggccgggacacggatgtg

SEQ ID NO: 791 - DNA, 20 bp, Artificial
  CRISPR gRNA sequence
ggatgtgaagaaatacctca

SEQ ID NO: 792 - DNA, 20 bp, Artificial
  CRISPR gRNA sequence
atgtgaagaaatacctcatg

SEQ ID NO: 793 - DNA, 20 bp, Artificial
  CRISPR gRNA sequence
tgaagaaatacctcatggag

SEQ ID NO: 794 - DNA, 20 bp, Artificial
  CRISPR gRNA sequence
gaagaaatacctcatggagt

SEQ ID NO: 795 - DNA, 20 bp, Artificial
  CRISPR gRNA sequence
agaaatacctcatggagtgg

SEQ ID NO: 796 - DNA, 20 bp, Artificial
  CRISPR gRNA sequence
tacctcatggagtgggagcc

SEQ ID NO: 797 - DNA, 20 bp, Artificial
  CRISPR gRNA sequence
acctcatggagtgggagcct

SEQ ID NO: 798 - DNA, 20 bp, Artificial
  CRISPR gRNA sequence
cctcatggagtgggagcctg

SEQ ID NO: 799 - DNA, 20 bp, Artificial
  CRISPR gRNA sequence
ctcatggagtgggagcctgg

SEQ ID NO: 800 - DNA, 20 bp, Artificial
  CRISPR gRNA sequence
tggagtgggagcctgggggc

SEQ ID NO: 801 - DNA, 20 bp, Artificial
  CRISPR gRNA sequence
agtgggagcctgggggcgag

SEQ ID NO: 802 - DNA, 20 bp, Artificial
  CRISPR gRNA sequence
gggagcctgggggcgagcag

SEQ ID NO: 803 - DNA, 20 bp, Artificial
  CRISPR gRNA sequence
cctgggggcgagcagtggct

SEQ ID NO: 804 - DNA, 20 bp, Artificial
  CRISPR gRNA sequence
gacctgcccgaccctcgtcc

SEQ ID NO: 805 - DNA, 20 bp, Artificial
  CRISPR gRNA sequence
gcccgaccctcgtcccggcg

SEQ ID NO: 806 - DNA, 20 bp, Artificial
  CRISPR gRNA sequence
tcgtcccggcgcggctcccc

SEQ ID NO: 807 - DNA, 20 bp, Artificial
  CRISPR gRNA sequence
ccccggtcctgcgcccccgc

SEQ ID NO: 808 - DNA, 20 bp, Artificial
  CRISPR gRNA sequence
cccggtcctgcgcccccgcc

SEQ ID NO: 809 - DNA, 20 bp, Artificial
  CRISPR gRNA sequence
cggtcctgcgcccccgccag

SEQ ID NO: 810 - DNA, 20 bp, Artificial
  CRISPR gRNA sequence
ggtcctgcgcccccgccagg

SEQ ID NO: 811 - DNA, 20 bp, Artificial
  CRISPR gRNA sequence
gtcctgcgcccccgccagga

SEQ ID NO: 812 - DNA, 20 bp, Artificial
  CRISPR gRNA sequence
gggccccttgcttctccccg

SEQ ID NO: 813 - DNA, 20 bp, Artificial
  CRISPR gRNA sequence
gccccttgcttctccccgca

SEQ ID NO: 814 - DNA, 20 bp, Artificial
  CRISPR gRNA sequence
ccccttgcttctccccgcag

SEQ ID NO: 815 - DNA, 20 bp, Artificial
  CRISPR gRNA sequence
cttgcttctccccgcagagg

SEQ ID NO: 816 - DNA, 20 bp, Artificial
  CRISPR gRNA sequence
cgaccccgcactcacccgcc

SEQ ID NO: 817 - DNA, 20 bp, Artificial
  CRISPR gRNA sequence
gaccccgcactcacccgccc

SEQ ID NO: 818 - DNA, 20 bp, Artificial
  CRISPR gRNA sequence
cgcactcacccgcccaggtc

SEQ ID NO: 819 - DNA, 20 bp, Artificial
  CRISPR gRNA sequence
gcactcacccgcccaggtct

SEQ ID NO: 820 - DNA, 20 bp, Artificial
  CRISPR gRNA sequence
tcacccgcccaggtctgggt

SEQ ID NO: 821 - DNA, 20 bp, Artificial
  CRISPR gRNA sequence
cacccgcccaggtctgggtc

SEQ ID NO: 822 - DNA, 20 bp, Artificial
  CRISPR gRNA sequence
acccgcccaggtctgggtca

SEQ ID NO: 823 - DNA, 20 bp, Artificial
  CRISPR gRNA sequence
gcccaggtctgggtcagggc

SEQ ID NO: 824 - DNA, 20 bp, Artificial
  CRISPR gRNA sequence
cccaggtctgggtcagggcc

SEQ ID NO: 825 - DNA, 20 bp, Artificial
  CRISPR gRNA sequence
ccaggtctgggtcagggcca

SEQ ID NO: 826 - DNA, 20 bp, Artificial
  CRISPR gRNA sequence
gggtcagggccagggccccc

SEQ ID NO: 827 - DNA, 20 bp, Artificial
  CRISPR gRNA sequence
gtcagggccagggcccccga

SEQ ID NO: 828 - DNA, 20 bp, Artificial
  CRISPR gRNA sequence
agggccagggcccccgagag

SEQ ID NO: 829 - DNA, 20 bp, Artificial
  CRISPR gRNA sequence
gccagggcccccgagagtag

SEQ ID NO: 830 - DNA, 20 bp, Artificial
  CRISPR gRNA sequence
ccagggcccccgagagtagc

SEQ ID NO: 831 - DNA, 20 bp, Artificial
  CRISPR gRNA sequence
agggcccccgagagtagcag

SEQ ID NO: 832 - DNA, 20 bp, Artificial
  CRISPR gRNA sequence
gggcccccgagagtagcagg

SEQ ID NO: 833 - DNA, 20 bp, Artificial
  CRISPR gRNA sequence
gcccccgagagtagcaggag

SEQ ID NO: 834 - DNA, 20 bp, Artificial
  CRISPR gRNA sequence
cccccgagagtagcaggagg

SEQ ID NO: 835 - DNA, 20 bp, Artificial
  CRISPR gRNA sequence
ccccgagagtagcaggagga

SEQ ID NO: 836 - DNA, 20 bp, Artificial
  CRISPR gRNA sequence
agagtagcaggaggagggtt

SEQ ID NO: 837 - DNA, 20 bp, Artificial
  CRISPR gRNA sequence
gagtagcaggaggagggttc

SEQ ID NO: 838 - DNA, 20 bp, Artificial
  CRISPR gRNA sequence
agtagcaggaggagggttcg

SEQ ID NO: 839 - DNA, 20 bp, Artificial
  CRISPR gRNA sequence
gagggttcggggcgccatga

SEQ ID NO: 840 - DNA, 20 bp, Artificial
  CRISPR gRNA sequence
ggcgccatgacggccatcct

SEQ ID NO: 841 - DNA, 20 bp, Artificial
  CRISPR gRNA sequence
tgacggccatcctcggcgtc

SEQ ID NO: 842 - DNA, 20 bp, Artificial
  CRISPR gRNA sequence
gacggccatcctcggcgtct

SEQ ID NO: 843 - DNA, 20 bp, Artificial
  CRISPR gRNA sequence
acggccatcctcggcgtctg

SEQ ID NO: 844 - DNA, 20 bp, Artificial
  CRISPR gRNA sequence
ggccatcctcggcgtctggg

SEQ ID NO: 845 - DNA, 20 bp, Artificial
  CRISPR gRNA sequence
tcggcgtctggggagaatct

SEQ ID NO: 846 - DNA, 20 bp, Artificial
  CRISPR gRNA sequence
tctggggagaatctgagtcc

SEQ ID NO: 847 - DNA, 20 bp, Artificial
  CRISPR gRNA sequence
ggggagaatctgagtcccgg

SEQ ID NO: 848 - DNA, 20 bp, Artificial
  CRISPR gRNA sequence
gggagaatctgagtcccggt

SEQ ID NO: 849 - DNA, 20 bp, Artificial
  CRISPR gRNA sequence
tgagtcccggtgggtgcgtg

SEQ ID NO: 850 - DNA, 20 bp, Artificial
  CRISPR gRNA sequence
gagtcccggtgggtgcgtgc

SEQ ID NO: 851 - DNA, 20 bp, Artificial
  CRISPR gRNA sequence
cggtgggtgcgtgcgggctt

SEQ ID NO: 852 - DNA, 20 bp, Artificial
  CRISPR gRNA sequence
ggtgcgtgcgggctttagaa

SEQ ID NO: 853 - DNA, 20 bp, Artificial
  CRISPR gRNA sequence
gcgaccgcgacgacactgat

SEQ ID NO: 854 - DNA, 20 bp, Artificial
  CRISPR gRNA sequence
acgacactgattggcttctc

SEQ ID NO: 855 - DNA, 20 bp, Artificial
  CRISPR gRNA sequence
tcagattctccccagacgcc

SEQ ID NO: 856 - DNA, 20 bp, Artificial
  CRISPR gRNA sequence
tggccctgacccagacctgg

SEQ ID NO: 857 - DNA, 20 bp, Artificial
  CRISPR gRNA sequence
cctgacccagacctgggcgg

SEQ ID NO: 858 - DNA, 20 bp, Artificial
  CRISPR gRNA sequence
cagacctgggcgggtgagtg

SEQ ID NO: 859 - DNA, 20 bp, Artificial
  CRISPR gRNA sequence
cgggggagccgcgccgggac

SEQ ID NO: 860 - DNA, 20 bp, Artificial
  CRISPR gRNA sequence
gacagcgacgccgcgagcca

SEQ ID NO: 861 - DNA, 20 bp, Artificial
  CRISPR gRNA sequence
aggatggagccgcgggcgcc

SEQ ID NO: 862 - DNA, 20 bp, Artificial
  CRISPR gRNA sequence
gtggatagagcaggaggggc

SEQ ID NO: 863 - DNA, 20 bp, Artificial
  CRISPR gRNA sequence
agtattgggaccaggagaca

SEQ ID NO: 864 - DNA, 20 bp, Artificial
  CRISPR gRNA sequence
aaggcccagtcacagactga

SEQ ID NO: 865 - DNA, 20 bp, Artificial
  CRISPR gRNA sequence
ctacaaccagagcgaggccg

SEQ ID NO: 866 - DNA, 20 bp, Artificial
  CRISPR gRNA sequence
ggccaggtcgcccacagtct

SEQ ID NO: 867 - DNA, 20 bp, Artificial
  CRISPR gRNA sequence
agtttaggccaaaaatcccc

SEQ ID NO: 868 - DNA, 20 bp, Artificial
  CRISPR gRNA sequence
tcgggggactgggctgaccg

SEQ ID NO: 869 - DNA, 20 bp, Artificial
  CRISPR gRNA sequence
gataatgtatggctgcgacg

SEQ ID NO: 870 - DNA, 20 bp, Artificial
  CRISPR gRNA sequence
gtcggacgggcgcttcctcc

SEQ ID NO: 871 - DNA, 20 bp, Artificial
  CRISPR gRNA sequence
ggcaggacgcctacgacggc

SEQ ID NO: 872 - DNA, 20 bp, Artificial
  CRISPR gRNA sequence
cggagcagttgagagcctac

SEQ ID NO: 873 - DNA, 20 bp, Artificial
  CRISPR gRNA sequence
ctacctggatggcacgtgcg

SEQ ID NO: 874 - DNA, 20 bp, Artificial
  CRISPR gRNA sequence
ggaaggagacgctgcagcgc

SEQ ID NO: 875 - DNA, 20 bp, Artificial
  CRISPR gRNA sequence
gagacaattgggaccaacac

SEQ ID NO: 876 - DNA, 20 bp, Artificial
  CRISPR gRNA sequence
tccctctggtcctgagggag

SEQ ID NO: 877 - DNA, 20 bp, Artificial
  CRISPR gRNA sequence
cctgagggagaggaatcctc

SEQ ID NO: 878 - DNA, 20 bp, Artificial
  CRISPR gRNA sequence
gggttccagatcctgtacca

SEQ ID NO: 879 - DNA, 20 bp, Artificial
  CRISPR gRNA sequence
cctgctctctgacacaatta

SEQ ID NO: 880 - DNA, 20 bp, Artificial
  CRISPR gRNA sequence
ttaagggataaaatctctga

SEQ ID NO: 881 - DNA, 20 bp, Artificial
  CRISPR gRNA sequence
agtgacgggaagacgatccc

SEQ ID NO: 882 - DNA, 20 bp, Artificial
  CRISPR gRNA sequence
agacgatccctcgaatactg

SEQ ID NO: 883 - DNA, 20 bp, Artificial
  CRISPR gRNA sequence
gcttcacactcaatgtgtgt

SEQ ID NO: 884 - DNA, 20 bp, Artificial
  CRISPR gRNA sequence
cactcaatgtgtgtgggggt

SEQ ID NO: 885 - DNA, 20 bp, Artificial
  CRISPR gRNA sequence
ggggtctgagtccagcactt

SEQ ID NO: 886 - DNA, 20 bp, Artificial
  CRISPR gRNA sequence
aagtcgctgttcccttctca

SEQ ID NO: 887 - DNA, 20 bp, Artificial
  CRISPR gRNA sequence
gcctgtgtccaggctggtgt

SEQ ID NO: 888 - DNA, 20 bp, Artificial
  CRISPR gRNA sequence
tctgtgctctcttccccatc

SEQ ID NO: 889 - DNA, 20 bp, Artificial
  CRISPR gRNA sequence
gatggccacatgcgtgctgg

SEQ ID NO: 890 - DNA, 20 bp, Artificial
  CRISPR gRNA sequence
ccatgacagatgcaaaatgc

SEQ ID NO: 891 - DNA, 20 bp, Artificial
  CRISPR gRNA sequence
agatcacactgacctggcag

SEQ ID NO: 892 - DNA, 20 bp, Artificial
  CRISPR gRNA sequence
tcgtggagaccaggcctgca

SEQ ID NO: 893 - DNA, 20 bp, Artificial
  CRISPR gRNA sequence
acacctgccatgtgcagcat

SEQ ID NO: 894 - DNA, 20 bp, Artificial
  CRISPR gRNA sequence
ccaagcccctcaccctgaga

SEQ ID NO: 895 - DNA, 20 bp, Artificial
  CRISPR gRNA sequence
gatggggtaaggagggagat

SEQ ID NO: 896 - DNA, 20 bp, Artificial
  CRISPR gRNA sequence
gcctctctggagacctttag

SEQ ID NO: 897 - DNA, 20 bp, Artificial
  CRISPR gRNA sequence
aggaagagctcaggtggaga

SEQ ID NO: 898 - DNA, 20 bp, Artificial
  CRISPR gRNA sequence
gctcaggtggagaaggggtg

SEQ ID NO: 899 - DNA, 20 bp, Artificial
  CRISPR gRNA sequence
ggtggagaaggggtgaaggg

SEQ ID NO: 900 - DNA, 20 bp, Artificial
  CRISPR gRNA sequence
ctgagatttcttgtctcact

SEQ ID NO: 901 - DNA, 20 bp, Artificial
  CRISPR gRNA sequence
ccagcaatgatgcccacgat

SEQ ID NO: 902 - DNA, 20 bp, Artificial
  CRISPR gRNA sequence
tctccctccttaccccatct

SEQ ID NO: 903 - DNA, 20 bp, Artificial
  CRISPR gRNA sequence
gtctccacgagctccgtgtc

SEQ ID NO: 904 - DNA, 20 bp, Artificial
  CRISPR gRNA sequence
ccaggtcagtgtgatctccg

SEQ ID NO: 905 - DNA, 20 bp, Artificial
  CRISPR gRNA sequence
aagcccagggcccagcacct

SEQ ID NO: 906 - DNA, 20 bp, Artificial
  CRISPR gRNA sequence
ggtggcctcatggtcagaga

SEQ ID NO: 907 - DNA, 20 bp, Artificial
  CRISPR gRNA sequence
tcatggtcagagatggggtg

SEQ ID NO: 908 - DNA, 20 bp, Artificial
  CRISPR gRNA sequence
gtgggtcatatgtgtcttgg

SEQ ID NO: 909 - DNA, 20 bp, Artificial
  CRISPR gRNA sequence
tcttgggggggtctgacggg

SEQ ID NO: 910 - DNA, 20 bp, Artificial
  CRISPR gRNA sequence
agcacgcatgtggccatctt

SEQ ID NO: 911 - DNA, 20 bp, Artificial
  CRISPR gRNA sequence
ttgagaatggacaggacacc

SEQ ID NO: 912 - DNA, 20 bp, Artificial
  CRISPR gRNA sequence
ccagcctggacacaggcacc

SEQ ID NO: 913 - DNA, 20 bp, Artificial
  CRISPR gRNA sequence
cagcgacttctggtcctgac

SEQ ID NO: 914 - DNA, 20 bp, Artificial
  CRISPR gRNA sequence
gactcagacccccacacaca

SEQ ID NO: 915 - DNA, 20 bp, Artificial
  CRISPR gRNA sequence
gaaccactcatcagtattcg

SEQ ID NO: 916 - DNA, 20 bp, Artificial
  CRISPR gRNA sequence
cagagagcagggcggaacct

SEQ ID NO: 917 - DNA, 20 bp, Artificial
  CRISPR gRNA sequence
ctcagagtcactctctggta

SEQ ID NO: 918 - DNA, 20 bp, Artificial
  CRISPR gRNA sequence
gtacaggatctggaacccag

SEQ ID NO: 919 - DNA, 20 bp, Artificial
  CRISPR gRNA sequence
ctctccctcaggaccagagg

SEQ ID NO: 920 - DNA, 20 bp, Artificial
  CRISPR gRNA sequence
acgtcgcagccatacattat

SEQ ID NO: 921 - DNA, 20 bp, Artificial
  CRISPR gRNA sequence
cccagccccgaccaacccgg

SEQ ID NO: 922 - DNA, 20 bp, Artificial
  CRISPR gRNA sequence
ggcctaaactgaaaatgaaa

SEQ ID NO: 923 - DNA, 20 bp, Artificial
  CRISPR gRNA sequence
gcctgggcctctcccggggc

SEQ ID NO: 924 - DNA, 20 bp, Artificial
  CRISPR gRNA sequence
ctctcccggggcaagggtct

SEQ ID NO: 925 - DNA, 20 bp, Artificial
  CRISPR gRNA sequence
gtctcggggtcccgcggctt

SEQ ID NO: 926 - DNA, 20 bp, Artificial
  CRISPR gRNA sequence
cggggtcccgcggcttcggg

SEQ ID NO: 927 - DNA, 20 bp, Artificial
  CRISPR gRNA sequence
ggcgacctggcccgtccgtg

SEQ ID NO: 928 - DNA, 20 bp, Artificial
  CRISPR gRNA sequence
tggcccgtccgtgggggatg

SEQ ID NO: 929 - DNA, 20 bp, Artificial
  CRISPR gRNA sequence
tcctgacctgcgcccccggc

SEQ ID NO: 930 - DNA, 20 bp, Artificial
  CRISPR gRNA sequence
ctctggttgtagtagccgcg

SEQ ID NO: 931 - DNA, 20 bp, Artificial
  CRISPR gRNA sequence
ccccgcggccgggccgggac

SEQ ID NO: 932 - DNA, 20 bp, Artificial
  CRISPR gRNA sequence
ggatgtgaagaaatacctca

SEQ ID NO: 933 - DNA, 20 bp, Artificial
  CRISPR gRNA sequence
ccgcactcacccgcccaggt

SEQ ID NO: 934 - DNA, 20 bp, Artificial
  CRISPR gRNA sequence
gggtcagggccagggccccc

SEQ ID NO: 935 - DNA, 20 bp, Artificial
  CRISPR gRNA sequence
gcccccgagagtagcaggag

SEQ ID NO: 936 - DNA, 20 bp, Artificial
  CRISPR gRNA sequence
ggccatcctcggcgtctggg

SEQ ID NO: 937 - DNA, 20 bp, Artificial
  CRISPR gRNA sequence
cctcggcgtctggggagaat

SEQ ID NO: 938 - DNA, 20 bp, Artificial
  CRISPR gRNA sequence
tggggagaatctgagtcccg

SEQ ID NO: 939 - DNA, 20 bp, Artificial
  CRISPR gRNA sequence
cccgcacgcacccaccggga

SEQ ID NO: 940 - DNA, 20 bp, Artificial
  CRISPR gRNA sequence
cccggcccggccgcggggag

SEQ ID NO: 941 - DNA, 20 bp, Artificial
  CRISPR gRNA sequence
gagaggcccaggcgccttta

SEQ ID NO: 942 - DNA, 20 bp, Artificial
  CRISPR gRNA sequence
cgcctttacccggtttcatt

SEQ ID NO: 943 - DNA, 20 bp, Artificial
  CRISPR gRNA sequence
gctgcgacgtggggtcggac

SEQ ID NO: 944 - DNA, 20 bp, Artificial
  CRISPR gRNA sequence
cggcaggacgcctacgacgg

SEQ ID NO: 945 - DNA, 20 bp, Artificial
  CRISPR gRNA sequence
ttttcctctcaggccttgtt

SEQ ID NO: 946 - DNA, 20 bp, Artificial
  CRISPR gRNA sequence
ctgttcccttctcagggaat

SEQ ID NO: 947 - DNA, 20 bp, Artificial
  CRISPR gRNA sequence
ccaccctgaggtgctgggcc

SEQ ID NO: 948 - DNA, 20 bp, Artificial
  CRISPR gRNA sequence
gaaggggtgaagggtggggt

SEQ ID NO: 949 - DNA, 20 bp, Artificial
  CRISPR gRNA sequence
agacagggcacatttctagc

SEQ ID NO: 950 - DNA, 20 bp, Artificial
  CRISPR gRNA sequence
ctaaaggtctccagagaggc

SEQ ID NO: 951 - DNA, 20 bp, Artificial
  CRISPR gRNA sequence
ccttaccccatctcagggtg

SEQ ID NO: 952 - DNA, 20 bp, Artificial
  CRISPR gRNA sequence
tcgtcttcccgtcactcctt

SEQ ID NO: 953 - DNA, 20 bp, Artificial
  CRISPR gRNA sequence
ggtacaggatctggaaccca

SEQ ID NO: 954 - DNA, 20 bp, Artificial
  CRISPR gRNA sequence
cctcatgggccgcctcccac

SEQ ID NO: 955 - DNA, 20 bp, Artificial
  CRISPR gRNA sequence
gcccagccccgaccaacccg

SEQ ID NO: 956 - DNA, 20 bp, Artificial
  CRISPR gRNA sequence
gggcaagggtctcggggtcc

SEQ ID NO: 957 - DNA, 20 bp, Artificial
  CRISPR gRNA sequence
gcgcccccgccaggagggcc

SEQ ID NO: 958 - DNA, 20 bp, Artificial
  CRISPR gRNA sequence
cccttgcttctccccgcaga

SEQ ID NO: 959 - DNA, 20 bp, Artificial
  CRISPR gRNA sequence
ctgagtcccggtgggtgcgt

SEQ ID NO: 960 - DNA, 20 bp, Artificial
  CRISPR gRNA sequence
tagaacagcgaccgcgacga

SEQ ID NO: 961 - DNA, 20 bp, Artificial
  CRISPR gRNA sequence
cagcgaccgcgacgacactg

SEQ ID NO: 962 - DNA, 20 bp, Artificial
  CRISPR gRNA sequence
ggagacaattgggaccaaca

SEQ ID NO: 963 - DNA, 20 bp, Artificial
  CRISPR gRNA sequence
ctgagggttccaagccccag

SEQ ID NO: 964 - DNA, 20 bp, Artificial
  CRISPR gRNA sequence
gcttggaaccctcagtgaga

SEQ ID NO: 965 - DNA, 20 bp, Artificial
  CRISPR gRNA sequence
ggggggtctgacgggaagag

SEQ ID NO: 966 - DNA, 20 bp, Artificial
  CRISPR gRNA sequence
cagcacgcatgtggccatct

SEQ ID NO: 967 - DNA, 20 bp, Artificial
  CRISPR gRNA sequence
ccgggccgggacacggatgt

SEQ ID NO: 968 - DNA, 20 bp, Artificial
  CRISPR gRNA sequence
cggccatcctcggcgtctgg

SEQ ID NO: 969 - DNA, 20 bp, Artificial
  CRISPR gRNA sequence
ccagagaagccaatcagtgt

SEQ ID NO: 970 - DNA, 20 bp, Artificial
  CRISPR gRNA sequence
cagagaagccaatcagtgtc

SEQ ID NO: 971 - DNA, 20 bp, Artificial
  CRISPR gRNA sequence
ttctaaagcccgcacgcacc

SEQ ID NO: 972 - DNA, 20 bp, Artificial
  CRISPR gRNA sequence
taaagcccgcacgcacccac

SEQ ID NO: 973 - DNA, 20 bp, Artificial
  CRISPR gRNA sequence
aagcccgcacgcacccaccg

SEQ ID NO: 974 - DNA, 20 bp, Artificial
  CRISPR gRNA sequence
agattctccccagacgccga

SEQ ID NO: 975 - DNA, 20 bp, Artificial
  CRISPR gRNA sequence
tccccagacgccgaggatgg

SEQ ID NO: 976 - DNA, 20 bp, Artificial
  CRISPR gRNA sequence
cccagacgccgaggatggcc

SEQ ID NO: 977 - DNA, 20 bp, Artificial
  CRISPR gRNA sequence
ctcctgctactctcgggggc

SEQ ID NO: 978 - DNA, 20 bp, Artificial
  CRISPR gRNA sequence
ctgctactctcgggggccct

SEQ ID NO: 979 - DNA, 20 bp, Artificial
  CRISPR gRNA sequence
ctactctcgggggccctggc

SEQ ID NO: 980 - DNA, 20 bp, Artificial
  CRISPR gRNA sequence
ctctcgggggccctggccct

SEQ ID NO: 981 - DNA, 20 bp, Artificial
  CRISPR gRNA sequence
tcgggggccctggccctgac

SEQ ID NO: 982 - DNA, 20 bp, Artificial
  CRISPR gRNA sequence
gggggccctggccctgaccc

SEQ ID NO: 983 - DNA, 20 bp, Artificial
  CRISPR gRNA sequence
gccctgacccagacctgggc

SEQ ID NO: 984 - DNA, 20 bp, Artificial
  CRISPR gRNA sequence
acccagacctgggcgggtga

SEQ ID NO: 985 - DNA, 20 bp, Artificial
  CRISPR gRNA sequence
ggcgggtgagtgcggggtcg

SEQ ID NO: 986 - DNA, 20 bp, Artificial
  CRISPR gRNA sequence
tgcggggagaagcaaggggc

SEQ ID NO: 987 - DNA, 20 bp, Artificial
  CRISPR gRNA sequence
cggggagaagcaaggggccc

SEQ ID NO: 988 - DNA, 20 bp, Artificial
  CRISPR gRNA sequence
ctggcgggggcgcaggaccg

SEQ ID NO: 989 - DNA, 20 bp, Artificial
  CRISPR gRNA sequence
gcgggggcgcaggaccgggg

SEQ ID NO: 990 - DNA, 20 bp, Artificial
  CRISPR gRNA sequence
agccactgctcgcccccagg

SEQ ID NO: 991 - DNA, 20 bp, Artificial
  CRISPR gRNA sequence
ctcgcccccaggctcccact

SEQ ID NO: 992 - DNA, 20 bp, Artificial
  CRISPR gRNA sequence
gcccccaggctcccactcca

SEQ ID NO: 993 - DNA, 20 bp, Artificial
  CRISPR gRNA sequence
ccactccatgaggtatttct

SEQ ID NO: 994 - DNA, 20 bp, Artificial
  CRISPR gRNA sequence
catgaggtatttcttcacat

SEQ ID NO: 995 - DNA, 20 bp, Artificial
  CRISPR gRNA sequence
cttcacatccgtgtcccggc

SEQ ID NO: 996 - DNA, 20 bp, Artificial
  CRISPR gRNA sequence
ttcacatccgtgtcccggcc

SEQ ID NO: 997 - DNA, 20 bp, Artificial
  CRISPR gRNA sequence
cacatccgtgtcccggcccg

SEQ ID NO: 998 - DNA, 20 bp, Artificial
  CRISPR gRNA sequence
acatccgtgtcccggcccgg

SEQ ID NO: 999 - DNA, 20 bp, Artificial
  CRISPR gRNA sequence
catcgccgtgggctacgtgg

SEQ ID NO: 1000 - DNA, 20 bp, Artificial
  CRISPR gRNA sequence
atcgccgtgggctacgtgga

SEQ ID NO: 1001 - DNA, 20 bp, Artificial
  CRISPR gRNA sequence
cgtggacgacacgcagttcg

SEQ ID NO: 1002 - DNA, 20 bp, Artificial
  CRISPR gRNA sequence
gtgcggttcgacagcgacgc

SEQ ID NO: 1003 - DNA, 20 bp, Artificial
  CRISPR gRNA sequence
gacagcgacgccgcgagcca

SEQ ID NO: 1004 - DNA, 20 bp, Artificial
  CRISPR gRNA sequence
ggaccaggagacacggaatg

SEQ ID NO: 1005 - DNA, 20 bp, Artificial
  CRISPR gRNA sequence
accgagtggacctggggacc

SEQ ID NO: 1006 - DNA, 20 bp, Artificial
  CRISPR gRNA sequence
gggaccctgcgcggctacta

SEQ ID NO: 1007 - DNA, 20 bp, Artificial
  CRISPR gRNA sequence
cgcggctactacaaccagag

SEQ ID NO: 1008 - DNA, 20 bp, Artificial
  CRISPR gRNA sequence
ctacaaccagagcgaggccg

SEQ ID NO: 1009 - DNA, 20 bp, Artificial
  CRISPR gRNA sequence
caaccagagcgaggccggtg

SEQ ID NO: 1010 - DNA, 20 bp, Artificial
  CRISPR gRNA sequence
atcccccacggacgggccag

SEQ ID NO: 1011 - DNA, 20 bp, Artificial
  CRISPR gRNA sequence
cgggtccgagatccaccccg

SEQ ID NO: 1012 - DNA, 20 bp, Artificial
  CRISPR gRNA sequence
gccccgggagaggcccaggc

SEQ ID NO: 1013 - DNA, 20 bp, Artificial
  CRISPR gRNA sequence
ccccgggagaggcccaggcg

SEQ ID NO: 1014 - DNA, 20 bp, Artificial
  CRISPR gRNA sequence
tacccggtttcattttcagt

SEQ ID NO: 1015 - DNA, 20 bp, Artificial
  CRISPR gRNA sequence
acccggtttcattttcagtt

SEQ ID NO: 1016 - DNA, 20 bp, Artificial
  CRISPR gRNA sequence
cccggtttcattttcagttt

SEQ ID NO: 1017 - DNA, 20 bp, Artificial
  CRISPR gRNA sequence
cattttcagtttaggccaaa

SEQ ID NO: 1018 - DNA, 20 bp, Artificial
  CRISPR gRNA sequence
attttcagtttaggccaaaa

SEQ ID NO: 1019 - DNA, 20 bp, Artificial
  CRISPR gRNA sequence
tcagtttaggccaaaaatcc

SEQ ID NO: 1020 - DNA, 20 bp, Artificial
  CRISPR gRNA sequence
cagtttaggccaaaaatccc

SEQ ID NO: 1021 - DNA, 20 bp, Artificial
  CRISPR gRNA sequence
agtttaggccaaaaatcccc

SEQ ID NO: 1022 - DNA, 20 bp, Artificial
  CRISPR gRNA sequence
aggccaaaaatccccccggg

SEQ ID NO: 1023 - DNA, 20 bp, Artificial
  CRISPR gRNA sequence
ggccaaaaatccccccgggt

SEQ ID NO: 1024 - DNA, 20 bp, Artificial
  CRISPR gRNA sequence
gtcggggctgggcggggctc

SEQ ID NO: 1025 - DNA, 20 bp, Artificial
  CRISPR gRNA sequence
ggcggggctcgggggactgg

SEQ ID NO: 1026 - DNA, 20 bp, Artificial
  CRISPR gRNA sequence
gggggactgggctgaccgcg

SEQ ID NO: 1027 - DNA, 20 bp, Artificial
  CRISPR gRNA sequence
ggctgaccgcggggtcgggg

SEQ ID NO: 1028 - DNA, 20 bp, Artificial
  CRISPR gRNA sequence
accgcggggtcggggccagg

SEQ ID NO: 1029 - DNA, 20 bp, Artificial
  CRISPR gRNA sequence
tcacaccatccagataatgt

SEQ ID NO: 1030 - DNA, 20 bp, Artificial
  CRISPR gRNA sequence
acaccatccagataatgtat

SEQ ID NO: 1031 - DNA, 20 bp, Artificial
  CRISPR gRNA sequence
cgacgtggggtcggacgggc

SEQ ID NO: 1032 - DNA, 20 bp, Artificial
  CRISPR gRNA sequence
cctccgcgggtaccggcagg

SEQ ID NO: 1033 - DNA, 20 bp, Artificial
  CRISPR gRNA sequence
ctccgcgggtaccggcagga

SEQ ID NO: 1034 - DNA, 20 bp, Artificial
  CRISPR gRNA sequence
cgcgggtaccggcaggacgc

SEQ ID NO: 1035 - DNA, 20 bp, Artificial
  CRISPR gRNA sequence
cgacggcaaggattacatcg

SEQ ID NO: 1036 - DNA, 20 bp, Artificial
  CRISPR gRNA sequence
catcgccctgaacgaggacc

SEQ ID NO: 1037 - DNA, 20 bp, Artificial
  CRISPR gRNA sequence
aacgaggacctgcgctcttg

SEQ ID NO: 1038 - DNA, 20 bp, Artificial
  CRISPR gRNA sequence
cgctcttggaccgcggcgga

SEQ ID NO: 1039 - DNA, 20 bp, Artificial
  CRISPR gRNA sequence
ttggaccgcggcggacatgg

SEQ ID NO: 1040 - DNA, 20 bp, Artificial
  CRISPR gRNA sequence
ggaccgcggcggacatggcg

SEQ ID NO: 1041 - DNA, 20 bp, Artificial
  CRISPR gRNA sequence
gaccgcggcggacatggcgg

SEQ ID NO: 1042 - DNA, 20 bp, Artificial
  CRISPR gRNA sequence
agatcaccaagcgcaagtgg

SEQ ID NO: 1043 - DNA, 20 bp, Artificial
  CRISPR gRNA sequence
agagcctacctggatggcac

SEQ ID NO: 1044 - DNA, 20 bp, Artificial
  CRISPR gRNA sequence
cctggatggcacgtgcgtgg

SEQ ID NO: 1045 - DNA, 20 bp, Artificial
  CRISPR gRNA sequence
gatggcacgtgcgtggagtg

SEQ ID NO: 1046 - DNA, 20 bp, Artificial
  CRISPR gRNA sequence
cgcagatacctggagaacgg

SEQ ID NO: 1047 - DNA, 20 bp, Artificial
  CRISPR gRNA sequence
gagaacgggaaggagacgct

SEQ ID NO: 1048 - DNA, 20 bp, Artificial
  CRISPR gRNA sequence
cagcgcacgggtaccagggg

SEQ ID NO: 1049 - DNA, 20 bp, Artificial
  CRISPR gRNA sequence
cctgatcgcctgtagatctc

SEQ ID NO: 1050 - DNA, 20 bp, Artificial
  CRISPR gRNA sequence
atcgcctgtagatctcccgg

SEQ ID NO: 1051 - DNA, 20 bp, Artificial
  CRISPR gRNA sequence
tagatctcccgggctggcct

SEQ ID NO: 1052 - DNA, 20 bp, Artificial
  CRISPR gRNA sequence
ccgggctggcctcccacaag

SEQ ID NO: 1053 - DNA, 20 bp, Artificial
  CRISPR gRNA sequence
gcctcccacaaggaggggag

SEQ ID NO: 1054 - DNA, 20 bp, Artificial
  CRISPR gRNA sequence
ccacaaggaggggagacaat

SEQ ID NO: 1055 - DNA, 20 bp, Artificial
  CRISPR gRNA sequence
ggaccaacactagaatatca

SEQ ID NO: 1056 - DNA, 20 bp, Artificial
  CRISPR gRNA sequence
gaatatcaccctccctctgg

SEQ ID NO: 1057 - DNA, 20 bp, Artificial
  CRISPR gRNA sequence
cctctggtcctgagggagag

SEQ ID NO: 1058 - DNA, 20 bp, Artificial
  CRISPR gRNA sequence
tggtcctgagggagaggaat

SEQ ID NO: 1059 - DNA, 20 bp, Artificial
  CRISPR gRNA sequence
gtcctgagggagaggaatcc

SEQ ID NO: 1060 - DNA, 20 bp, Artificial
  CRISPR gRNA sequence
agggagaggaatcctcctgg

SEQ ID NO: 1061 - DNA, 20 bp, Artificial
  CRISPR gRNA sequence
ctgggttccagatcctgtac

SEQ ID NO: 1062 - DNA, 20 bp, Artificial
  CRISPR gRNA sequence
ggttccagatcctgtaccag

SEQ ID NO: 1063 - DNA, 20 bp, Artificial
  CRISPR gRNA sequence
cagatcctgtaccagagagt

SEQ ID NO: 1064 - DNA, 20 bp, Artificial
  CRISPR gRNA sequence
taccagagagtgactctgag

SEQ ID NO: 1065 - DNA, 20 bp, Artificial
  CRISPR gRNA sequence
tgaggttccgccctgctctc

SEQ ID NO: 1066 - DNA, 20 bp, Artificial
  CRISPR gRNA sequence
aggttccgccctgctctctg

SEQ ID NO: 1067 - DNA, 20 bp, Artificial
  CRISPR gRNA sequence
cgccctgctctctgacacaa

SEQ ID NO: 1068 - DNA, 20 bp, Artificial
  CRISPR gRNA sequence
ctctctgacacaattaaggg

SEQ ID NO: 1069 - DNA, 20 bp, Artificial
  CRISPR gRNA sequence
tctgacacaattaagggata

SEQ ID NO: 1070 - DNA, 20 bp, Artificial
  CRISPR gRNA sequence
tgacacaattaagggataaa

SEQ ID NO: 1071 - DNA, 20 bp, Artificial
  CRISPR gRNA sequence
acacaattaagggataaaat

SEQ ID NO: 1072 - DNA, 20 bp, Artificial
  CRISPR gRNA sequence
agggataaaatctctgaagg

SEQ ID NO: 1073 - DNA, 20 bp, Artificial
  CRISPR gRNA sequence
tgaaggagtgacgggaagac

SEQ ID NO: 1074 - DNA, 20 bp, Artificial
  CRISPR gRNA sequence
aaggagtgacgggaagacga

SEQ ID NO: 1075 - DNA, 20 bp, Artificial
  CRISPR gRNA sequence
gaatactgatgagtggttcc

SEQ ID NO: 1076 - DNA, 20 bp, Artificial
  CRISPR gRNA sequence
atgagtggttccctttgaca

SEQ ID NO: 1077 - DNA, 20 bp, Artificial
  CRISPR gRNA sequence
cctttgacaccggcagcagc

SEQ ID NO: 1078 - DNA, 20 bp, Artificial
  CRISPR gRNA sequence
tgacaccggcagcagccttg

SEQ ID NO: 1079 - DNA, 20 bp, Artificial
  CRISPR gRNA sequence
gacaccggcagcagccttgg

SEQ ID NO: 1080 - DNA, 20 bp, Artificial
  CRISPR gRNA sequence
acaccggcagcagccttggg

SEQ ID NO: 1081 - DNA, 20 bp, Artificial
  CRISPR gRNA sequence
gggcccgtgacttttcctct

SEQ ID NO: 1082 - DNA, 20 bp, Artificial
  CRISPR gRNA sequence
ggcccgtgacttttcctctc

SEQ ID NO: 1083 - DNA, 20 bp, Artificial
  CRISPR gRNA sequence
ttcctctcaggccttgttct

SEQ ID NO: 1084 - DNA, 20 bp, Artificial
  CRISPR gRNA sequence
tcctctcaggccttgttctc

SEQ ID NO: 1085 - DNA, 20 bp, Artificial
  CRISPR gRNA sequence
cctctcaggccttgttctct

SEQ ID NO: 1086 - DNA, 20 bp, Artificial
  CRISPR gRNA sequence
ctctcaggccttgttctctg

SEQ ID NO: 1087 - DNA, 20 bp, Artificial
  CRISPR gRNA sequence
tcaggccttgttctctgctt

SEQ ID NO: 1088 - DNA, 20 bp, Artificial
  CRISPR gRNA sequence
aggccttgttctctgcttca

SEQ ID NO: 1089 - DNA, 20 bp, Artificial
  CRISPR gRNA sequence
gttctctgcttcacactcaa

SEQ ID NO: 1090 - DNA, 20 bp, Artificial
  CRISPR gRNA sequence
ttctctgcttcacactcaat

SEQ ID NO: 1091 - DNA, 20 bp, Artificial
  CRISPR gRNA sequence
tctgcttcacactcaatgtg

SEQ ID NO: 1092 - DNA, 20 bp, Artificial
  CRISPR gRNA sequence
tgcttcacactcaatgtgtg

SEQ ID NO: 1093 - DNA, 20 bp, Artificial
  CRISPR gRNA sequence
cttcacactcaatgtgtgtg

SEQ ID NO: 1094 - DNA, 20 bp, Artificial
  CRISPR gRNA sequence
cacactcaatgtgtgtgggg

SEQ ID NO: 1095 - DNA, 20 bp, Artificial
  CRISPR gRNA sequence
acactcaatgtgtgtggggg

SEQ ID NO: 1096 - DNA, 20 bp, Artificial
  CRISPR gRNA sequence
aatgtgtgtgggggtctgag

SEQ ID NO: 1097 - DNA, 20 bp, Artificial
  CRISPR gRNA sequence
agtccagcacttctgagtcc

SEQ ID NO: 1098 - DNA, 20 bp, Artificial
  CRISPR gRNA sequence
ctgagtccctcagcctccac

SEQ ID NO: 1099 - DNA, 20 bp, Artificial
  CRISPR gRNA sequence
tgagtccctcagcctccact

SEQ ID NO: 1100 - DNA, 20 bp, Artificial
  CRISPR gRNA sequence
agtccctcagcctccactca

SEQ ID NO: 1101 - DNA, 20 bp, Artificial
  CRISPR gRNA sequence
agcctccactcaggtcagga

SEQ ID NO: 1102 - DNA, 20 bp, Artificial
  CRISPR gRNA sequence
cactcaggtcaggaccagaa

SEQ ID NO: 1103 - DNA, 20 bp, Artificial
  CRISPR gRNA sequence
aggtcaggaccagaagtcgc

SEQ ID NO: 1104 - DNA, 20 bp, Artificial
  CRISPR gRNA sequence
ttcccttctcagggaataga

SEQ ID NO: 1105 - DNA, 20 bp, Artificial
  CRISPR gRNA sequence
ccttctcagggaatagaaga

SEQ ID NO: 1106 - DNA, 20 bp, Artificial
  CRISPR gRNA sequence
ctcagggaatagaagattat

SEQ ID NO: 1107 - DNA, 20 bp, Artificial
  CRISPR gRNA sequence
tcagggaatagaagattatc

SEQ ID NO: 1108 - DNA, 20 bp, Artificial
  CRISPR gRNA sequence
agggaatagaagattatccc

SEQ ID NO: 1109 - DNA, 20 bp, Artificial
  CRISPR gRNA sequence
tcccaggtgcctgtgtccag

SEQ ID NO: 1110 - DNA, 20 bp, Artificial
  CRISPR gRNA sequence
tgtccaggctggtgtctggg

SEQ ID NO: 1111 - DNA, 20 bp, Artificial
  CRISPR gRNA sequence
gtgtctgggttctgtgctct

SEQ ID NO: 1112 - DNA, 20 bp, Artificial
  CRISPR gRNA sequence
ggttctgtgctctcttcccc

SEQ ID NO: 1113 - DNA, 20 bp, Artificial
  CRISPR gRNA sequence
tgtgctctcttccccatccc

SEQ ID NO: 1114 - DNA, 20 bp, Artificial
  CRISPR gRNA sequence
tgctctcttccccatcccgg

SEQ ID NO: 1115 - DNA, 20 bp, Artificial
  CRISPR gRNA sequence
tcttccccatcccgggtgtc

SEQ ID NO: 1116 - DNA, 20 bp, Artificial
  CRISPR gRNA sequence
ttccccatcccgggtgtcct

SEQ ID NO: 1117 - DNA, 20 bp, Artificial
  CRISPR gRNA sequence
ccccatcccgggtgtcctgt

SEQ ID NO: 1118 - DNA, 20 bp, Artificial
  CRISPR gRNA sequence
cccatcccgggtgtcctgtc

SEQ ID NO: 1119 - DNA, 20 bp, Artificial
  CRISPR gRNA sequence
tccattctcaagatggccac

SEQ ID NO: 1120 - DNA, 20 bp, Artificial
  CRISPR gRNA sequence
tcaagatggccacatgcgtg

SEQ ID NO: 1121 - DNA, 20 bp, Artificial
  CRISPR gRNA sequence
aagatggccacatgcgtgct

SEQ ID NO: 1122 - DNA, 20 bp, Artificial
  CRISPR gRNA sequence
gtggagtgtcccatgacaga

SEQ ID NO: 1123 - DNA, 20 bp, Artificial
  CRISPR gRNA sequence
aattttctgactcttcccgt

SEQ ID NO: 1124 - DNA, 20 bp, Artificial
  CRISPR gRNA sequence
tctgactcttcccgtcagac

SEQ ID NO: 1125 - DNA, 20 bp, Artificial
  CRISPR gRNA sequence
ctgactcttcccgtcagacc

SEQ ID NO: 1126 - DNA, 20 bp, Artificial
  CRISPR gRNA sequence
tgactcttcccgtcagaccc

SEQ ID NO: 1127 - DNA, 20 bp, Artificial
  CRISPR gRNA sequence
actcttcccgtcagaccccc

SEQ ID NO: 1128 - DNA, 20 bp, Artificial
  CRISPR gRNA sequence
ttcccgtcagacccccccaa

SEQ ID NO: 1129 - DNA, 20 bp, Artificial
  CRISPR gRNA sequence
cccgtcagacccccccaaga

SEQ ID NO: 1130 - DNA, 20 bp, Artificial
  CRISPR gRNA sequence
ccgtcagacccccccaagac

SEQ ID NO: 1131 - DNA, 20 bp, Artificial
  CRISPR gRNA sequence
tgaccatgaggccaccctga

SEQ ID NO: 1132 - DNA, 20 bp, Artificial
  CRISPR gRNA sequence
accatgaggccaccctgagg

SEQ ID NO: 1133 - DNA, 20 bp, Artificial
  CRISPR gRNA sequence
aggtgctgggccctgggctt

SEQ ID NO: 1134 - DNA, 20 bp, Artificial
  CRISPR gRNA sequence
ggccctgggcttctaccctg

SEQ ID NO: 1135 - DNA, 20 bp, Artificial
  CRISPR gRNA sequence
ggcttctaccctgcggagat

SEQ ID NO: 1136 - DNA, 20 bp, Artificial
  CRISPR gRNA sequence
ctaccctgcggagatcacac

SEQ ID NO: 1137 - DNA, 20 bp, Artificial
  CRISPR gRNA sequence
taccctgcggagatcacact

SEQ ID NO: 1138 - DNA, 20 bp, Artificial
  CRISPR gRNA sequence
ccctgcggagatcacactga

SEQ ID NO: 1139 - DNA, 20 bp, Artificial
  CRISPR gRNA sequence
cggagatcacactgacctgg

SEQ ID NO: 1140 - DNA, 20 bp, Artificial
  CRISPR gRNA sequence
acctggcagcgggatgggga

SEQ ID NO: 1141 - DNA, 20 bp, Artificial
  CRISPR gRNA sequence
gcagcgggatggggaggacc

SEQ ID NO: 1142 - DNA, 20 bp, Artificial
  CRISPR gRNA sequence
gtggagaccaggcctgcagg

SEQ ID NO: 1143 - DNA, 20 bp, Artificial
  CRISPR gRNA sequence
caggggatggaaccttccag

SEQ ID NO: 1144 - DNA, 20 bp, Artificial
  CRISPR gRNA sequence
ccagaagtgggcggctgtgg

SEQ ID NO: 1145 - DNA, 20 bp, Artificial
  CRISPR gRNA sequence
cagaagtgggcggctgtggt

SEQ ID NO: 1146 - DNA, 20 bp, Artificial
  CRISPR gRNA sequence
tggtggtgccttctggagag

SEQ ID NO: 1147 - DNA, 20 bp, Artificial
  CRISPR gRNA sequence
ctggagaggagcagagatac

SEQ ID NO: 1148 - DNA, 20 bp, Artificial
  CRISPR gRNA sequence
tggagaggagcagagataca

SEQ ID NO: 1149 - DNA, 20 bp, Artificial
  CRISPR gRNA sequence
gagaggagcagagatacacc

SEQ ID NO: 1150 - DNA, 20 bp, Artificial
  CRISPR gRNA sequence
ccatgtgcagcatgagggtc

SEQ ID NO: 1151 - DNA, 20 bp, Artificial
  CRISPR gRNA sequence
cccaagcccctcaccctgag

SEQ ID NO: 1152 - DNA, 20 bp, Artificial
  CRISPR gRNA sequence
accctgagatggggtaagga

SEQ ID NO: 1153 - DNA, 20 bp, Artificial
  CRISPR gRNA sequence
agatggggtaaggagggaga

SEQ ID NO: 1154 - DNA, 20 bp, Artificial
  CRISPR gRNA sequence
ttagggaaagcaggagcctc

SEQ ID NO: 1155 - DNA, 20 bp, Artificial
  CRISPR gRNA sequence
agggaaagcaggagcctctc

SEQ ID NO: 1156 - DNA, 20 bp, Artificial
  CRISPR gRNA sequence
gggaaagcaggagcctctct

SEQ ID NO: 1157 - DNA, 20 bp, Artificial
  CRISPR gRNA sequence
tctggagacctttagcaggg

SEQ ID NO: 1158 - DNA, 20 bp, Artificial
  CRISPR gRNA sequence
tggagacctttagcagggtc

SEQ ID NO: 1159 - DNA, 20 bp, Artificial
  CRISPR gRNA sequence
gagacctttagcagggtcag

SEQ ID NO: 1160 - DNA, 20 bp, Artificial
  CRISPR gRNA sequence
tagcagggtcagggcccctc

SEQ ID NO: 1161 - DNA, 20 bp, Artificial
  CRISPR gRNA sequence
agcagggtcagggcccctca

SEQ ID NO: 1162 - DNA, 20 bp, Artificial
  CRISPR gRNA sequence
gcagggtcagggcccctcac

SEQ ID NO: 1163 - DNA, 20 bp, Artificial
  CRISPR gRNA sequence
accttcccctcttttcccag

SEQ ID NO: 1164 - DNA, 20 bp, Artificial
  CRISPR gRNA sequence
cccctcttttcccagagctg

SEQ ID NO: 1165 - DNA, 20 bp, Artificial
  CRISPR gRNA sequence
ccctcttttcccagagctgt

SEQ ID NO: 1166 - DNA, 20 bp, Artificial
  CRISPR gRNA sequence
ttttcccagagctgtcttcc

SEQ ID NO: 1167 - DNA, 20 bp, Artificial
  CRISPR gRNA sequence
ttcccagagctgtcttccca

SEQ ID NO: 1168 - DNA, 20 bp, Artificial
  CRISPR gRNA sequence
tcccagagctgtcttcccag

SEQ ID NO: 1169 - DNA, 20 bp, Artificial
  CRISPR gRNA sequence
cccagagctgtcttcccagc

SEQ ID NO: 1170 - DNA, 20 bp, Artificial
  CRISPR gRNA sequence
ccagagctgtcttcccagcc

SEQ ID NO: 1171 - DNA, 20 bp, Artificial
  CRISPR gRNA sequence
tcttcccagcccaccatccc

SEQ ID NO: 1172 - DNA, 20 bp, Artificial
  CRISPR gRNA sequence
cccagcccaccatccccatc

SEQ ID NO: 1173 - DNA, 20 bp, Artificial
  CRISPR gRNA sequence
ccagcccaccatccccatcg

SEQ ID NO: 1174 - DNA, 20 bp, Artificial
  CRISPR gRNA sequence
ctggcctggttctccttgga

SEQ ID NO: 1175 - DNA, 20 bp, Artificial
  CRISPR gRNA sequence
gcctggttctccttggagct

SEQ ID NO: 1176 - DNA, 20 bp, Artificial
  CRISPR gRNA sequence
gttctccttggagctgtgat

SEQ ID NO: 1177 - DNA, 20 bp, Artificial
  CRISPR gRNA sequence
tccttggagctgtgatcact

SEQ ID NO: 1178 - DNA, 20 bp, Artificial
  CRISPR gRNA sequence
cttggagctgtgatcactgg

SEQ ID NO: 1179 - DNA, 20 bp, Artificial
  CRISPR gRNA sequence
ggagctgtgatcactggagc

SEQ ID NO: 1180 - DNA, 20 bp, Artificial
  CRISPR gRNA sequence
gagctgtgatcactggagct

SEQ ID NO: 1181 - DNA, 20 bp, Artificial
  CRISPR gRNA sequence
tgatcactggagctgtggtc

SEQ ID NO: 1182 - DNA, 20 bp, Artificial
  CRISPR gRNA sequence
gagctgtggtcgctgccgtg

SEQ ID NO: 1183 - DNA, 20 bp, Artificial
  CRISPR gRNA sequence
tggtcgctgccgtgatgtgg

SEQ ID NO: 1184 - DNA, 20 bp, Artificial
  CRISPR gRNA sequence
ccgtgatgtggaggaggaag

SEQ ID NO: 1185 - DNA, 20 bp, Artificial
  CRISPR gRNA sequence
aggtggagaaggggtgaagg

SEQ ID NO: 1186 - DNA, 20 bp, Artificial
  CRISPR gRNA sequence
agatttcttgtctcactgag

SEQ ID NO: 1187 - DNA, 20 bp, Artificial
  CRISPR gRNA sequence
cttgtctcactgagggttcc

SEQ ID NO: 1188 - DNA, 20 bp, Artificial
  CRISPR gRNA sequence
ttgtctcactgagggttcca

SEQ ID NO: 1189 - DNA, 20 bp, Artificial
  CRISPR gRNA sequence
gtctcactgagggttccaag

SEQ ID NO: 1190 - DNA, 20 bp, Artificial
  CRISPR gRNA sequence
tctcactgagggttccaagc

SEQ ID NO: 1191 - DNA, 20 bp, Artificial
  CRISPR gRNA sequence
actgagggttccaagcccca

SEQ ID NO: 1192 - DNA, 20 bp, Artificial
  CRISPR gRNA sequence
agggttccaagccccagcta

SEQ ID NO: 1193 - DNA, 20 bp, Artificial
  CRISPR gRNA sequence
caagccccagctagaaatgt

SEQ ID NO: 1194 - DNA, 20 bp, Artificial
  CRISPR gRNA sequence
gaaatgtgccctgtctcatt

SEQ ID NO: 1195 - DNA, 20 bp, Artificial
  CRISPR gRNA sequence
tctcattactgggaagcacc

SEQ ID NO: 1196 - DNA, 20 bp, Artificial
  CRISPR gRNA sequence
cccagtaatgagacagggca

SEQ ID NO: 1197 - DNA, 20 bp, Artificial
  CRISPR gRNA sequence
ccagtaatgagacagggcac

SEQ ID NO: 1198 - DNA, 20 bp, Artificial
  CRISPR gRNA sequence
ctagctggggcttggaaccc

SEQ ID NO: 1199 - DNA, 20 bp, Artificial
  CRISPR gRNA sequence
tagctggggcttggaaccct

SEQ ID NO: 1200 - DNA, 20 bp, Artificial
  CRISPR gRNA sequence
gctggggcttggaaccctca

SEQ ID NO: 1201 - DNA, 20 bp, Artificial
  CRISPR gRNA sequence
gggcttggaaccctcagtga

SEQ ID NO: 1202 - DNA, 20 bp, Artificial
  CRISPR gRNA sequence
ggaaccctcagtgagacaag

SEQ ID NO: 1203 - DNA, 20 bp, Artificial
  CRISPR gRNA sequence
gaaccctcagtgagacaaga

SEQ ID NO: 1204 - DNA, 20 bp, Artificial
  CRISPR gRNA sequence
agtgagacaagaaatctcag

SEQ ID NO: 1205 - DNA, 20 bp, Artificial
  CRISPR gRNA sequence
agaccccacccttcacccct

SEQ ID NO: 1206 - DNA, 20 bp, Artificial
  CRISPR gRNA sequence
caccccttctccacctgagc

SEQ ID NO: 1207 - DNA, 20 bp, Artificial
  CRISPR gRNA sequence
accccttctccacctgagct

SEQ ID NO: 1208 - DNA, 20 bp, Artificial
  CRISPR gRNA sequence
ctccacctgagctcttcctc

SEQ ID NO: 1209 - DNA, 20 bp, Artificial
  CRISPR gRNA sequence
tccacctgagctcttcctcc

SEQ ID NO: 1210 - DNA, 20 bp, Artificial
  CRISPR gRNA sequence
cacctgagctcttcctcctc

SEQ ID NO: 1211 - DNA, 20 bp, Artificial
  CRISPR gRNA sequence
agctcttcctcctccacatc

SEQ ID NO: 1212 - DNA, 20 bp, Artificial
  CRISPR gRNA sequence
ttcctcctccacatcacggc

SEQ ID NO: 1213 - DNA, 20 bp, Artificial
  CRISPR gRNA sequence
cctcctccacatcacggcag

SEQ ID NO: 1214 - DNA, 20 bp, Artificial
  CRISPR gRNA sequence
ctcctccacatcacggcagc

SEQ ID NO: 1215 - DNA, 20 bp, Artificial
  CRISPR gRNA sequence
ctccacatcacggcagcgac

SEQ ID NO: 1216 - DNA, 20 bp, Artificial
  CRISPR gRNA sequence
cacatcacggcagcgaccac

SEQ ID NO: 1217 - DNA, 20 bp, Artificial
  CRISPR gRNA sequence
cagtgatcacagctccaagg

SEQ ID NO: 1218 - DNA, 20 bp, Artificial
  CRISPR gRNA sequence
caaggagaaccaggccagca

SEQ ID NO: 1219 - DNA, 20 bp, Artificial
  CRISPR gRNA sequence
ggaagacagctctgggaaaa

SEQ ID NO: 1220 - DNA, 20 bp, Artificial
  CRISPR gRNA sequence
tgggaaaagaggggaaggtg

SEQ ID NO: 1221 - DNA, 20 bp, Artificial
  CRISPR gRNA sequence
ggaaaagaggggaaggtgag

SEQ ID NO: 1222 - DNA, 20 bp, Artificial
  CRISPR gRNA sequence
accctgctaaaggtctccag

SEQ ID NO: 1223 - DNA, 20 bp, Artificial
  CRISPR gRNA sequence
ctaaaggtctccagagaggc

SEQ ID NO: 1224 - DNA, 20 bp, Artificial
  CRISPR gRNA sequence
aaggtctccagagaggctcc

SEQ ID NO: 1225 - DNA, 20 bp, Artificial
  CRISPR gRNA sequence
cagagaggctcctgctttcc

SEQ ID NO: 1226 - DNA, 20 bp, Artificial
  CRISPR gRNA sequence
ctgctttccctaagagacat

SEQ ID NO: 1227 - DNA, 20 bp, Artificial
  CRISPR gRNA sequence
ctttccctaagagacatgac

SEQ ID NO: 1228 - DNA, 20 bp, Artificial
  CRISPR gRNA sequence
tccctaagagacatgacacc

SEQ ID NO: 1229 - DNA, 20 bp, Artificial
  CRISPR gRNA sequence
ccctaagagacatgacaccc

SEQ ID NO: 1230 - DNA, 20 bp, Artificial
  CRISPR gRNA sequence
cctaagagacatgacacccc

SEQ ID NO: 1231 - DNA, 20 bp, Artificial
  CRISPR gRNA sequence
agagacatgacacccccatc

SEQ ID NO: 1232 - DNA, 20 bp, Artificial
  CRISPR gRNA sequence
cctccttaccccatctcagg

SEQ ID NO: 1233 - DNA, 20 bp, Artificial
  CRISPR gRNA sequence
cttaccccatctcagggtga

SEQ ID NO: 1234 - DNA, 20 bp, Artificial
  CRISPR gRNA sequence
accccatctcagggtgaggg

SEQ ID NO: 1235 - DNA, 20 bp, Artificial
  CRISPR gRNA sequence
ccccatctcagggtgagggg

SEQ ID NO: 1236 - DNA, 20 bp, Artificial
  CRISPR gRNA sequence
agggtgaggggcttgggcag

SEQ ID NO: 1237 - DNA, 20 bp, Artificial
  CRISPR gRNA sequence
gggcagaccctcatgctgca

SEQ ID NO: 1238 - DNA, 20 bp, Artificial
  CRISPR gRNA sequence
ggcagaccctcatgctgcac

SEQ ID NO: 1239 - DNA, 20 bp, Artificial
  CRISPR gRNA sequence
atgctgcacatggcaggtgt

SEQ ID NO: 1240 - DNA, 20 bp, Artificial
  CRISPR gRNA sequence
cacatggcaggtgtatctct

SEQ ID NO: 1241 - DNA, 20 bp, Artificial
  CRISPR gRNA sequence
tgctcctctccagaaggcac

SEQ ID NO: 1242 - DNA, 20 bp, Artificial
  CRISPR gRNA sequence
ctcctctccagaaggcacca

SEQ ID NO: 1243 - DNA, 20 bp, Artificial
  CRISPR gRNA sequence
ctctccagaaggcaccacca

SEQ ID NO: 1244 - DNA, 20 bp, Artificial
  CRISPR gRNA sequence
tccagaaggcaccaccacag

SEQ ID NO: 1245 - DNA, 20 bp, Artificial
  CRISPR gRNA sequence
cagaaggcaccaccacagcc

SEQ ID NO: 1246 - DNA, 20 bp, Artificial
  CRISPR gRNA sequence
ctggaaggttccatcccctg

SEQ ID NO: 1247 - DNA, 20 bp, Artificial
  CRISPR gRNA sequence
tggaaggttccatcccctgc

SEQ ID NO: 1248 - DNA, 20 bp, Artificial
  CRISPR gRNA sequence
gaaggttccatcccctgcag

SEQ ID NO: 1249 - DNA, 20 bp, Artificial
  CRISPR gRNA sequence
catcccctgcaggcctggtc

SEQ ID NO: 1250 - DNA, 20 bp, Artificial
  CRISPR gRNA sequence
caggcctggtctccacgagc

SEQ ID NO: 1251 - DNA, 20 bp, Artificial
  CRISPR gRNA sequence
gtctccacgagctccgtgtc

SEQ ID NO: 1252 - DNA, 20 bp, Artificial
  CRISPR gRNA sequence
cacgagctccgtgtcctggg

SEQ ID NO: 1253 - DNA, 20 bp, Artificial
  CRISPR gRNA sequence
cgtgtcctgggtctggtcct

SEQ ID NO: 1254 - DNA, 20 bp, Artificial
  CRISPR gRNA sequence
ggtctggtcctccccatccc

SEQ ID NO: 1255 - DNA, 20 bp, Artificial
  CRISPR gRNA sequence
gtcctccccatcccgctgcc

SEQ ID NO: 1256 - DNA, 20 bp, Artificial
  CRISPR gRNA sequence
cccatcccgctgccaggtca

SEQ ID NO: 1257 - DNA, 20 bp, Artificial
  CRISPR gRNA sequence
ccaggtcagtgtgatctccg

SEQ ID NO: 1258 - DNA, 20 bp, Artificial
  CRISPR gRNA sequence
cgcagggtagaagcccaggg

SEQ ID NO: 1259 - DNA, 20 bp, Artificial
  CRISPR gRNA sequence
agggtggcctcatggtcaga

SEQ ID NO: 1260 - DNA, 20 bp, Artificial
  CRISPR gRNA sequence
atggtcagagatggggtggt

SEQ ID NO: 1261 - DNA, 20 bp, Artificial
  CRISPR gRNA sequence
gggggggtctgacgggaaga

SEQ ID NO: 1262 - DNA, 20 bp, Artificial
  CRISPR gRNA sequence
ggggggtctgacgggaagag

SEQ ID NO: 1263 - DNA, 20 bp, Artificial
  CRISPR gRNA sequence
acgggaagagtcagaaaatt

SEQ ID NO: 1264 - DNA, 20 bp, Artificial
  CRISPR gRNA sequence
aggcattttgcatctgtcat

SEQ ID NO: 1265 - DNA, 20 bp, Artificial
  CRISPR gRNA sequence
tgcatctgtcatgggacact

SEQ ID NO: 1266 - DNA, 20 bp, Artificial
  CRISPR gRNA sequence
gcatctgtcatgggacactc

SEQ ID NO: 1267 - DNA, 20 bp, Artificial
  CRISPR gRNA sequence
catctgtcatgggacactcc

SEQ ID NO: 1268 - DNA, 20 bp, Artificial
  CRISPR gRNA sequence
tcatgggacactccaccagc

SEQ ID NO: 1269 - DNA, 20 bp, Artificial
  CRISPR gRNA sequence
caccagcacgcatgtggcca

SEQ ID NO: 1270 - DNA, 20 bp, Artificial
  CRISPR gRNA sequence
gagaatggacaggacacccg

SEQ ID NO: 1271 - DNA, 20 bp, Artificial
  CRISPR gRNA sequence
agaatggacaggacacccgg

SEQ ID NO: 1272 - DNA, 20 bp, Artificial
  CRISPR gRNA sequence
gacacaggcacctgggataa

SEQ ID NO: 1273 - DNA, 20 bp, Artificial
  CRISPR gRNA sequence
ggataatcttctattccctg

SEQ ID NO: 1274 - DNA, 20 bp, Artificial
  CRISPR gRNA sequence
ctattccctgagaagggaac

SEQ ID NO: 1275 - DNA, 20 bp, Artificial
  CRISPR gRNA sequence
tattccctgagaagggaaca

SEQ ID NO: 1276 - DNA, 20 bp, Artificial
  CRISPR gRNA sequence
ttccctgagaagggaacagc

SEQ ID NO: 1277 - DNA, 20 bp, Artificial
  CRISPR gRNA sequence
cctgagaagggaacagcgac

SEQ ID NO: 1278 - DNA, 20 bp, Artificial
  CRISPR gRNA sequence
agaagggaacagcgacttct

SEQ ID NO: 1279 - DNA, 20 bp, Artificial
  CRISPR gRNA sequence
ctggtcctgacctgagtgga

SEQ ID NO: 1280 - DNA, 20 bp, Artificial
  CRISPR gRNA sequence
tggtcctgacctgagtggag

SEQ ID NO: 1281 - DNA, 20 bp, Artificial
  CRISPR gRNA sequence
gtcctgacctgagtggaggc

SEQ ID NO: 1282 - DNA, 20 bp, Artificial
  CRISPR gRNA sequence
acctgagtggaggctgaggg

SEQ ID NO: 1283 - DNA, 20 bp, Artificial
  CRISPR gRNA sequence
agtggaggctgagggactca

SEQ ID NO: 1284 - DNA, 20 bp, Artificial
  CRISPR gRNA sequence
agggactcagaagtgctgga

SEQ ID NO: 1285 - DNA, 20 bp, Artificial
  CRISPR gRNA sequence
agaagtgctggactcagacc

SEQ ID NO: 1286 - DNA, 20 bp, Artificial
  CRISPR gRNA sequence
gactcagacccccacacaca

SEQ ID NO: 1287 - DNA, 20 bp, Artificial
  CRISPR gRNA sequence
agacccccacacacattgag

SEQ ID NO: 1288 - DNA, 20 bp, Artificial
  CRISPR gRNA sequence
agtgtgaagcagagaacaag

SEQ ID NO: 1289 - DNA, 20 bp, Artificial
  CRISPR gRNA sequence
agaggaaaagtcacgggccc

SEQ ID NO: 1290 - DNA, 20 bp, Artificial
  CRISPR gRNA sequence
ctgccggtgtcaaagggaac

SEQ ID NO: 1291 - DNA, 20 bp, Artificial
  CRISPR gRNA sequence
ccggtgtcaaagggaaccac

SEQ ID NO: 1292 - DNA, 20 bp, Artificial
  CRISPR gRNA sequence
atcagtattcgagggatcgt

SEQ ID NO: 1293 - DNA, 20 bp, Artificial
  CRISPR gRNA sequence
gagggatcgtcttcccgtca

SEQ ID NO: 1294 - DNA, 20 bp, Artificial
  CRISPR gRNA sequence
cccgtcactccttcagagat

SEQ ID NO: 1295 - DNA, 20 bp, Artificial
  CRISPR gRNA sequence
ccgtcactccttcagagatt

SEQ ID NO: 1296 - DNA, 20 bp, Artificial
  CRISPR gRNA sequence
cttcagagattttatccctt

SEQ ID NO: 1297 - DNA, 20 bp, Artificial
  CRISPR gRNA sequence
cagagattttatcccttaat

SEQ ID NO: 1298 - DNA, 20 bp, Artificial
  CRISPR gRNA sequence
agagattttatcccttaatt

SEQ ID NO: 1299 - DNA, 20 bp, Artificial
  CRISPR gRNA sequence
tatcccttaattgtgtcaga

SEQ ID NO: 1300 - DNA, 20 bp, Artificial
  CRISPR gRNA sequence
atcccttaattgtgtcagag

SEQ ID NO: 1301 - DNA, 20 bp, Artificial
  CRISPR gRNA sequence
tcccttaattgtgtcagaga

SEQ ID NO: 1302 - DNA, 20 bp, Artificial
  CRISPR gRNA sequence
aattgtgtcagagagcaggg

SEQ ID NO: 1303 - DNA, 20 bp, Artificial
  CRISPR gRNA sequence
attgtgtcagagagcagggc

SEQ ID NO: 1304 - DNA, 20 bp, Artificial
  CRISPR gRNA sequence
tgtcagagagcagggcggaa

SEQ ID NO: 1305 - DNA, 20 bp, Artificial
  CRISPR gRNA sequence
agagtcactctctggtacag

SEQ ID NO: 1306 - DNA, 20 bp, Artificial
  CRISPR gRNA sequence
tctggtacaggatctggaac

SEQ ID NO: 1307 - DNA, 20 bp, Artificial
  CRISPR gRNA sequence
tggtacaggatctggaaccc

SEQ ID NO: 1308 - DNA, 20 bp, Artificial
  CRISPR gRNA sequence
gtacaggatctggaacccag

SEQ ID NO: 1309 - DNA, 20 bp, Artificial
  CRISPR gRNA sequence
gaacccaggaggattcctct

SEQ ID NO: 1310 - DNA, 20 bp, Artificial
  CRISPR gRNA sequence
ctctccctcaggaccagagg

SEQ ID NO: 1311 - DNA, 20 bp, Artificial
  CRISPR gRNA sequence
tccctcaggaccagagggag

SEQ ID NO: 1312 - DNA, 20 bp, Artificial
  CRISPR gRNA sequence
cctcaggaccagagggaggg

SEQ ID NO: 1313 - DNA, 20 bp, Artificial
  CRISPR gRNA sequence
aggaccagagggagggtgat

SEQ ID NO: 1314 - DNA, 20 bp, Artificial
  CRISPR gRNA sequence
tagtgttggtcccaattgtc

SEQ ID NO: 1315 - DNA, 20 bp, Artificial
  CRISPR gRNA sequence
gtgttggtcccaattgtctc

SEQ ID NO: 1316 - DNA, 20 bp, Artificial
  CRISPR gRNA sequence
gtcccaattgtctcccctcc

SEQ ID NO: 1317 - DNA, 20 bp, Artificial
  CRISPR gRNA sequence
tctcccctccttgtgggagg

SEQ ID NO: 1318 - DNA, 20 bp, Artificial
  CRISPR gRNA sequence
ccctccttgtgggaggccag

SEQ ID NO: 1319 - DNA, 20 bp, Artificial
  CRISPR gRNA sequence
cttgtgggaggccagcccgg

SEQ ID NO: 1320 - DNA, 20 bp, Artificial
  CRISPR gRNA sequence
gtgggaggccagcccgggag

SEQ ID NO: 1321 - DNA, 20 bp, Artificial
  CRISPR gRNA sequence
tgggaggccagcccgggaga

SEQ ID NO: 1322 - DNA, 20 bp, Artificial
  CRISPR gRNA sequence
caggcgatcagggaggcgcc

SEQ ID NO: 1323 - DNA, 20 bp, Artificial
  CRISPR gRNA sequence
gtacccgtgcgctgcagcgt

SEQ ID NO: 1324 - DNA, 20 bp, Artificial
  CRISPR gRNA sequence
cagcgtctccttcccgttct

SEQ ID NO: 1325 - DNA, 20 bp, Artificial
  CRISPR gRNA sequence
cttcccgttctccaggtatc

SEQ ID NO: 1326 - DNA, 20 bp, Artificial
  CRISPR gRNA sequence
cccgttctccaggtatctgc

SEQ ID NO: 1327 - DNA, 20 bp, Artificial
  CRISPR gRNA sequence
ccgttctccaggtatctgcg

SEQ ID NO: 1328 - DNA, 20 bp, Artificial
  CRISPR gRNA sequence
tccaggtatctgcggagcca

SEQ ID NO: 1329 - DNA, 20 bp, Artificial
  CRISPR gRNA sequence
caggtatctgcggagccact

SEQ ID NO: 1330 - DNA, 20 bp, Artificial
  CRISPR gRNA sequence
cggagccactccacgcacgt

SEQ ID NO: 1331 - DNA, 20 bp, Artificial
  CRISPR gRNA sequence
cacgcacgtgccatccaggt

SEQ ID NO: 1332 - DNA, 20 bp, Artificial
  CRISPR gRNA sequence
tcaactgctccgcctcatgg

SEQ ID NO: 1333 - DNA, 20 bp, Artificial
  CRISPR gRNA sequence
aactgctccgcctcatgggc

SEQ ID NO: 1334 - DNA, 20 bp, Artificial
  CRISPR gRNA sequence
ctccgcctcatgggccgcct

SEQ ID NO: 1335 - DNA, 20 bp, Artificial
  CRISPR gRNA sequence
cgcctcatgggccgcctccc

SEQ ID NO: 1336 - DNA, 20 bp, Artificial
  CRISPR gRNA sequence
atgggccgcctcccacttgc

SEQ ID NO: 1337 - DNA, 20 bp, Artificial
  CRISPR gRNA sequence
ccacttgcgcttggtgatct

SEQ ID NO: 1338 - DNA, 20 bp, Artificial
  CRISPR gRNA sequence
gcgcttggtgatctgagccg

SEQ ID NO: 1339 - DNA, 20 bp, Artificial
  CRISPR gRNA sequence
cgcttggtgatctgagccgc

SEQ ID NO: 1340 - DNA, 20 bp, Artificial
  CRISPR gRNA sequence
ggtgatctgagccgccatgt

SEQ ID NO: 1341 - DNA, 20 bp, Artificial
  CRISPR gRNA sequence
gtgatctgagccgccatgtc

SEQ ID NO: 1342 - DNA, 20 bp, Artificial
  CRISPR gRNA sequence
agccgccatgtccgccgcgg

SEQ ID NO: 1343 - DNA, 20 bp, Artificial
  CRISPR gRNA sequence
gttcagggcgatgtaatcct

SEQ ID NO: 1344 - DNA, 20 bp, Artificial
  CRISPR gRNA sequence
agggcgatgtaatccttgcc

SEQ ID NO: 1345 - DNA, 20 bp, Artificial
  CRISPR gRNA sequence
gccgtcgtaggcgtcctgcc

SEQ ID NO: 1346 - DNA, 20 bp, Artificial
  CRISPR gRNA sequence
ccgtcgtaggcgtcctgccg

SEQ ID NO: 1347 - DNA, 20 bp, Artificial
  CRISPR gRNA sequence
ccggtacccgcggaggaagc

SEQ ID NO: 1348 - DNA, 20 bp, Artificial
  CRISPR gRNA sequence
tctggatggtgtgagaacct

SEQ ID NO: 1349 - DNA, 20 bp, Artificial
  CRISPR gRNA sequence
gatggtgtgagaacctggcc

SEQ ID NO: 1350 - DNA, 20 bp, Artificial
  CRISPR gRNA sequence
gccccgaccccgcggtcagc

SEQ ID NO: 1351 - DNA, 20 bp, Artificial
  CRISPR gRNA sequence
ttggcctaaactgaaaatga

SEQ ID NO: 1352 - DNA, 20 bp, Artificial
  CRISPR gRNA sequence
tggcctaaactgaaaatgaa

SEQ ID NO: 1353 - DNA, 20 bp, Artificial
  CRISPR gRNA sequence
ggcctaaactgaaaatgaaa

SEQ ID NO: 1354 - DNA, 20 bp, Artificial
  CRISPR gRNA sequence
gcctaaactgaaaatgaaac

SEQ ID NO: 1355 - DNA, 20 bp, Artificial
  CRISPR gRNA sequence
aactgaaaatgaaaccgggt

SEQ ID NO: 1356 - DNA, 20 bp, Artificial
  CRISPR gRNA sequence
aaaatgaaaccgggtaaagg

SEQ ID NO: 1357 - DNA, 20 bp, Artificial
  CRISPR gRNA sequence
ggcctctcccggggcaaggg

SEQ ID NO: 1358 - DNA, 20 bp, Artificial
  CRISPR gRNA sequence
tcccggggcaagggtctcgg

SEQ ID NO: 1359 - DNA, 20 bp, Artificial
  CRISPR gRNA sequence
ccggggcaagggtctcgggg

SEQ ID NO: 1360 - DNA, 20 bp, Artificial
  CRISPR gRNA sequence
ggggtcccgcggcttcgggg

SEQ ID NO: 1361 - DNA, 20 bp, Artificial
  CRISPR gRNA sequence
cggggtggatctcggacccg

SEQ ID NO: 1362 - DNA, 20 bp, Artificial
  CRISPR gRNA sequence
ggggtggatctcggacccgg

SEQ ID NO: 1363 - DNA, 20 bp, Artificial
  CRISPR gRNA sequence
ggacccggagactgtgggcg

SEQ ID NO: 1364 - DNA, 20 bp, Artificial
  CRISPR gRNA sequence
tgggcgacctggcccgtccg

SEQ ID NO: 1365 - DNA, 20 bp, Artificial
  CRISPR gRNA sequence
gcccgtccgtgggggatgag

SEQ ID NO: 1366 - DNA, 20 bp, Artificial
  CRISPR gRNA sequence
acctgcgcccccggccgggg

SEQ ID NO: 1367 - DNA, 20 bp, Artificial
  CRISPR gRNA sequence
cgcccccggccggggtcact

SEQ ID NO: 1368 - DNA, 20 bp, Artificial
  CRISPR gRNA sequence
accggcctcgctctggttgt

SEQ ID NO: 1369 - DNA, 20 bp, Artificial
  CRISPR gRNA sequence
gctctggttgtagtagccgc

SEQ ID NO: 1370 - DNA, 20 bp, Artificial
  CRISPR gRNA sequence
tggttgtagtagccgcgcag

SEQ ID NO: 1371 - DNA, 20 bp, Artificial
  CRISPR gRNA sequence
gttgtagtagccgcgcaggg

SEQ ID NO: 1372 - DNA, 20 bp, Artificial
  CRISPR gRNA sequence
tagtagccgcgcagggtccc

SEQ ID NO: 1373 - DNA, 20 bp, Artificial
  CRISPR gRNA sequence
ggtcagtctgtgactgggcc

SEQ ID NO: 1374 - DNA, 20 bp, Artificial
  CRISPR gRNA sequence
tgactgggccttcacattcc

SEQ ID NO: 1375 - DNA, 20 bp, Artificial
  CRISPR gRNA sequence
ggccttcacattccgtgtct

SEQ ID NO: 1376 - DNA, 20 bp, Artificial
  CRISPR gRNA sequence
cacattccgtgtctcctggt

SEQ ID NO: 1377 - DNA, 20 bp, Artificial
  CRISPR gRNA sequence
acattccgtgtctcctggtc

SEQ ID NO: 1378 - DNA, 20 bp, Artificial
  CRISPR gRNA sequence
cgtgtctcctggtcccaata

SEQ ID NO: 1379 - DNA, 20 bp, Artificial
  CRISPR gRNA sequence
ctggtcccaatactccggcc

SEQ ID NO: 1380 - DNA, 20 bp, Artificial
  CRISPR gRNA sequence
gtcccaatactccggcccct

SEQ ID NO: 1381 - DNA, 20 bp, Artificial
  CRISPR gRNA sequence
cggcccctcctgctctatcc

SEQ ID NO: 1382 - DNA, 20 bp, Artificial
  CRISPR gRNA sequence
ctgctctatccacggcgccc

SEQ ID NO: 1383 - DNA, 20 bp, Artificial
  CRISPR gRNA sequence
ctctatccacggcgcccgcg

SEQ ID NO: 1384 - DNA, 20 bp, Artificial
  CRISPR gRNA sequence
tatccacggcgcccgcggct

SEQ ID NO: 1385 - DNA, 20 bp, Artificial
  CRISPR gRNA sequence
tccacggcgcccgcggctcc

SEQ ID NO: 1386 - DNA, 20 bp, Artificial
  CRISPR gRNA sequence
catcctctggctcgcggcgt

SEQ ID NO: 1387 - DNA, 20 bp, Artificial
  CRISPR gRNA sequence
tggctcgcggcgtcgctgtc

SEQ ID NO: 1388 - DNA, 20 bp, Artificial
  CRISPR gRNA sequence
gctcgcggcgtcgctgtcga

SEQ ID NO: 1389 - DNA, 20 bp, Artificial
  CRISPR gRNA sequence
gcggcgtcgctgtcgaaccg

SEQ ID NO: 1390 - DNA, 20 bp, Artificial
  CRISPR gRNA sequence
tcgaaccgcacgaactgcgt

SEQ ID NO: 1391 - DNA, 20 bp, Artificial
  CRISPR gRNA sequence
cgtgtcgtccacgtagccca

SEQ ID NO: 1392 - DNA, 20 bp, Artificial
  CRISPR gRNA sequence
cccgcggccgggccgggaca

SEQ ID NO: 1393 - DNA, 20 bp, Artificial
  CRISPR gRNA sequence
atggagtgggagcctggggg

SEQ ID NO: 1394 - DNA, 20 bp, Artificial
  CRISPR gRNA sequence
ggggcgagcagtggctgaga

SEQ ID NO: 1395 - DNA, 20 bp, Artificial
  CRISPR gRNA sequence
agacctgcccgaccctcgtc

SEQ ID NO: 1396 - DNA, 20 bp, Artificial
  CRISPR gRNA sequence
cccgaccctcgtcccggcgc

SEQ ID NO: 1397 - DNA, 20 bp, Artificial
  CRISPR gRNA sequence
gtcccggcgcggctcccccg

SEQ ID NO: 1398 - DNA, 20 bp, Artificial
  CRISPR gRNA sequence
ccccggtcctgcgcccccgc

SEQ ID NO: 1399 - DNA, 20 bp, Artificial
  CRISPR gRNA sequence
cgcccccgccaggagggccc

SEQ ID NO: 1400 - DNA, 20 bp, Artificial
  CRISPR gRNA sequence
gcttctccccgcagaggcgg

SEQ ID NO: 1401 - DNA, 20 bp, Artificial
  CRISPR gRNA sequence
cttctccccgcagaggcggt

SEQ ID NO: 1402 - DNA, 20 bp, Artificial
  CRISPR gRNA sequence
ctccccgcagaggcggtttc

SEQ ID NO: 1403 - DNA, 20 bp, Artificial
  CRISPR gRNA sequence
tccccgcagaggcggtttcc

SEQ ID NO: 1404 - DNA, 20 bp, Artificial
  CRISPR gRNA sequence
cccgcagaggcggtttccct

SEQ ID NO: 1405 - DNA, 20 bp, Artificial
  CRISPR gRNA sequence
ccctcccgaccccgcactca

SEQ ID NO: 1406 - DNA, 20 bp, Artificial
  CRISPR gRNA sequence
cctcccgaccccgcactcac

SEQ ID NO: 1407 - DNA, 20 bp, Artificial
  CRISPR gRNA sequence
ccgaccccgcactcacccgc

SEQ ID NO: 1408 - DNA, 20 bp, Artificial
  CRISPR gRNA sequence
acccgcccaggtctgggtca

SEQ ID NO: 1409 - DNA, 20 bp, Artificial
  CRISPR gRNA sequence
ggtcagggccagggcccccg

SEQ ID NO: 1410 - DNA, 20 bp, Artificial
  CRISPR gRNA sequence
ggggcgccatgacggccatc

SEQ ID NO: 1411 - DNA, 20 bp, Artificial
  CRISPR gRNA sequence
ggcgtctggggagaatctga

SEQ ID NO: 1412 - DNA, 20 bp, Artificial
  CRISPR gRNA sequence
gggagaatctgagtcccggt

SEQ ID NO: 1413 - DNA, 20 bp, Artificial
  CRISPR gRNA sequence
agtcccggtgggtgcgtgcg

SEQ ID NO: 1414 - DNA, 20 bp, Artificial
  CRISPR gRNA sequence
tagaacagcgaccgcgacga

SEQ ID NO: 1415 - DNA, 20 bp, Artificial
  CRISPR gRNA sequence
agaacagcgaccgcgacgac

SEQ ID NO: 1416 - DNA, 20 bp, Artificial
  CRISPR gRNA sequence
gaacagcgaccgcgacgaca

SEQ ID NO: 1417 - DNA, 20 bp, Artificial
  CRISPR gRNA sequence
attggcttctctggaaaccc

SEQ ID NO: 1418 - DNA, 20 bp, Artificial
  CRISPR gRNA sequence
gcttctctggaaacccgaca

SEQ ID NO: 1419 - DNA, 20 bp, Artificial
  CRISPR gRNA sequence
atcaaagaatccccattacc

SEQ ID NO: 1420 - DNA, 20 bp, Artificial
  CRISPR gRNA sequence
tcaaagaatccccattaccc

SEQ ID NO: 1421 - DNA, 20 bp, Artificial
  CRISPR gRNA sequence
ccctctgccccacccacccc

SEQ ID NO: 1422 - DNA, 20 bp, Artificial
  CRISPR gRNA sequence
acccgccaccccacccactc

SEQ ID NO: 1423 - DNA, 20 bp, Artificial
  CRISPR gRNA sequence
ccccacccactctagacccc

SEQ ID NO: 1424 - DNA, 20 bp, Artificial
  CRISPR gRNA sequence
cccaagaatctcaccttttc

SEQ ID NO: 1425 - DNA, 20 bp, Artificial
  CRISPR gRNA sequence
atctcaccttttcaagctgt

SEQ ID NO: 1426 - DNA, 20 bp, Artificial
  CRISPR gRNA sequence
ctcaccttttcaagctgtga

SEQ ID NO: 1427 - DNA, 20 bp, Artificial
  CRISPR gRNA sequence
tcaagctgtgagagacacat

SEQ ID NO: 1428 - DNA, 20 bp, Artificial
  CRISPR gRNA sequence
aagctgtgagagacacatca

SEQ ID NO: 1429 - DNA, 20 bp, Artificial
  CRISPR gRNA sequence
tgagagacacatcagagccc

SEQ ID NO: 1430 - DNA, 20 bp, Artificial
  CRISPR gRNA sequence
gagagacacatcagagccct

SEQ ID NO: 1431 - DNA, 20 bp, Artificial
  CRISPR gRNA sequence
ccctgggcactgtcgctgcc

SEQ ID NO: 1432 - DNA, 20 bp, Artificial
  CRISPR gRNA sequence
ctgggcactgtcgctgcctg

SEQ ID NO: 1433 - DNA, 20 bp, Artificial
  CRISPR gRNA sequence
ggcactgtcgctgcctggag

SEQ ID NO: 1434 - DNA, 20 bp, Artificial
  CRISPR gRNA sequence
tgcctggagtagaacaaaaa

SEQ ID NO: 1435 - DNA, 20 bp, Artificial
  CRISPR gRNA sequence
gcctggagtagaacaaaaac

SEQ ID NO: 1436 - DNA, 20 bp, Artificial
  CRISPR gRNA sequence
agtagaacaaaaacaggacc

SEQ ID NO: 1437 - DNA, 20 bp, Artificial
  CRISPR gRNA sequence
gaacaaaaacaggacctggt

SEQ ID NO: 1438 - DNA, 20 bp, Artificial
  CRISPR gRNA sequence
acaaaaacaggacctggtca

SEQ ID NO: 1439 - DNA, 20 bp, Artificial
  CRISPR gRNA sequence
caggacctggtcagagcccg

SEQ ID NO: 1440 - DNA, 20 bp, Artificial
  CRISPR gRNA sequence
aggacctggtcagagcccgc

SEQ ID NO: 1441 - DNA, 20 bp, Artificial
  CRISPR gRNA sequence
gacctggtcagagcccgcag

SEQ ID NO: 1442 - DNA, 20 bp, Artificial
  CRISPR gRNA sequence
gtcagagcccgcaggagacg

SEQ ID NO: 1443 - DNA, 20 bp, Artificial
  CRISPR gRNA sequence
tcagagcccgcaggagacgt

SEQ ID NO: 1444 - DNA, 20 bp, Artificial
  CRISPR gRNA sequence
agcccgcaggagacgtggga

SEQ ID NO: 1445 - DNA, 20 bp, Artificial
  CRISPR gRNA sequence
gcccgcaggagacgtgggac

SEQ ID NO: 1446 - DNA, 20 bp, Artificial
  CRISPR gRNA sequence
ccgcaggagacgtgggacag

SEQ ID NO: 1447 - DNA, 20 bp, Artificial
  CRISPR gRNA sequence
cgcaggagacgtgggacagg

SEQ ID NO: 1448 - DNA, 20 bp, Artificial
  CRISPR gRNA sequence
acgtgggacaggaggaatta

SEQ ID NO: 1449 - DNA, 20 bp, Artificial
  CRISPR gRNA sequence
cgtgggacaggaggaattat

SEQ ID NO: 1450 - DNA, 20 bp, Artificial
  CRISPR gRNA sequence
gtgggacaggaggaattatg

SEQ ID NO: 1451 - DNA, 20 bp, Artificial
  CRISPR gRNA sequence
ggacaggaggaattatgggg

SEQ ID NO: 1452 - DNA, 20 bp, Artificial
  CRISPR gRNA sequence
gacaggaggaattatggggt

SEQ ID NO: 1453 - DNA, 20 bp, Artificial
  CRISPR gRNA sequence
ggaggaattatggggtgggt

SEQ ID NO: 1454 - DNA, 20 bp, Artificial
  CRISPR gRNA sequence
ccacccccaccacttacacg

SEQ ID NO: 1455 - DNA, 20 bp, Artificial
  CRISPR gRNA sequence
ccaccacttacacgcagcct

SEQ ID NO: 1456 - DNA, 20 bp, Artificial
  CRISPR gRNA sequence
accacttacacgcagcctga

SEQ ID NO: 1457 - DNA, 20 bp, Artificial
  CRISPR gRNA sequence
acttacacgcagcctgagag

SEQ ID NO: 1458 - DNA, 20 bp, Artificial
  CRISPR gRNA sequence
gctccctccttttccacctg

SEQ ID NO: 1459 - DNA, 20 bp, Artificial
  CRISPR gRNA sequence
ctccctccttttccacctgt

SEQ ID NO: 1460 - DNA, 20 bp, Artificial
  CRISPR gRNA sequence
cctccttttccacctgtggg

SEQ ID NO: 1461 - DNA, 20 bp, Artificial
  CRISPR gRNA sequence
gtgggaagaaaatgtcctgt

SEQ ID NO: 1462 - DNA, 20 bp, Artificial
  CRISPR gRNA sequence
tgggaagaaaatgtcctgtg

SEQ ID NO: 1463 - DNA, 20 bp, Artificial
  CRISPR gRNA sequence
gggaagaaaatgtcctgtga

SEQ ID NO: 1464 - DNA, 20 bp, Artificial
  CRISPR gRNA sequence
aaaatgtcctgtgagggcac

SEQ ID NO: 1465 - DNA, 20 bp, Artificial
  CRISPR gRNA sequence
aaatgtcctgtgagggcact

SEQ ID NO: 1466 - DNA, 20 bp, Artificial
  CRISPR gRNA sequence
atgtcctgtgagggcactgg

SEQ ID NO: 1467 - DNA, 20 bp, Artificial
  CRISPR gRNA sequence
tgtcctgtgagggcactggg

SEQ ID NO: 1468 - DNA, 20 bp, Artificial
  CRISPR gRNA sequence
cctgtgagggcactgggagg

SEQ ID NO: 1469 - DNA, 20 bp, Artificial
  CRISPR gRNA sequence
gtgagggcactgggaggaag

SEQ ID NO: 1470 - DNA, 20 bp, Artificial
  CRISPR gRNA sequence
tgagggcactgggaggaagc

SEQ ID NO: 1471 - DNA, 20 bp, Artificial
  CRISPR gRNA sequence
gagggcactgggaggaagca

SEQ ID NO: 1472 - DNA, 20 bp, Artificial
  CRISPR gRNA sequence
ctgggaggaagcagggccat

SEQ ID NO: 1473 - DNA, 20 bp, Artificial
  CRISPR gRNA sequence
gaagcagggccatgagatct

SEQ ID NO: 1474 - DNA, 20 bp, Artificial
  CRISPR gRNA sequence
agcagggccatgagatctta

SEQ ID NO: 1475 - DNA, 20 bp, Artificial
  CRISPR gRNA sequence
gcagggccatgagatcttag

SEQ ID NO: 1476 - DNA, 20 bp, Artificial
  CRISPR gRNA sequence
gagatcttagaggaacctcc

SEQ ID NO: 1477 - DNA, 20 bp, Artificial
  CRISPR gRNA sequence
ttagaggaacctcctagtct

SEQ ID NO: 1478 - DNA, 20 bp, Artificial
  CRISPR gRNA sequence
cctcctagtcttggacccaa

SEQ ID NO: 1479 - DNA, 20 bp, Artificial
  CRISPR gRNA sequence
ctcctagtcttggacccaaa

SEQ ID NO: 1480 - DNA, 20 bp, Artificial
  CRISPR gRNA sequence
ttggacccaaaaggaatttc

SEQ ID NO: 1481 - DNA, 20 bp, Artificial
  CRISPR gRNA sequence
gacccaaaaggaatttccag

SEQ ID NO: 1482 - DNA, 20 bp, Artificial
  CRISPR gRNA sequence
aatttccagaagtatgacta

SEQ ID NO: 1483 - DNA, 20 bp, Artificial
  CRISPR gRNA sequence
cagaagtatgactacagacc

SEQ ID NO: 1484 - DNA, 20 bp, Artificial
  CRISPR gRNA sequence
agaagtatgactacagaccc

SEQ ID NO: 1485 - DNA, 20 bp, Artificial
  CRISPR gRNA sequence
gaagtatgactacagaccca

SEQ ID NO: 1486 - DNA, 20 bp, Artificial
  CRISPR gRNA sequence
gtatgactacagacccaggg

SEQ ID NO: 1487 - DNA, 20 bp, Artificial
  CRISPR gRNA sequence
tatgactacagacccagggc

SEQ ID NO: 1488 - DNA, 20 bp, Artificial
  CRISPR gRNA sequence
ctacagacccagggcaggat

SEQ ID NO: 1489 - DNA, 20 bp, Artificial
  CRISPR gRNA sequence
tacagacccagggcaggatc

SEQ ID NO: 1490 - DNA, 20 bp, Artificial
  CRISPR gRNA sequence
agggcaggatcaggaaacac

SEQ ID NO: 1491 - DNA, 20 bp, Artificial
  CRISPR gRNA sequence
gggcaggatcaggaaacacg

SEQ ID NO: 1492 - DNA, 20 bp, Artificial
  CRISPR gRNA sequence
aggatcaggaaacacgagga

SEQ ID NO: 1493 - DNA, 20 bp, Artificial
  CRISPR gRNA sequence
tcaggaaacacgaggaaagc

SEQ ID NO: 1494 - DNA, 20 bp, Artificial
  CRISPR gRNA sequence
aaacacgaggaaagcaagtg

SEQ ID NO: 1495 - DNA, 20 bp, Artificial
  CRISPR gRNA sequence
aacacgaggaaagcaagtgt

SEQ ID NO: 1496 - DNA, 20 bp, Artificial
  CRISPR gRNA sequence
aggaaagcaagtgtgggtcc

SEQ ID NO: 1497 - DNA, 20 bp, Artificial
  CRISPR gRNA sequence
cctggaccaactgccctcct

SEQ ID NO: 1498 - DNA, 20 bp, Artificial
  CRISPR gRNA sequence
ctggaccaactgccctccta

SEQ ID NO: 1499 - DNA, 20 bp, Artificial
  CRISPR gRNA sequence
gccctcctaaggtctgtcct

SEQ ID NO: 1500 - DNA, 20 bp, Artificial
  CRISPR gRNA sequence
ctcctaaggtctgtccttag

SEQ ID NO: 1501 - DNA, 20 bp, Artificial
  CRISPR gRNA sequence
tcctaaggtctgtccttagc

SEQ ID NO: 1502 - DNA, 20 bp, Artificial
  CRISPR gRNA sequence
cctaaggtctgtccttagca

SEQ ID NO: 1503 - DNA, 20 bp, Artificial
  CRISPR gRNA sequence
ttcccctgactcatgaatgc

SEQ ID NO: 1504 - DNA, 20 bp, Artificial
  CRISPR gRNA sequence
tgactcatgaatgctggaat

SEQ ID NO: 1505 - DNA, 20 bp, Artificial
  CRISPR gRNA sequence
gactcatgaatgctggaatc

SEQ ID NO: 1506 - DNA, 20 bp, Artificial
  CRISPR gRNA sequence
accccaacaccacaaccatc

SEQ ID NO: 1507 - DNA, 20 bp, Artificial
  CRISPR gRNA sequence
ccccaacaccacaaccatca

SEQ ID NO: 1508 - DNA, 20 bp, Artificial
  CRISPR gRNA sequence
ttgtcacatgtgctgcacaa

SEQ ID NO: 1509 - DNA, 20 bp, Artificial
  CRISPR gRNA sequence
gtcacatgtgctgcacaaaa

SEQ ID NO: 1510 - DNA, 20 bp, Artificial
  CRISPR gRNA sequence
catgtgctgcacaaaagagt

SEQ ID NO: 1511 - DNA, 20 bp, Artificial
  CRISPR gRNA sequence
ctgcacaaaagagtaagtgc

SEQ ID NO: 1512 - DNA, 20 bp, Artificial
  CRISPR gRNA sequence
aaagagtaagtgctggcaca

SEQ ID NO: 1513 - DNA, 20 bp, Artificial
  CRISPR gRNA sequence
aagagtaagtgctggcacac

SEQ ID NO: 1514 - DNA, 20 bp, Artificial
  CRISPR gRNA sequence
agagtaagtgctggcacaca

SEQ ID NO: 1515 - DNA, 20 bp, Artificial
  CRISPR gRNA sequence
agtgctggcacacagggtcc

SEQ ID NO: 1516 - DNA, 20 bp, Artificial
  CRISPR gRNA sequence
gtgctggcacacagggtccc

SEQ ID NO: 1517 - DNA, 20 bp, Artificial
  CRISPR gRNA sequence
cacagggtcccaggctgcgt

SEQ ID NO: 1518 - DNA, 20 bp, Artificial
  CRISPR gRNA sequence
cctgtgtgcatgctgcttcc

SEQ ID NO: 1519 - DNA, 20 bp, Artificial
  CRISPR gRNA sequence
gcatgctgcttcccagtaat

SEQ ID NO: 1520 - DNA, 20 bp, Artificial
  CRISPR gRNA sequence
catgctgcttcccagtaatg

SEQ ID NO: 1521 - DNA, 20 bp, Artificial
  CRISPR gRNA sequence
gctgcttcccagtaatgagg

SEQ ID NO: 1522 - DNA, 20 bp, Artificial
  CRISPR gRNA sequence
ctgcttcccagtaatgaggc

SEQ ID NO: 1523 - DNA, 20 bp, Artificial
  CRISPR gRNA sequence
tgcttcccagtaatgaggca

SEQ ID NO: 1524 - DNA, 20 bp, Artificial
  CRISPR gRNA sequence
aggcagggaacacttctacc

SEQ ID NO: 1525 - DNA, 20 bp, Artificial
  CRISPR gRNA sequence
ggcagggaacacttctacct

SEQ ID NO: 1526 - DNA, 20 bp, Artificial
  CRISPR gRNA sequence
gcagggaacacttctacctg

SEQ ID NO: 1527 - DNA, 20 bp, Artificial
  CRISPR gRNA sequence
tacctggggcttgaaacccc

SEQ ID NO: 1528 - DNA, 20 bp, Artificial
  CRISPR gRNA sequence
ctggggcttgaaacccccag

SEQ ID NO: 1529 - DNA, 20 bp, Artificial
  CRISPR gRNA sequence
tggggcttgaaacccccagt

SEQ ID NO: 1530 - DNA, 20 bp, Artificial
  CRISPR gRNA sequence
cttgaaacccccagtgggac

SEQ ID NO: 1531 - DNA, 20 bp, Artificial
  CRISPR gRNA sequence
cccagtgggacaagaaaacc

SEQ ID NO: 1532 - DNA, 20 bp, Artificial
  CRISPR gRNA sequence
actcttcctcctacacatca

SEQ ID NO: 1533 - DNA, 20 bp, Artificial
  CRISPR gRNA sequence
cttcctcctacacatcacag

SEQ ID NO: 1534 - DNA, 20 bp, Artificial
  CRISPR gRNA sequence
acacatcacagcagcgacca

SEQ ID NO: 1535 - DNA, 20 bp, Artificial
  CRISPR gRNA sequence
gctccgatgaccacaactgc

SEQ ID NO: 1536 - DNA, 20 bp, Artificial
  CRISPR gRNA sequence
ctccgatgaccacaactgct

SEQ ID NO: 1537 - DNA, 20 bp, Artificial
  CRISPR gRNA sequence
gatgaccacaactgctagga

SEQ ID NO: 1538 - DNA, 20 bp, Artificial
  CRISPR gRNA sequence
accacaactgctaggacagc

SEQ ID NO: 1539 - DNA, 20 bp, Artificial
  CRISPR gRNA sequence
ccacaactgctaggacagcc

SEQ ID NO: 1540 - DNA, 20 bp, Artificial
  CRISPR gRNA sequence
aactgctaggacagccaggc

SEQ ID NO: 1541 - DNA, 20 bp, Artificial
  CRISPR gRNA sequence
gccagcaacaatgcccacga

SEQ ID NO: 1542 - DNA, 20 bp, Artificial
  CRISPR gRNA sequence
ccagcaacaatgcccacgat

SEQ ID NO: 1543 - DNA, 20 bp, Artificial
  CRISPR gRNA sequence
cagcaacaatgcccacgatg

SEQ ID NO: 1544 - DNA, 20 bp, Artificial
  CRISPR gRNA sequence
aacaatgcccacgatgggga

SEQ ID NO: 1545 - DNA, 20 bp, Artificial
  CRISPR gRNA sequence
aatgcccacgatggggacgg

SEQ ID NO: 1546 - DNA, 20 bp, Artificial
  CRISPR gRNA sequence
ccacgatggggacggtggac

SEQ ID NO: 1547 - DNA, 20 bp, Artificial
  CRISPR gRNA sequence
cacgatggggacggtggact

SEQ ID NO: 1548 - DNA, 20 bp, Artificial
  CRISPR gRNA sequence
gatggggacggtggactggg

SEQ ID NO: 1549 - DNA, 20 bp, Artificial
  CRISPR gRNA sequence
gggacggtggactgggaaga

SEQ ID NO: 1550 - DNA, 20 bp, Artificial
  CRISPR gRNA sequence
gtggactgggaagacggctc

SEQ ID NO: 1551 - DNA, 20 bp, Artificial
  CRISPR gRNA sequence
tggactgggaagacggctct

SEQ ID NO: 1552 - DNA, 20 bp, Artificial
  CRISPR gRNA sequence
ctgggaagacggctctggga

SEQ ID NO: 1553 - DNA, 20 bp, Artificial
  CRISPR gRNA sequence
tgggaagacggctctgggaa

SEQ ID NO: 1554 - DNA, 20 bp, Artificial
  CRISPR gRNA sequence
ggaagacggctctgggaaag

SEQ ID NO: 1555 - DNA, 20 bp, Artificial
  CRISPR gRNA sequence
gaagacggctctgggaaagg

SEQ ID NO: 1556 - DNA, 20 bp, Artificial
  CRISPR gRNA sequence
aagacggctctgggaaagga

SEQ ID NO: 1557 - DNA, 20 bp, Artificial
  CRISPR gRNA sequence
agacggctctgggaaaggag

SEQ ID NO: 1558 - DNA, 20 bp, Artificial
  CRISPR gRNA sequence
cggctctgggaaaggagggg

SEQ ID NO: 1559 - DNA, 20 bp, Artificial
  CRISPR gRNA sequence
ctgggaaaggaggggaagat

SEQ ID NO: 1560 - DNA, 20 bp, Artificial
  CRISPR gRNA sequence
tgggaaaggaggggaagatg

SEQ ID NO: 1561 - DNA, 20 bp, Artificial
  CRISPR gRNA sequence
gggaaaggaggggaagatga

SEQ ID NO: 1562 - DNA, 20 bp, Artificial
  CRISPR gRNA sequence
ggaaaggaggggaagatgag

SEQ ID NO: 1563 - DNA, 20 bp, Artificial
  CRISPR gRNA sequence
gaggggccctgaccctgctg

SEQ ID NO: 1564 - DNA, 20 bp, Artificial
  CRISPR gRNA sequence
aggggccctgaccctgctga

SEQ ID NO: 1565 - DNA, 20 bp, Artificial
  CRISPR gRNA sequence
ggggccctgaccctgctgaa

SEQ ID NO: 1566 - DNA, 20 bp, Artificial
  CRISPR gRNA sequence
gaagggctcctgctttccct

SEQ ID NO: 1567 - DNA, 20 bp, Artificial
  CRISPR gRNA sequence
gggctcctgctttccctgag

SEQ ID NO: 1568 - DNA, 20 bp, Artificial
  CRISPR gRNA sequence
gctcctgctttccctgagaa

SEQ ID NO: 1569 - DNA, 20 bp, Artificial
  CRISPR gRNA sequence
tccccctccttaccccatct

SEQ ID NO: 1570 - DNA, 20 bp, Artificial
  CRISPR gRNA sequence
ccccctccttaccccatctc

SEQ ID NO: 1571 - DNA, 20 bp, Artificial
  CRISPR gRNA sequence
cccctccttaccccatctca

SEQ ID NO: 1572 - DNA, 20 bp, Artificial
  CRISPR gRNA sequence
tccttaccccatctcagggt

SEQ ID NO: 1573 - DNA, 20 bp, Artificial
  CRISPR gRNA sequence
ccttaccccatctcagggtg

SEQ ID NO: 1574 - DNA, 20 bp, Artificial
  CRISPR gRNA sequence
cttaccccatctcagggtga

SEQ ID NO: 1575 - DNA, 20 bp, Artificial
  CRISPR gRNA sequence
ttaccccatctcagggtgag

SEQ ID NO: 1576 - DNA, 20 bp, Artificial
  CRISPR gRNA sequence
catctcagggtgaggggctt

SEQ ID NO: 1577 - DNA, 20 bp, Artificial
  CRISPR gRNA sequence
ctcagggtgaggggcttcgg

SEQ ID NO: 1578 - DNA, 20 bp, Artificial
  CRISPR gRNA sequence
gcagcccctcatgctgtaca

SEQ ID NO: 1579 - DNA, 20 bp, Artificial
  CRISPR gRNA sequence
tgtgtatctctgctcttctc

SEQ ID NO: 1580 - DNA, 20 bp, Artificial
  CRISPR gRNA sequence
gtatctctgctcttctccag

SEQ ID NO: 1581 - DNA, 20 bp, Artificial
  CRISPR gRNA sequence
tatctctgctcttctccaga

SEQ ID NO: 1582 - DNA, 20 bp, Artificial
  CRISPR gRNA sequence
ttctccagaaggcaccacca

SEQ ID NO: 1583 - DNA, 20 bp, Artificial
  CRISPR gRNA sequence
ccaccacagctgcccacttc

SEQ ID NO: 1584 - DNA, 20 bp, Artificial
  CRISPR gRNA sequence
ccacagctgcccacttctgg

SEQ ID NO: 1585 - DNA, 20 bp, Artificial
  CRISPR gRNA sequence
cacagctgcccacttctgga

SEQ ID NO: 1586 - DNA, 20 bp, Artificial
  CRISPR gRNA sequence
tggaaggttctatctcctgc

SEQ ID NO: 1587 - DNA, 20 bp, Artificial
  CRISPR gRNA sequence
ggttctatctcctgctggtc

SEQ ID NO: 1588 - DNA, 20 bp, Artificial
  CRISPR gRNA sequence
cctgctggtctggtctccac

SEQ ID NO: 1589 - DNA, 20 bp, Artificial
  CRISPR gRNA sequence
tggtctggtctccacaagct

SEQ ID NO: 1590 - DNA, 20 bp, Artificial
  CRISPR gRNA sequence
ctccacaagctcagtgtcct

SEQ ID NO: 1591 - DNA, 20 bp, Artificial
  CRISPR gRNA sequence
caagctcagtgtcctgagtt

SEQ ID NO: 1592 - DNA, 20 bp, Artificial
  CRISPR gRNA sequence
ggtcctcgccatcccgctgc

SEQ ID NO: 1593 - DNA, 20 bp, Artificial
  CRISPR gRNA sequence
gtcctcgccatcccgctgcc

SEQ ID NO: 1594 - DNA, 20 bp, Artificial
  CRISPR gRNA sequence
tcgccatcccgctgccaggt

SEQ ID NO: 1595 - DNA, 20 bp, Artificial
  CRISPR gRNA sequence
ccaggtcagtgtgatctccg

SEQ ID NO: 1596 - DNA, 20 bp, Artificial
  CRISPR gRNA sequence
caggtcagtgtgatctccgc

SEQ ID NO: 1597 - DNA, 20 bp, Artificial
  CRISPR gRNA sequence
aggtcagtgtgatctccgca

SEQ ID NO: 1598 - DNA, 20 bp, Artificial
  CRISPR gRNA sequence
tcagtgtgatctccgcaggg

SEQ ID NO: 1599 - DNA, 20 bp, Artificial
  CRISPR gRNA sequence
atctccgcagggtagaaacc

SEQ ID NO: 1600 - DNA, 20 bp, Artificial
  CRISPR gRNA sequence
tctccgcagggtagaaaccc

SEQ ID NO: 1601 - DNA, 20 bp, Artificial
  CRISPR gRNA sequence
ctccgcagggtagaaaccca

SEQ ID NO: 1602 - DNA, 20 bp, Artificial
  CRISPR gRNA sequence
cagggtagaaacccagggcc

SEQ ID NO: 1603 - DNA, 20 bp, Artificial
  CRISPR gRNA sequence
aaacccagggcccagcacct

SEQ ID NO: 1604 - DNA, 20 bp, Artificial
  CRISPR gRNA sequence
aacccagggcccagcacctc

SEQ ID NO: 1605 - DNA, 20 bp, Artificial
  CRISPR gRNA sequence
acccagggcccagcacctca

SEQ ID NO: 1606 - DNA, 20 bp, Artificial
  CRISPR gRNA sequence
cagggcccagcacctcaggg

SEQ ID NO: 1607 - DNA, 20 bp, Artificial
  CRISPR gRNA sequence
agcacctcagggtggcctca

SEQ ID NO: 1608 - DNA, 20 bp, Artificial
  CRISPR gRNA sequence
cctcagggtggcctcatggt

SEQ ID NO: 1609 - DNA, 20 bp, Artificial
  CRISPR gRNA sequence
tcagggtggcctcatggtca

SEQ ID NO: 1610 - DNA, 20 bp, Artificial
  CRISPR gRNA sequence
ggtggcctcatggtcagaga

SEQ ID NO: 1611 - DNA, 20 bp, Artificial
  CRISPR gRNA sequence
gtggcctcatggtcagagat

SEQ ID NO: 1612 - DNA, 20 bp, Artificial
  CRISPR gRNA sequence
tggcctcatggtcagagatg

SEQ ID NO: 1613 - DNA, 20 bp, Artificial
  CRISPR gRNA sequence
cctcatggtcagagatgggg

SEQ ID NO: 1614 - DNA, 20 bp, Artificial
  CRISPR gRNA sequence
catggtcagagatggggtgg

SEQ ID NO: 1615 - DNA, 20 bp, Artificial
  CRISPR gRNA sequence
atggtcagagatggggtggt

SEQ ID NO: 1616 - DNA, 20 bp, Artificial
  CRISPR gRNA sequence
tggtgggtcacgtgtgtctt

SEQ ID NO: 1617 - DNA, 20 bp, Artificial
  CRISPR gRNA sequence
ggtgggtcacgtgtgtcttt

SEQ ID NO: 1618 - DNA, 20 bp, Artificial
  CRISPR gRNA sequence
gtgggtcacgtgtgtctttg

SEQ ID NO: 1619 - DNA, 20 bp, Artificial
  CRISPR gRNA sequence
tgggtcacgtgtgtctttgg

SEQ ID NO: 1620 - DNA, 20 bp, Artificial
  CRISPR gRNA sequence
gggtcacgtgtgtctttggg

SEQ ID NO: 1621 - DNA, 20 bp, Artificial
  CRISPR gRNA sequence
tgtgtctttggggggtctga

SEQ ID NO: 1622 - DNA, 20 bp, Artificial
  CRISPR gRNA sequence
gtgtctttggggggtctgat

SEQ ID NO: 1623 - DNA, 20 bp, Artificial
  CRISPR gRNA sequence
tctttggggggtctgatggg

SEQ ID NO: 1624 - DNA, 20 bp, Artificial
  CRISPR gRNA sequence
tttggggggtctgatgggaa

SEQ ID NO: 1625 - DNA, 20 bp, Artificial
  CRISPR gRNA sequence
gggggtctgatgggaagagt

SEQ ID NO: 1626 - DNA, 20 bp, Artificial
  CRISPR gRNA sequence
atgggaagagtcagaaaatt

SEQ ID NO: 1627 - DNA, 20 bp, Artificial
  CRISPR gRNA sequence
tgggaagagtcagaaaattc

SEQ ID NO: 1628 - DNA, 20 bp, Artificial
  CRISPR gRNA sequence
caggcgctttgcatctttca

SEQ ID NO: 1629 - DNA, 20 bp, Artificial
  CRISPR gRNA sequence
aggcgctttgcatctttcat

SEQ ID NO: 1630 - DNA, 20 bp, Artificial
  CRISPR gRNA sequence
gcatctttcatgggacaccc

SEQ ID NO: 1631 - DNA, 20 bp, Artificial
  CRISPR gRNA sequence
catctttcatgggacaccct

SEQ ID NO: 1632 - DNA, 20 bp, Artificial
  CRISPR gRNA sequence
cctaggaccacccatgtgac

SEQ ID NO: 1633 - DNA, 20 bp, Artificial
  CRISPR gRNA sequence
accacccatgtgaccagcct

SEQ ID NO: 1634 - DNA, 20 bp, Artificial
  CRISPR gRNA sequence
ccatgtgaccagcctgagaa

SEQ ID NO: 1635 - DNA, 20 bp, Artificial
  CRISPR gRNA sequence
gtgaccagcctgagaatgga

SEQ ID NO: 1636 - DNA, 20 bp, Artificial
  CRISPR gRNA sequence
tgaccagcctgagaatggac

SEQ ID NO: 1637 - DNA, 20 bp, Artificial
  CRISPR gRNA sequence
ctgagaatggacaggacacc

SEQ ID NO: 1638 - DNA, 20 bp, Artificial
  CRISPR gRNA sequence
tgagaatggacaggacacct

SEQ ID NO: 1639 - DNA, 20 bp, Artificial
  CRISPR gRNA sequence
gagaatggacaggacacctg

SEQ ID NO: 1640 - DNA, 20 bp, Artificial
  CRISPR gRNA sequence
aatggacaggacacctgggg

SEQ ID NO: 1641 - DNA, 20 bp, Artificial
  CRISPR gRNA sequence
atggacaggacacctggggt

SEQ ID NO: 1642 - DNA, 20 bp, Artificial
  CRISPR gRNA sequence
tggacaggacacctggggtg

SEQ ID NO: 1643 - DNA, 20 bp, Artificial
  CRISPR gRNA sequence
acaggacacctggggtgggg

SEQ ID NO: 1644 - DNA, 20 bp, Artificial
  CRISPR gRNA sequence
caggacacctggggtgggga

SEQ ID NO: 1645 - DNA, 20 bp, Artificial
  CRISPR gRNA sequence
aggacacctggggtggggaa

SEQ ID NO: 1646 - DNA, 20 bp, Artificial
  CRISPR gRNA sequence
ggacacctggggtggggaag

SEQ ID NO: 1647 - DNA, 20 bp, Artificial
  CRISPR gRNA sequence
cctggggtggggaaggggca

SEQ ID NO: 1648 - DNA, 20 bp, Artificial
  CRISPR gRNA sequence
tggggaaggggcacagaacc

SEQ ID NO: 1649 - DNA, 20 bp, Artificial
  CRISPR gRNA sequence
ggggcacagaacccagacac

SEQ ID NO: 1650 - DNA, 20 bp, Artificial
  CRISPR gRNA sequence
acagaacccagacaccagcc

SEQ ID NO: 1651 - DNA, 20 bp, Artificial
  CRISPR gRNA sequence
cccagacaccagcctggacg

SEQ ID NO: 1652 - DNA, 20 bp, Artificial
  CRISPR gRNA sequence
ccagacaccagcctggacgc

SEQ ID NO: 1653 - DNA, 20 bp, Artificial
  CRISPR gRNA sequence
ccagcctggacgcaggcacc

SEQ ID NO: 1654 - DNA, 20 bp, Artificial
  CRISPR gRNA sequence
cagcctggacgcaggcacct

SEQ ID NO: 1655 - DNA, 20 bp, Artificial
  CRISPR gRNA sequence
tgggataatctcctattcat

SEQ ID NO: 1656 - DNA, 20 bp, Artificial
  CRISPR gRNA sequence
ataatctcctattcattgga

SEQ ID NO: 1657 - DNA, 20 bp, Artificial
  CRISPR gRNA sequence
tcctattcattggaaagttc

SEQ ID NO: 1658 - DNA, 20 bp, Artificial
  CRISPR gRNA sequence
attggaaagttcgagtctct

SEQ ID NO: 1659 - DNA, 20 bp, Artificial
  CRISPR gRNA sequence
ggaaagttcgagtctctgag

SEQ ID NO: 1660 - DNA, 20 bp, Artificial
  CRISPR gRNA sequence
gaaagttcgagtctctgagc

SEQ ID NO: 1661 - DNA, 20 bp, Artificial
  CRISPR gRNA sequence
aaagttcgagtctctgagcg

SEQ ID NO: 1662 - DNA, 20 bp, Artificial
  CRISPR gRNA sequence
tcgagtctctgagcggggaa

SEQ ID NO: 1663 - DNA, 20 bp, Artificial
  CRISPR gRNA sequence
cgagtctctgagcggggaac

SEQ ID NO: 1664 - DNA, 20 bp, Artificial
  CRISPR gRNA sequence
gagtctctgagcggggaaca

SEQ ID NO: 1665 - DNA, 20 bp, Artificial
  CRISPR gRNA sequence
gggacttctgctcctgatct

SEQ ID NO: 1666 - DNA, 20 bp, Artificial
  CRISPR gRNA sequence
acttctgctcctgatctgag

SEQ ID NO: 1667 - DNA, 20 bp, Artificial
  CRISPR gRNA sequence
ttctgctcctgatctgagtg

SEQ ID NO: 1668 - DNA, 20 bp, Artificial
  CRISPR gRNA sequence
tctgctcctgatctgagtgg

SEQ ID NO: 1669 - DNA, 20 bp, Artificial
  CRISPR gRNA sequence
tcctgatctgagtggaggta

SEQ ID NO: 1670 - DNA, 20 bp, Artificial
  CRISPR gRNA sequence
tgagtggaggtaaagtgact

SEQ ID NO: 1671 - DNA, 20 bp, Artificial
  CRISPR gRNA sequence
gtggaggtaaagtgactcag

SEQ ID NO: 1672 - DNA, 20 bp, Artificial
  CRISPR gRNA sequence
gtaaagtgactcagaagtgc

SEQ ID NO: 1673 - DNA, 20 bp, Artificial
  CRISPR gRNA sequence
tgactcagaagtgctggaat

SEQ ID NO: 1674 - DNA, 20 bp, Artificial
  CRISPR gRNA sequence
actcagaagtgctggaatca

SEQ ID NO: 1675 - DNA, 20 bp, Artificial
  CRISPR gRNA sequence
atcagagccccaaacacact

SEQ ID NO: 1676 - DNA, 20 bp, Artificial
  CRISPR gRNA sequence
gccccaaacacactgagtgt

SEQ ID NO: 1677 - DNA, 20 bp, Artificial
  CRISPR gRNA sequence
ccccaaacacactgagtgtg

SEQ ID NO: 1678 - DNA, 20 bp, Artificial
  CRISPR gRNA sequence
caaacacactgagtgtgagg

SEQ ID NO: 1679 - DNA, 20 bp, Artificial
  CRISPR gRNA sequence
aacacactgagtgtgaggca

SEQ ID NO: 1680 - DNA, 20 bp, Artificial
  CRISPR gRNA sequence
ctgagtgtgaggcagagaac

SEQ ID NO: 1681 - DNA, 20 bp, Artificial
  CRISPR gRNA sequence
tgagtgtgaggcagagaaca

SEQ ID NO: 1682 - DNA, 20 bp, Artificial
  CRISPR gRNA sequence
tgaggcagagaacaaggcct

SEQ ID NO: 1683 - DNA, 20 bp, Artificial
  CRISPR gRNA sequence
aggcagagaacaaggcctga

SEQ ID NO: 1684 - DNA, 20 bp, Artificial
  CRISPR gRNA sequence
ggcagagaacaaggcctgag

SEQ ID NO: 1685 - DNA, 20 bp, Artificial
  CRISPR gRNA sequence
agaacaaggcctgagaggaa

SEQ ID NO: 1686 - DNA, 20 bp, Artificial
  CRISPR gRNA sequence
aggcctgagaggaaaagtca

SEQ ID NO: 1687 - DNA, 20 bp, Artificial
  CRISPR gRNA sequence
gaggaaaagtcacggttccc

SEQ ID NO: 1688 - DNA, 20 bp, Artificial
  CRISPR gRNA sequence
aggaaaagtcacggttccca

SEQ ID NO: 1689 - DNA, 20 bp, Artificial
  CRISPR gRNA sequence
cacggttcccaaggctgctg

SEQ ID NO: 1690 - DNA, 20 bp, Artificial
  CRISPR gRNA sequence
acggttcccaaggctgctgc

SEQ ID NO: 1691 - DNA, 20 bp, Artificial
  CRISPR gRNA sequence
cggttcccaaggctgctgca

SEQ ID NO: 1692 - DNA, 20 bp, Artificial
  CRISPR gRNA sequence
ggttcccaaggctgctgcag

SEQ ID NO: 1693 - DNA, 20 bp, Artificial
  CRISPR gRNA sequence
caaggctgctgcaggggtca

SEQ ID NO: 1694 - DNA, 20 bp, Artificial
  CRISPR gRNA sequence
aaggctgctgcaggggtcaa

SEQ ID NO: 1695 - DNA, 20 bp, Artificial
  CRISPR gRNA sequence
aggctgctgcaggggtcaaa

SEQ ID NO: 1696 - DNA, 20 bp, Artificial
  CRISPR gRNA sequence
ggctgctgcaggggtcaaag

SEQ ID NO: 1697 - DNA, 20 bp, Artificial
  CRISPR gRNA sequence
ggtcaaaggggacccctgat

SEQ ID NO: 1698 - DNA, 20 bp, Artificial
  CRISPR gRNA sequence
gggacccctgatcagtattc

SEQ ID NO: 1699 - DNA, 20 bp, Artificial
  CRISPR gRNA sequence
ggacccctgatcagtattct

SEQ ID NO: 1700 - DNA, 20 bp, Artificial
  CRISPR gRNA sequence
gacccctgatcagtattcta

SEQ ID NO: 1701 - DNA, 20 bp, Artificial
  CRISPR gRNA sequence
tgtcttcccctccatttcct

SEQ ID NO: 1702 - DNA, 20 bp, Artificial
  CRISPR gRNA sequence
tcttcccctccatttcctca

SEQ ID NO: 1703 - DNA, 20 bp, Artificial
  CRISPR gRNA sequence
gacgtcattccttaattgtc

SEQ ID NO: 1704 - DNA, 20 bp, Artificial
  CRISPR gRNA sequence
cgtcattccttaattgtcta

SEQ ID NO: 1705 - DNA, 20 bp, Artificial
  CRISPR gRNA sequence
tcattccttaattgtctaga

SEQ ID NO: 1706 - DNA, 20 bp, Artificial
  CRISPR gRNA sequence
ttccttaattgtctagagag

SEQ ID NO: 1707 - DNA, 20 bp, Artificial
  CRISPR gRNA sequence
ccttaattgtctagagagaa

SEQ ID NO: 1708 - DNA, 20 bp, Artificial
  CRISPR gRNA sequence
cttaattgtctagagagaag

SEQ ID NO: 1709 - DNA, 20 bp, Artificial
  CRISPR gRNA sequence
ttaattgtctagagagaaga

SEQ ID NO: 1710 - DNA, 20 bp, Artificial
  CRISPR gRNA sequence
taattgtctagagagaagag

SEQ ID NO: 1711 - DNA, 20 bp, Artificial
  CRISPR gRNA sequence
aattgtctagagagaagagg

SEQ ID NO: 1712 - DNA, 20 bp, Artificial
  CRISPR gRNA sequence
tagagagaagagggggccct

SEQ ID NO: 1713 - DNA, 20 bp, Artificial
  CRISPR gRNA sequence
gagagaagagggggccctca

SEQ ID NO: 1714 - DNA, 20 bp, Artificial
  CRISPR gRNA sequence
agagaagagggggccctcag

SEQ ID NO: 1715 - DNA, 20 bp, Artificial
  CRISPR gRNA sequence
gggggccctcagaggaaact

SEQ ID NO: 1716 - DNA, 20 bp, Artificial
  CRISPR gRNA sequence
ggggccctcagaggaaactc

SEQ ID NO: 1717 - DNA, 20 bp, Artificial
  CRISPR gRNA sequence
tcatgccattctccattcaa

SEQ ID NO: 1718 - DNA, 20 bp, Artificial
  CRISPR gRNA sequence
atgccattctccattcaacg

SEQ ID NO: 1719 - DNA, 20 bp, Artificial
  CRISPR gRNA sequence
tgccattctccattcaacgg

SEQ ID NO: 1720 - DNA, 20 bp, Artificial
  CRISPR gRNA sequence
gccattctccattcaacgga

SEQ ID NO: 1721 - DNA, 20 bp, Artificial
  CRISPR gRNA sequence
ttcaacggagggcgacattc

SEQ ID NO: 1722 - DNA, 20 bp, Artificial
  CRISPR gRNA sequence
ccattttcctcctcttctcg

SEQ ID NO: 1723 - DNA, 20 bp, Artificial
  CRISPR gRNA sequence
cattttcctcctcttctcgt

SEQ ID NO: 1724 - DNA, 20 bp, Artificial
  CRISPR gRNA sequence
ttttcctcctcttctcgtgg

SEQ ID NO: 1725 - DNA, 20 bp, Artificial
  CRISPR gRNA sequence
tttcctcctcttctcgtggg

SEQ ID NO: 1726 - DNA, 20 bp, Artificial
  CRISPR gRNA sequence
ttctcgtgggaggccatccc

SEQ ID NO: 1727 - DNA, 20 bp, Artificial
  CRISPR gRNA sequence
aggccatccccggcgaccta

SEQ ID NO: 1728 - DNA, 20 bp, Artificial
  CRISPR gRNA sequence
ggccatccccggcgacctat

SEQ ID NO: 1729 - DNA, 20 bp, Artificial
  CRISPR gRNA sequence
ccatccccggcgacctatag

SEQ ID NO: 1730 - DNA, 20 bp, Artificial
  CRISPR gRNA sequence
ccccggcgacctataggaga

SEQ ID NO: 1731 - DNA, 20 bp, Artificial
  CRISPR gRNA sequence
cccggcgacctataggagat

SEQ ID NO: 1732 - DNA, 20 bp, Artificial
  CRISPR gRNA sequence
ccggcgacctataggagatg

SEQ ID NO: 1733 - DNA, 20 bp, Artificial
  CRISPR gRNA sequence
gcgacctataggagatgggg

SEQ ID NO: 1734 - DNA, 20 bp, Artificial
  CRISPR gRNA sequence
cgacctataggagatgggga

SEQ ID NO: 1735 - DNA, 20 bp, Artificial
  CRISPR gRNA sequence
ggaaggctccccactgcccc

SEQ ID NO: 1736 - DNA, 20 bp, Artificial
  CRISPR gRNA sequence
ctccccactgcccctggtac

SEQ ID NO: 1737 - DNA, 20 bp, Artificial
  CRISPR gRNA sequence
cccctggtaccagcgcgctc

SEQ ID NO: 1738 - DNA, 20 bp, Artificial
  CRISPR gRNA sequence
agcttgtccttcccgttctc

SEQ ID NO: 1739 - DNA, 20 bp, Artificial
  CRISPR gRNA sequence
gcttgtccttcccgttctcc

SEQ ID NO: 1740 - DNA, 20 bp, Artificial
  CRISPR gRNA sequence
tcccgttctccaggtatctg

SEQ ID NO: 1741 - DNA, 20 bp, Artificial
  CRISPR gRNA sequence
ccgttctccaggtatctgcg

SEQ ID NO: 1742 - DNA, 20 bp, Artificial
  CRISPR gRNA sequence
cactccacgcactcgccctc

SEQ ID NO: 1743 - DNA, 20 bp, Artificial
  CRISPR gRNA sequence
actccacgcactcgccctcc

SEQ ID NO: 1744 - DNA, 20 bp, Artificial
  CRISPR gRNA sequence
ccacgcactcgccctccagg

SEQ ID NO: 1745 - DNA, 20 bp, Artificial
  CRISPR gRNA sequence
cacgcactcgccctccaggt

SEQ ID NO: 1746 - DNA, 20 bp, Artificial
  CRISPR gRNA sequence
ctctccgctgctccgcctca

SEQ ID NO: 1747 - DNA, 20 bp, Artificial
  CRISPR gRNA sequence
tctccgctgctccgcctcac

SEQ ID NO: 1748 - DNA, 20 bp, Artificial
  CRISPR gRNA sequence
gggccgcctcccacttgcgc

SEQ ID NO: 1749 - DNA, 20 bp, Artificial
  CRISPR gRNA sequence
ggccgcctcccacttgcgct

SEQ ID NO: 1750 - DNA, 20 bp, Artificial
  CRISPR gRNA sequence
ccacttgcgctgggtgatct

SEQ ID NO: 1751 - DNA, 20 bp, Artificial
  CRISPR gRNA sequence
gatctgagccgccgtgtccg

SEQ ID NO: 1752 - DNA, 20 bp, Artificial
  CRISPR gRNA sequence
ctgagccgccgtgtccgcgg

SEQ ID NO: 1753 - DNA, 20 bp, Artificial
  CRISPR gRNA sequence
ccgccgtgtccgcggcggtc

SEQ ID NO: 1754 - DNA, 20 bp, Artificial
  CRISPR gRNA sequence
cgccgtgtccgcggcggtcc

SEQ ID NO: 1755 - DNA, 20 bp, Artificial
  CRISPR gRNA sequence
ccgtgtccgcggcggtccag

SEQ ID NO: 1756 - DNA, 20 bp, Artificial
  CRISPR gRNA sequence
tccgcggcggtccaggagcg

SEQ ID NO: 1757 - DNA, 20 bp, Artificial
  CRISPR gRNA sequence
ccgcggcggtccaggagcgc

SEQ ID NO: 1758 - DNA, 20 bp, Artificial
  CRISPR gRNA sequence
caggagcgcaggtcctcgtt

SEQ ID NO: 1759 - DNA, 20 bp, Artificial
  CRISPR gRNA sequence
aggagcgcaggtcctcgttc

SEQ ID NO: 1760 - DNA, 20 bp, Artificial
  CRISPR gRNA sequence
ggagcgcaggtcctcgttca

SEQ ID NO: 1761 - DNA, 20 bp, Artificial
  CRISPR gRNA sequence
cgatgtaatccttgccgtcg

SEQ ID NO: 1762 - DNA, 20 bp, Artificial
  CRISPR gRNA sequence
gatgtaatccttgccgtcgt

SEQ ID NO: 1763 - DNA, 20 bp, Artificial
  CRISPR gRNA sequence
ccttgccgtcgtaggcgtac

SEQ ID NO: 1764 - DNA, 20 bp, Artificial
  CRISPR gRNA sequence
aggcgtactggtcatgcccg

SEQ ID NO: 1765 - DNA, 20 bp, Artificial
  CRISPR gRNA sequence
gcgtactggtcatgcccgcg

SEQ ID NO: 1766 - DNA, 20 bp, Artificial
  CRISPR gRNA sequence
cgtactggtcatgcccgcgg

SEQ ID NO: 1767 - DNA, 20 bp, Artificial
  CRISPR gRNA sequence
tactggtcatgcccgcggag

SEQ ID NO: 1768 - DNA, 20 bp, Artificial
  CRISPR gRNA sequence
actggtcatgcccgcggagg

SEQ ID NO: 1769 - DNA, 20 bp, Artificial
  CRISPR gRNA sequence
ccgcggaggaggcgcccgtc

SEQ ID NO: 1770 - DNA, 20 bp, Artificial
  CRISPR gRNA sequence
gcccgtccggccccacgtcg

SEQ ID NO: 1771 - DNA, 20 bp, Artificial
  CRISPR gRNA sequence
cgtcgcagccgtacatgctc

SEQ ID NO: 1772 - DNA, 20 bp, Artificial
  CRISPR gRNA sequence
tcgcagccgtacatgctctg

SEQ ID NO: 1773 - DNA, 20 bp, Artificial
  CRISPR gRNA sequence
cgcagccgtacatgctctgg

SEQ ID NO: 1774 - DNA, 20 bp, Artificial
  CRISPR gRNA sequence
gcagccgtacatgctctgga

SEQ ID NO: 1775 - DNA, 20 bp, Artificial
  CRISPR gRNA sequence
gtacatgctctggagggtgt

SEQ ID NO: 1776 - DNA, 20 bp, Artificial
  CRISPR gRNA sequence
ctctggagggtgtgagaccc

SEQ ID NO: 1777 - DNA, 20 bp, Artificial
  CRISPR gRNA sequence
agggtgtgagaccctggccc

SEQ ID NO: 1778 - DNA, 20 bp, Artificial
  CRISPR gRNA sequence
agaccctggccccggccccg

SEQ ID NO: 1779 - DNA, 20 bp, Artificial
  CRISPR gRNA sequence
cctggccccggccccgcggt

SEQ ID NO: 1780 - DNA, 20 bp, Artificial
  CRISPR gRNA sequence
ccccggccccgcggtcagcc

SEQ ID NO: 1781 - DNA, 20 bp, Artificial
  CRISPR gRNA sequence
cgcggtcagcccagtccccc

SEQ ID NO: 1782 - DNA, 20 bp, Artificial
  CRISPR gRNA sequence
gccccgccccgaccaacccg

SEQ ID NO: 1783 - DNA, 20 bp, Artificial
  CRISPR gRNA sequence
ccccgccccgaccaacccgc

SEQ ID NO: 1784 - DNA, 20 bp, Artificial
  CRISPR gRNA sequence
cccgccccgaccaacccgcg

SEQ ID NO: 1785 - DNA, 20 bp, Artificial
  CRISPR gRNA sequence
cgaccaacccgcggggattt

SEQ ID NO: 1786 - DNA, 20 bp, Artificial
  CRISPR gRNA sequence
gcctcaactgaaaatgaaac

SEQ ID NO: 1787 - DNA, 20 bp, Artificial
  CRISPR gRNA sequence
cctcaactgaaaatgaaacc

SEQ ID NO: 1788 - DNA, 20 bp, Artificial
  CRISPR gRNA sequence
tgaaaccgggtaaacgcgcc

SEQ ID NO: 1789 - DNA, 20 bp, Artificial
  CRISPR gRNA sequence
gaaaccgggtaaacgcgcct

SEQ ID NO: 1790 - DNA, 20 bp, Artificial
  CRISPR gRNA sequence
aaaccgggtaaacgcgcctg

SEQ ID NO: 1791 - DNA, 20 bp, Artificial
  CRISPR gRNA sequence
aacgcgcctggggctctcgc

SEQ ID NO: 1792 - DNA, 20 bp, Artificial
  CRISPR gRNA sequence
gcctggggctctcgccggtc

SEQ ID NO: 1793 - DNA, 20 bp, Artificial
  CRISPR gRNA sequence
cctggggctctcgccggtcg

SEQ ID NO: 1794 - DNA, 20 bp, Artificial
  CRISPR gRNA sequence
ctggggctctcgccggtcga

SEQ ID NO: 1795 - DNA, 20 bp, Artificial
  CRISPR gRNA sequence
gctctcgccggtcgagggtc

SEQ ID NO: 1796 - DNA, 20 bp, Artificial
  CRISPR gRNA sequence
ctctcgccggtcgagggtct

SEQ ID NO: 1797 - DNA, 20 bp, Artificial
  CRISPR gRNA sequence
tcgccggtcgagggtctggg

SEQ ID NO: 1798 - DNA, 20 bp, Artificial
  CRISPR gRNA sequence
cgccggtcgagggtctgggc

SEQ ID NO: 1799 - DNA, 20 bp, Artificial
  CRISPR gRNA sequence
gagggtctgggcgggtcccg

SEQ ID NO: 1800 - DNA, 20 bp, Artificial
  CRISPR gRNA sequence
ctgggcgggtcccgcggcct

SEQ ID NO: 1801 - DNA, 20 bp, Artificial
  CRISPR gRNA sequence
tgggcgggtcccgcggcctc

SEQ ID NO: 1802 - DNA, 20 bp, Artificial
  CRISPR gRNA sequence
gggcgggtcccgcggcctca

SEQ ID NO: 1803 - DNA, 20 bp, Artificial
  CRISPR gRNA sequence
gcgggtcccgcggcctcagg

SEQ ID NO: 1804 - DNA, 20 bp, Artificial
  CRISPR gRNA sequence
cgggtcccgcggcctcaggg

SEQ ID NO: 1805 - DNA, 20 bp, Artificial
  CRISPR gRNA sequence
gtcccgcggcctcagggagg

SEQ ID NO: 1806 - DNA, 20 bp, Artificial
  CRISPR gRNA sequence
ggcctcagggaggcggatct

SEQ ID NO: 1807 - DNA, 20 bp, Artificial
  CRISPR gRNA sequence
agggaggcggatctcggacc

SEQ ID NO: 1808 - DNA, 20 bp, Artificial
  CRISPR gRNA sequence
ggaggcggatctcggacccg

SEQ ID NO: 1809 - DNA, 20 bp, Artificial
  CRISPR gRNA sequence
ggatctcggacccggagact

SEQ ID NO: 1810 - DNA, 20 bp, Artificial
  CRISPR gRNA sequence
gatctcggacccggagactc

SEQ ID NO: 1811 - DNA, 20 bp, Artificial
  CRISPR gRNA sequence
atctcggacccggagactcg

SEQ ID NO: 1812 - DNA, 20 bp, Artificial
  CRISPR gRNA sequence
cccggagactcggggcgacc

SEQ ID NO: 1813 - DNA, 20 bp, Artificial
  CRISPR gRNA sequence
ccggagactcggggcgaccc

SEQ ID NO: 1814 - DNA, 20 bp, Artificial
  CRISPR gRNA sequence
ggggcgacccgggccgtacg

SEQ ID NO: 1815 - DNA, 20 bp, Artificial
  CRISPR gRNA sequence
gggcgacccgggccgtacgt

SEQ ID NO: 1816 - DNA, 20 bp, Artificial
  CRISPR gRNA sequence
ggcgacccgggccgtacgtg

SEQ ID NO: 1817 - DNA, 20 bp, Artificial
  CRISPR gRNA sequence
gcgacccgggccgtacgtgg

SEQ ID NO: 1818 - DNA, 20 bp, Artificial
  CRISPR gRNA sequence
cccgggccgtacgtggggga

SEQ ID NO: 1819 - DNA, 20 bp, Artificial
  CRISPR gRNA sequence
ccgggccgtacgtgggggat

SEQ ID NO: 1820 - DNA, 20 bp, Artificial
  CRISPR gRNA sequence
cgggccgtacgtgggggatg

SEQ ID NO: 1821 - DNA, 20 bp, Artificial
  CRISPR gRNA sequence
ggccgtacgtgggggatggg

SEQ ID NO: 1822 - DNA, 20 bp, Artificial
  CRISPR gRNA sequence
gggagtcgtgacctgcgccc

SEQ ID NO: 1823 - DNA, 20 bp, Artificial
  CRISPR gRNA sequence
ggagtcgtgacctgcgcccc

SEQ ID NO: 1824 - DNA, 20 bp, Artificial
  CRISPR gRNA sequence
tcgtgacctgcgccccgggc

SEQ ID NO: 1825 - DNA, 20 bp, Artificial
  CRISPR gRNA sequence
cgtgacctgcgccccgggcc

SEQ ID NO: 1826 - DNA, 20 bp, Artificial
  CRISPR gRNA sequence
gtgacctgcgccccgggccg

SEQ ID NO: 1827 - DNA, 20 bp, Artificial
  CRISPR gRNA sequence
cccgggccggggtcactcac

SEQ ID NO: 1828 - DNA, 20 bp, Artificial
  CRISPR gRNA sequence
gtcactcaccggcctcgctc

SEQ ID NO: 1829 - DNA, 20 bp, Artificial
  CRISPR gRNA sequence
caccggcctcgctctggttg

SEQ ID NO: 1830 - DNA, 20 bp, Artificial
  CRISPR gRNA sequence
cggcctcgctctggttgtag

SEQ ID NO: 1831 - DNA, 20 bp, Artificial
  CRISPR gRNA sequence
ctctggttgtagtagccgcg

SEQ ID NO: 1832 - DNA, 20 bp, Artificial
  CRISPR gRNA sequence
tctggttgtagtagccgcgc

SEQ ID NO: 1833 - DNA, 20 bp, Artificial
  CRISPR gRNA sequence
tagtagccgcgcaggttccg

SEQ ID NO: 1834 - DNA, 20 bp, Artificial
  CRISPR gRNA sequence
agtagccgcgcaggttccgc

SEQ ID NO: 1835 - DNA, 20 bp, Artificial
  CRISPR gRNA sequence
gcaggttccgcaggctctct

SEQ ID NO: 1836 - DNA, 20 bp, Artificial
  CRISPR gRNA sequence
gttccgcaggctctctcggt

SEQ ID NO: 1837 - DNA, 20 bp, Artificial
  CRISPR gRNA sequence
tctctcggtcagtctgtgcc

SEQ ID NO: 1838 - DNA, 20 bp, Artificial
  CRISPR gRNA sequence
ctctcggtcagtctgtgcct

SEQ ID NO: 1839 - DNA, 20 bp, Artificial
  CRISPR gRNA sequence
cagtctgtgcctgggccttg

SEQ ID NO: 1840 - DNA, 20 bp, Artificial
  CRISPR gRNA sequence
ccttgtagatctgtgtgttc

SEQ ID NO: 1841 - DNA, 20 bp, Artificial
  CRISPR gRNA sequence
gtgttccggtcccaatactc

SEQ ID NO: 1842 - DNA, 20 bp, Artificial
  CRISPR gRNA sequence
ggcccctcctgctctatcca

SEQ ID NO: 1843 - DNA, 20 bp, Artificial
  CRISPR gRNA sequence
tgctctatccacggcgcccg

SEQ ID NO: 1844 - DNA, 20 bp, Artificial
  CRISPR gRNA sequence
ggcgcccgcggctcctctct

SEQ ID NO: 1845 - DNA, 20 bp, Artificial
  CRISPR gRNA sequence
cggctcctctctcggactcg

SEQ ID NO: 1846 - DNA, 20 bp, Artificial
  CRISPR gRNA sequence
cgctgtcgaacctcacgaac

SEQ ID NO: 1847 - DNA, 20 bp, Artificial
  CRISPR gRNA sequence
gctgtcgaacctcacgaact

SEQ ID NO: 1848 - DNA, 20 bp, Artificial
  CRISPR gRNA sequence
cgaactgggtgtcgtccacg

SEQ ID NO: 1849 - DNA, 20 bp, Artificial
  CRISPR gRNA sequence
tgtcgtccacgtagcccact

SEQ ID NO: 1850 - DNA, 20 bp, Artificial
  CRISPR gRNA sequence
ccacgtagcccactgagatg

SEQ ID NO: 1851 - DNA, 20 bp, Artificial
  CRISPR gRNA sequence
cgtagcccactgagatgaag

SEQ ID NO: 1852 - DNA, 20 bp, Artificial
  CRISPR gRNA sequence
gtagcccactgagatgaagc

SEQ ID NO: 1853 - DNA, 20 bp, Artificial
  CRISPR gRNA sequence
tagcccactgagatgaagcg

SEQ ID NO: 1854 - DNA, 20 bp, Artificial
  CRISPR gRNA sequence
agatgaagcggggctccccg

SEQ ID NO: 1855 - DNA, 20 bp, Artificial
  CRISPR gRNA sequence
gaagcggggctccccgcggc

SEQ ID NO: 1856 - DNA, 20 bp, Artificial
  CRISPR gRNA sequence
aagcggggctccccgcggcc

SEQ ID NO: 1857 - DNA, 20 bp, Artificial
  CRISPR gRNA sequence
ggggctccccgcggccgggc

SEQ ID NO: 1858 - DNA, 20 bp, Artificial
  CRISPR gRNA sequence
gggctccccgcggccgggcc

SEQ ID NO: 1859 - DNA, 20 bp, Artificial
  CRISPR gRNA sequence
cccgcggccgggccgggaca

SEQ ID NO: 1860 - DNA, 20 bp, Artificial
  CRISPR gRNA sequence
cgcggccgggccgggacacg

SEQ ID NO: 1861 - DNA, 20 bp, Artificial
  CRISPR gRNA sequence
gcggccgggccgggacacgg

SEQ ID NO: 1862 - DNA, 20 bp, Artificial
  CRISPR gRNA sequence
cgggccgggacacggaggtg

SEQ ID NO: 1863 - DNA, 20 bp, Artificial
  CRISPR gRNA sequence
ggaggtgtagaaatacctca

SEQ ID NO: 1864 - DNA, 20 bp, Artificial
  CRISPR gRNA sequence
aggtgtagaaatacctcatg

SEQ ID NO: 1865 - DNA, 20 bp, Artificial
  CRISPR gRNA sequence
tgtagaaatacctcatggag

SEQ ID NO: 1866 - DNA, 20 bp, Artificial
  CRISPR gRNA sequence
gtagaaatacctcatggagt

SEQ ID NO: 1867 - DNA, 20 bp, Artificial
  CRISPR gRNA sequence
agaaatacctcatggagtgg

SEQ ID NO: 1868 - DNA, 20 bp, Artificial
  CRISPR gRNA sequence
tacctcatggagtgggagcc

SEQ ID NO: 1869 - DNA, 20 bp, Artificial
  CRISPR gRNA sequence
acctcatggagtgggagcct

SEQ ID NO: 1870 - DNA, 20 bp, Artificial
  CRISPR gRNA sequence
cctcatggagtgggagcctg

SEQ ID NO: 1871 - DNA, 20 bp, Artificial
  CRISPR gRNA sequence
ctcatggagtgggagcctgg

SEQ ID NO: 1872 - DNA, 20 bp, Artificial
  CRISPR gRNA sequence
tggagtgggagcctgggggt

SEQ ID NO: 1873 - DNA, 20 bp, Artificial
  CRISPR gRNA sequence
ggagtgggagcctgggggtg

SEQ ID NO: 1874 - DNA, 20 bp, Artificial
  CRISPR gRNA sequence
agtgggagcctgggggtgag

SEQ ID NO: 1875 - DNA, 20 bp, Artificial
  CRISPR gRNA sequence
gtgggagcctgggggtgagg

SEQ ID NO: 1876 - DNA, 20 bp, Artificial
  CRISPR gRNA sequence
tgggagcctgggggtgagga

SEQ ID NO: 1877 - DNA, 20 bp, Artificial
  CRISPR gRNA sequence
gggagcctgggggtgaggag

SEQ ID NO: 1878 - DNA, 20 bp, Artificial
  CRISPR gRNA sequence
cctgggggtgaggaggggct

SEQ ID NO: 1879 - DNA, 20 bp, Artificial
  CRISPR gRNA sequence
gacccgcccgaccctcctcc

SEQ ID NO: 1880 - DNA, 20 bp, Artificial
  CRISPR gRNA sequence
gcccgaccctcctcccggcg

SEQ ID NO: 1881 - DNA, 20 bp, Artificial
  CRISPR gRNA sequence
ctcctcccggcgcggctcct

SEQ ID NO: 1882 - DNA, 20 bp, Artificial
  CRISPR gRNA sequence
tcctcccggcgcggctcctc

SEQ ID NO: 1883 - DNA, 20 bp, Artificial
  CRISPR gRNA sequence
aggtcctgcgcccccgcctg

SEQ ID NO: 1884 - DNA, 20 bp, Artificial
  CRISPR gRNA sequence
tgcggtcccctcgctcctcc

SEQ ID NO: 1885 - DNA, 20 bp, Artificial
  CRISPR gRNA sequence
ggtcccctcgctcctcccgg

SEQ ID NO: 1886 - DNA, 20 bp, Artificial
  CRISPR gRNA sequence
tcccctcgctcctcccggca

SEQ ID NO: 1887 - DNA, 20 bp, Artificial
  CRISPR gRNA sequence
cccctcgctcctcccggcag

SEQ ID NO: 1888 - DNA, 20 bp, Artificial
  CRISPR gRNA sequence
ccctcccgacccgcactcac

SEQ ID NO: 1889 - DNA, 20 bp, Artificial
  CRISPR gRNA sequence
ccgacccgcactcaccggcc

SEQ ID NO: 1890 - DNA, 20 bp, Artificial
  CRISPR gRNA sequence
cgacccgcactcaccggccc

SEQ ID NO: 1891 - DNA, 20 bp, Artificial
  CRISPR gRNA sequence
gcactcaccggcccaggtct

SEQ ID NO: 1892 - DNA, 20 bp, Artificial
  CRISPR gRNA sequence
tcaccggcccaggtctcggt

SEQ ID NO: 1893 - DNA, 20 bp, Artificial
  CRISPR gRNA sequence
caccggcccaggtctcggtc

SEQ ID NO: 1894 - DNA, 20 bp, Artificial
  CRISPR gRNA sequence
accggcccaggtctcggtca

SEQ ID NO: 1895 - DNA, 20 bp, Artificial
  CRISPR gRNA sequence
gcccaggtctcggtcagggc

SEQ ID NO: 1896 - DNA, 20 bp, Artificial
  CRISPR gRNA sequence
cccaggtctcggtcagggcc

SEQ ID NO: 1897 - DNA, 20 bp, Artificial
  CRISPR gRNA sequence
ccaggtctcggtcagggcca

SEQ ID NO: 1898 - DNA, 20 bp, Artificial
  CRISPR gRNA sequence
cggtcagggccagggccgcc

SEQ ID NO: 1899 - DNA, 20 bp, Artificial
  CRISPR gRNA sequence
gtcagggccagggccgccga

SEQ ID NO: 1900 - DNA, 20 bp, Artificial
  CRISPR gRNA sequence
agggccagggccgccgagag

SEQ ID NO: 1901 - DNA, 20 bp, Artificial
  CRISPR gRNA sequence
gccagggccgccgagagcag

SEQ ID NO: 1902 - DNA, 20 bp, Artificial
  CRISPR gRNA sequence
ccagggccgccgagagcagc

SEQ ID NO: 1903 - DNA, 20 bp, Artificial
  CRISPR gRNA sequence
agggccgccgagagcagcag

SEQ ID NO: 1904 - DNA, 20 bp, Artificial
  CRISPR gRNA sequence
gggccgccgagagcagcagg

SEQ ID NO: 1905 - DNA, 20 bp, Artificial
  CRISPR gRNA sequence
cgccgagagcagcaggagga

SEQ ID NO: 1906 - DNA, 20 bp, Artificial
  CRISPR gRNA sequence
agagcagcaggaggacggtt

SEQ ID NO: 1907 - DNA, 20 bp, Artificial
  CRISPR gRNA sequence
gagcagcaggaggacggttc

SEQ ID NO: 1908 - DNA, 20 bp, Artificial
  CRISPR gRNA sequence
agcagcaggaggacggttcg

SEQ ID NO: 1909 - DNA, 20 bp, Artificial
  CRISPR gRNA sequence
acggttcggggcgccatgac

SEQ ID NO: 1910 - DNA, 20 bp, Artificial
  CRISPR gRNA sequence
gggcgccatgaccagcatct

SEQ ID NO: 1911 - DNA, 20 bp, Artificial
  CRISPR gRNA sequence
tgaccagcatctcggcgtct

SEQ ID NO: 1912 - DNA, 20 bp, Artificial
  CRISPR gRNA sequence
gaccagcatctcggcgtctg

SEQ ID NO: 1913 - DNA, 20 bp, Artificial
  CRISPR gRNA sequence
ccagcatctcggcgtctgag

SEQ ID NO: 1914 - DNA, 20 bp, Artificial
  CRISPR gRNA sequence
tcggcgtctgaggagactct

SEQ ID NO: 1915 - DNA, 20 bp, Artificial
  CRISPR gRNA sequence
gtctgaggagactctgagtc

SEQ ID NO: 1916 - DNA, 20 bp, Artificial
  CRISPR gRNA sequence
tctgaggagactctgagtcc

SEQ ID NO: 1917 - DNA, 20 bp, Artificial
  CRISPR gRNA sequence
gaggagactctgagtccggg

SEQ ID NO: 1918 - DNA, 20 bp, Artificial
  CRISPR gRNA sequence
aggagactctgagtccgggt

SEQ ID NO: 1919 - DNA, 20 bp, Artificial
  CRISPR gRNA sequence
tctgagtccgggtgggtgcg

SEQ ID NO: 1920 - DNA, 20 bp, Artificial
  CRISPR gRNA sequence
ctgagtccgggtgggtgcgt

SEQ ID NO: 1921 - DNA, 20 bp, Artificial
  CRISPR gRNA sequence
tgagtccgggtgggtgcgtg

SEQ ID NO: 1922 - DNA, 20 bp, Artificial
  CRISPR gRNA sequence
gggtgggtgcgtggggactt

SEQ ID NO: 1923 - DNA, 20 bp, Artificial
  CRISPR gRNA sequence
gtgcgtggggactttagaac

SEQ ID NO: 1924 - DNA, 20 bp, Artificial
  CRISPR gRNA sequence
tgcgtggggactttagaact

SEQ ID NO: 1925 - DNA, 20 bp, Artificial
  CRISPR gRNA sequence
ggactttagaactgggaccg

SEQ ID NO: 1926 - DNA, 20 bp, Artificial
  CRISPR gRNA sequence
gggaccgcggcgacgctgat

SEQ ID NO: 1927 - DNA, 20 bp, Artificial
  CRISPR gRNA sequence
gcgacgctgattggcttctc

SEQ ID NO: 1928 - DNA, 20 bp, Artificial
  CRISPR gRNA sequence
tgggtattggatatctagag

SEQ ID NO: 1929 - DNA, 20 bp, Artificial
  CRISPR gRNA sequence
ggatatctagagaagccaat

SEQ ID NO: 1930 - DNA, 20 bp, Artificial
  CRISPR gRNA sequence
gaagccaatcagcgtcgccg

SEQ ID NO: 1931 - DNA, 20 bp, Artificial
  CRISPR gRNA sequence
aatcagcgtcgccgcggtcc

SEQ ID NO: 1932 - DNA, 20 bp, Artificial
  CRISPR gRNA sequence
tcgccgcggtcccagttcta

SEQ ID NO: 1933 - DNA, 20 bp, Artificial
  CRISPR gRNA sequence
aaagtccccacgcacccacc

SEQ ID NO: 1934 - DNA, 20 bp, Artificial
  CRISPR gRNA sequence
cccacgcacccacccggact

SEQ ID NO: 1935 - DNA, 20 bp, Artificial
  CRISPR gRNA sequence
cacgcacccacccggactca

SEQ ID NO: 1936 - DNA, 20 bp, Artificial
  CRISPR gRNA sequence
acccggactcagagtctcct

SEQ ID NO: 1937 - DNA, 20 bp, Artificial
  CRISPR gRNA sequence
tcagagtctcctcagacgcc

SEQ ID NO: 1938 - DNA, 20 bp, Artificial
  CRISPR gRNA sequence
ctcctcagacgccgagatgc

SEQ ID NO: 1939 - DNA, 20 bp, Artificial
  CRISPR gRNA sequence
agacgccgagatgctggtca

SEQ ID NO: 1940 - DNA, 20 bp, Artificial
  CRISPR gRNA sequence
aaccgtcctcctgctgctct

SEQ ID NO: 1941 - DNA, 20 bp, Artificial
  CRISPR gRNA sequence
cgtcctcctgctgctctcgg

SEQ ID NO: 1942 - DNA, 20 bp, Artificial
  CRISPR gRNA sequence
cctgctgctctcggcggccc

SEQ ID NO: 1943 - DNA, 20 bp, Artificial
  CRISPR gRNA sequence
cggcggccctggccctgacc

SEQ ID NO: 1944 - DNA, 20 bp, Artificial
  CRISPR gRNA sequence
ccctggccctgaccgagacc

SEQ ID NO: 1945 - DNA, 20 bp, Artificial
  CRISPR gRNA sequence
cctggccctgaccgagacct

SEQ ID NO: 1946 - DNA, 20 bp, Artificial
  CRISPR gRNA sequence
gccctgaccgagacctgggc

SEQ ID NO: 1947 - DNA, 20 bp, Artificial
  CRISPR gRNA sequence
tgaccgagacctgggccggt

SEQ ID NO: 1948 - DNA, 20 bp, Artificial
  CRISPR gRNA sequence
gagacctgggccggtgagtg

SEQ ID NO: 1949 - DNA, 20 bp, Artificial
  CRISPR gRNA sequence
agacctgggccggtgagtgc

SEQ ID NO: 1950 - DNA, 20 bp, Artificial
  CRISPR gRNA sequence
ctgggccggtgagtgcgggt

SEQ ID NO: 1951 - DNA, 20 bp, Artificial
  CRISPR gRNA sequence
tgggccggtgagtgcgggtc

SEQ ID NO: 1952 - DNA, 20 bp, Artificial
  CRISPR gRNA sequence
ggccggtgagtgcgggtcgg

SEQ ID NO: 1953 - DNA, 20 bp, Artificial
  CRISPR gRNA sequence
gccggtgagtgcgggtcggg

SEQ ID NO: 1954 - DNA, 20 bp, Artificial
  CRISPR gRNA sequence
ccggtgagtgcgggtcggga

SEQ ID NO: 1955 - DNA, 20 bp, Artificial
  CRISPR gRNA sequence
agtgcgggtcgggagggaaa

SEQ ID NO: 1956 - DNA, 20 bp, Artificial
  CRISPR gRNA sequence
gggagggaaatggcctctgc

SEQ ID NO: 1957 - DNA, 20 bp, Artificial
  CRISPR gRNA sequence
ggagggaaatggcctctgcc

SEQ ID NO: 1958 - DNA, 20 bp, Artificial
  CRISPR gRNA sequence
agggaaatggcctctgccgg

SEQ ID NO: 1959 - DNA, 20 bp, Artificial
  CRISPR gRNA sequence
gggaaatggcctctgccggg

SEQ ID NO: 1960 - DNA, 20 bp, Artificial
  CRISPR gRNA sequence
gaaatggcctctgccgggag

SEQ ID NO: 1961 - DNA, 20 bp, Artificial
  CRISPR gRNA sequence
tggcctctgccgggaggagc

SEQ ID NO: 1962 - DNA, 20 bp, Artificial
  CRISPR gRNA sequence
ggcctctgccgggaggagcg

SEQ ID NO: 1963 - DNA, 20 bp, Artificial
  CRISPR gRNA sequence
gcctctgccgggaggagcga

SEQ ID NO: 1964 - DNA, 20 bp, Artificial
  CRISPR gRNA sequence
cctctgccgggaggagcgag

SEQ ID NO: 1965 - DNA, 20 bp, Artificial
  CRISPR gRNA sequence
cgggaggagcgaggggaccg

SEQ ID NO: 1966 - DNA, 20 bp, Artificial
  CRISPR gRNA sequence
gggaggagcgaggggaccgc

SEQ ID NO: 1967 - DNA, 20 bp, Artificial
  CRISPR gRNA sequence
aggagcgaggggaccgcagg

SEQ ID NO: 1968 - DNA, 20 bp, Artificial
  CRISPR gRNA sequence
ggagcgaggggaccgcaggc

SEQ ID NO: 1969 - DNA, 20 bp, Artificial
  CRISPR gRNA sequence
gagcgaggggaccgcaggcg

SEQ ID NO: 1970 - DNA, 20 bp, Artificial
  CRISPR gRNA sequence
agcgaggggaccgcaggcgg

SEQ ID NO: 1971 - DNA, 20 bp, Artificial
  CRISPR gRNA sequence
ggggaccgcaggcgggggcg

SEQ ID NO: 1972 - DNA, 20 bp, Artificial
  CRISPR gRNA sequence
gggaccgcaggcgggggcgc

SEQ ID NO: 1973 - DNA, 20 bp, Artificial
  CRISPR gRNA sequence
caggcgggggcgcaggacct

SEQ ID NO: 1974 - DNA, 20 bp, Artificial
  CRISPR gRNA sequence
aggcgggggcgcaggacctg

SEQ ID NO: 1975 - DNA, 20 bp, Artificial
  CRISPR gRNA sequence
gcgggggcgcaggacctgag

SEQ ID NO: 1976 - DNA, 20 bp, Artificial
  CRISPR gRNA sequence
caggacctgaggagccgcgc

SEQ ID NO: 1977 - DNA, 20 bp, Artificial
  CRISPR gRNA sequence
aggacctgaggagccgcgcc

SEQ ID NO: 1978 - DNA, 20 bp, Artificial
  CRISPR gRNA sequence
gacctgaggagccgcgccgg

SEQ ID NO: 1979 - DNA, 20 bp, Artificial
  CRISPR gRNA sequence
acctgaggagccgcgccggg

SEQ ID NO: 1980 - DNA, 20 bp, Artificial
  CRISPR gRNA sequence
ctgaggagccgcgccgggag

SEQ ID NO: 1981 - DNA, 20 bp, Artificial
  CRISPR gRNA sequence
tgaggagccgcgccgggagg

SEQ ID NO: 1982 - DNA, 20 bp, Artificial
  CRISPR gRNA sequence
gaggagccgcgccgggagga

SEQ ID NO: 1983 - DNA, 20 bp, Artificial
  CRISPR gRNA sequence
agccgcgccgggaggagggt

SEQ ID NO: 1984 - DNA, 20 bp, Artificial
  CRISPR gRNA sequence
gccgcgccgggaggagggtc

SEQ ID NO: 1985 - DNA, 20 bp, Artificial
  CRISPR gRNA sequence
gcgccgggaggagggtcggg

SEQ ID NO: 1986 - DNA, 20 bp, Artificial
  CRISPR gRNA sequence
cgccgggaggagggtcgggc

SEQ ID NO: 1987 - DNA, 20 bp, Artificial
  CRISPR gRNA sequence
gaggagggtcgggcgggtct

SEQ ID NO: 1988 - DNA, 20 bp, Artificial
  CRISPR gRNA sequence
tctcagcccctcctcacccc

SEQ ID NO: 1989 - DNA, 20 bp, Artificial
  CRISPR gRNA sequence
ctcagcccctcctcaccccc

SEQ ID NO: 1990 - DNA, 20 bp, Artificial
  CRISPR gRNA sequence
cccccaggctcccactccat

SEQ ID NO: 1991 - DNA, 20 bp, Artificial
  CRISPR gRNA sequence
ccccaggctcccactccatg

SEQ ID NO: 1992 - DNA, 20 bp, Artificial
  CRISPR gRNA sequence
atttctacacctccgtgtcc

SEQ ID NO: 1993 - DNA, 20 bp, Artificial
  CRISPR gRNA sequence
tacacctccgtgtcccggcc

SEQ ID NO: 1994 - DNA, 20 bp, Artificial
  CRISPR gRNA sequence
tccgtgtcccggcccggccg

SEQ ID NO: 1995 - DNA, 20 bp, Artificial
  CRISPR gRNA sequence
ccgtgtcccggcccggccgc

SEQ ID NO: 1996 - DNA, 20 bp, Artificial
  CRISPR gRNA sequence
cgtgtcccggcccggccgcg

SEQ ID NO: 1997 - DNA, 20 bp, Artificial
  CRISPR gRNA sequence
tgtcccggcccggccgcggg

SEQ ID NO: 1998 - DNA, 20 bp, Artificial
  CRISPR gRNA sequence
cggggagccccgcttcatct

SEQ ID NO: 1999 - DNA, 20 bp, Artificial
  CRISPR gRNA sequence
ggagccccgcttcatctcag

SEQ ID NO: 2000 - DNA, 20 bp, Artificial
  CRISPR gRNA sequence
gagccccgcttcatctcagt

SEQ ID NO: 2001 - DNA, 20 bp, Artificial
  CRISPR gRNA sequence
cttcatctcagtgggctacg

SEQ ID NO: 2002 - DNA, 20 bp, Artificial
  CRISPR gRNA sequence
tgggctacgtggacgacacc

SEQ ID NO: 2003 - DNA, 20 bp, Artificial
  CRISPR gRNA sequence
gtggacgacacccagttcgt

SEQ ID NO: 2004 - DNA, 20 bp, Artificial
  CRISPR gRNA sequence
tggacgacacccagttcgtg

SEQ ID NO: 2005 - DNA, 20 bp, Artificial
  CRISPR gRNA sequence
acccagttcgtgaggttcga

SEQ ID NO: 2006 - DNA, 20 bp, Artificial
  CRISPR gRNA sequence
aggttcgacagcgacgccgc

SEQ ID NO: 2007 - DNA, 20 bp, Artificial
  CRISPR gRNA sequence
gacagcgacgccgcgagtcc

SEQ ID NO: 2008 - DNA, 20 bp, Artificial
  CRISPR gRNA sequence
cagcgacgccgcgagtccga

SEQ ID NO: 2009 - DNA, 20 bp, Artificial
  CRISPR gRNA sequence
gcgacgccgcgagtccgaga

SEQ ID NO: 2010 - DNA, 20 bp, Artificial
  CRISPR gRNA sequence
cgacgccgcgagtccgagag

SEQ ID NO: 2011 - DNA, 20 bp, Artificial
  CRISPR gRNA sequence
acgccgcgagtccgagagag

SEQ ID NO: 2012 - DNA, 20 bp, Artificial
  CRISPR gRNA sequence
cgagtccgagagaggagccg

SEQ ID NO: 2013 - DNA, 20 bp, Artificial
  CRISPR gRNA sequence
gagtccgagagaggagccgc

SEQ ID NO: 2014 - DNA, 20 bp, Artificial
  CRISPR gRNA sequence
gagaggagccgcgggcgccg

SEQ ID NO: 2015 - DNA, 20 bp, Artificial
  CRISPR gRNA sequence
ggagccgcgggcgccgtgga

SEQ ID NO: 2016 - DNA, 20 bp, Artificial
  CRISPR gRNA sequence
agccgcgggcgccgtggata

SEQ ID NO: 2017 - DNA, 20 bp, Artificial
  CRISPR gRNA sequence
cgcgggcgccgtggatagag

SEQ ID NO: 2018 - DNA, 20 bp, Artificial
  CRISPR gRNA sequence
gcgggcgccgtggatagagc

SEQ ID NO: 2019 - DNA, 20 bp, Artificial
  CRISPR gRNA sequence
gggcgccgtggatagagcag

SEQ ID NO: 2020 - DNA, 20 bp, Artificial
  CRISPR gRNA sequence
ggcgccgtggatagagcagg

SEQ ID NO: 2021 - DNA, 20 bp, Artificial
  CRISPR gRNA sequence
gcgccgtggatagagcagga

SEQ ID NO: 2022 - DNA, 20 bp, Artificial
  CRISPR gRNA sequence
cgccgtggatagagcaggag

SEQ ID NO: 2023 - DNA, 20 bp, Artificial
  CRISPR gRNA sequence
gtggatagagcaggaggggc

SEQ ID NO: 2024 - DNA, 20 bp, Artificial
  CRISPR gRNA sequence
ggatagagcaggaggggccg

SEQ ID NO: 2025 - DNA, 20 bp, Artificial
  CRISPR gRNA sequence
agcaggaggggccggagtat

SEQ ID NO: 2026 - DNA, 20 bp, Artificial
  CRISPR gRNA sequence
gcaggaggggccggagtatt

SEQ ID NO: 2027 - DNA, 20 bp, Artificial
  CRISPR gRNA sequence
aggggccggagtattgggac

SEQ ID NO: 2028 - DNA, 20 bp, Artificial
  CRISPR gRNA sequence
agtattgggaccggaacaca

SEQ ID NO: 2029 - DNA, 20 bp, Artificial
  CRISPR gRNA sequence
accggaacacacagatctac

SEQ ID NO: 2030 - DNA, 20 bp, Artificial
  CRISPR gRNA sequence
ccggaacacacagatctaca

SEQ ID NO: 2031 - DNA, 20 bp, Artificial
  CRISPR gRNA sequence
acacacagatctacaaggcc

SEQ ID NO: 2032 - DNA, 20 bp, Artificial
  CRISPR gRNA sequence
cacacagatctacaaggccc

SEQ ID NO: 2033 - DNA, 20 bp, Artificial
  CRISPR gRNA sequence
agatctacaaggcccaggca

SEQ ID NO: 2034 - DNA, 20 bp, Artificial
  CRISPR gRNA sequence
ggcccaggcacagactgacc

SEQ ID NO: 2035 - DNA, 20 bp, Artificial
  CRISPR gRNA sequence
cccaggcacagactgaccga

SEQ ID NO: 2036 - DNA, 20 bp, Artificial
  CRISPR gRNA sequence
caggcacagactgaccgaga

SEQ ID NO: 2037 - DNA, 20 bp, Artificial
  CRISPR gRNA sequence
agactgaccgagagagcctg

SEQ ID NO: 2038 - DNA, 20 bp, Artificial
  CRISPR gRNA sequence
gagagcctgcggaacctgcg

SEQ ID NO: 2039 - DNA, 20 bp, Artificial
  CRISPR gRNA sequence
acctgcgcggctactacaac

SEQ ID NO: 2040 - DNA, 20 bp, Artificial
  CRISPR gRNA sequence
ctgcgcggctactacaacca

SEQ ID NO: 2041 - DNA, 20 bp, Artificial
  CRISPR gRNA sequence
gcggctactacaaccagagc

SEQ ID NO: 2042 - DNA, 20 bp, Artificial
  CRISPR gRNA sequence
cggctactacaaccagagcg

SEQ ID NO: 2043 - DNA, 20 bp, Artificial
  CRISPR gRNA sequence
tactacaaccagagcgaggc

SEQ ID NO: 2044 - DNA, 20 bp, Artificial
  CRISPR gRNA sequence
acaaccagagcgaggccggt

SEQ ID NO: 2045 - DNA, 20 bp, Artificial
  CRISPR gRNA sequence
gcgaggccggtgagtgaccc

SEQ ID NO: 2046 - DNA, 20 bp, Artificial
  CRISPR gRNA sequence
gccggtgagtgaccccggcc

SEQ ID NO: 2047 - DNA, 20 bp, Artificial
  CRISPR gRNA sequence
ccggtgagtgaccccggccc

SEQ ID NO: 2048 - DNA, 20 bp, Artificial
  CRISPR gRNA sequence
cggtgagtgaccccggcccg

SEQ ID NO: 2049 - DNA, 20 bp, Artificial
  CRISPR gRNA sequence
agtgaccccggcccggggcg

SEQ ID NO: 2050 - DNA, 20 bp, Artificial
  CRISPR gRNA sequence
gtgaccccggcccggggcgc

SEQ ID NO: 2051 - DNA, 20 bp, Artificial
  CRISPR gRNA sequence
gactccccatcccccacgta

SEQ ID NO: 2052 - DNA, 20 bp, Artificial
  CRISPR gRNA sequence
cccatcccccacgtacggcc

SEQ ID NO: 2053 - DNA, 20 bp, Artificial
  CRISPR gRNA sequence
ccatcccccacgtacggccc

SEQ ID NO: 2054 - DNA, 20 bp, Artificial
  CRISPR gRNA sequence
cgtacggcccgggtcgcccc

SEQ ID NO: 2055 - DNA, 20 bp, Artificial
  CRISPR gRNA sequence
cccgggtcgccccgagtctc

SEQ ID NO: 2056 - DNA, 20 bp, Artificial
  CRISPR gRNA sequence
ccgggtcgccccgagtctcc

SEQ ID NO: 2057 - DNA, 20 bp, Artificial
  CRISPR gRNA sequence
cgccccgagtctccgggtcc

SEQ ID NO: 2058 - DNA, 20 bp, Artificial
  CRISPR gRNA sequence
ggtccgagatccgcctccct

SEQ ID NO: 2059 - DNA, 20 bp, Artificial
  CRISPR gRNA sequence
gtccgagatccgcctccctg

SEQ ID NO: 2060 - DNA, 20 bp, Artificial
  CRISPR gRNA sequence
gatccgcctccctgaggccg

SEQ ID NO: 2061 - DNA, 20 bp, Artificial
  CRISPR gRNA sequence
atccgcctccctgaggccgc

SEQ ID NO: 2062 - DNA, 20 bp, Artificial
  CRISPR gRNA sequence
ctgaggccgcgggacccgcc

SEQ ID NO: 2063 - DNA, 20 bp, Artificial
  CRISPR gRNA sequence
gacccgcccagaccctcgac

SEQ ID NO: 2064 - DNA, 20 bp, Artificial
  CRISPR gRNA sequence
cgcccagaccctcgaccggc

SEQ ID NO: 2065 - DNA, 20 bp, Artificial
  CRISPR gRNA sequence
cccagaccctcgaccggcga

SEQ ID NO: 2066 - DNA, 20 bp, Artificial
  CRISPR gRNA sequence
ccctcgaccggcgagagccc

SEQ ID NO: 2067 - DNA, 20 bp, Artificial
  CRISPR gRNA sequence
cctcgaccggcgagagcccc

SEQ ID NO: 2068 - DNA, 20 bp, Artificial
  CRISPR gRNA sequence
gagccccaggcgcgtttacc

SEQ ID NO: 2069 - DNA, 20 bp, Artificial
  CRISPR gRNA sequence
cgtttacccggtttcatttt

SEQ ID NO: 2070 - DNA, 20 bp, Artificial
  CRISPR gRNA sequence
acccggtttcattttcagtt

SEQ ID NO: 2071 - DNA, 20 bp, Artificial
  CRISPR gRNA sequence
cccggtttcattttcagttg

SEQ ID NO: 2072 - DNA, 20 bp, Artificial
  CRISPR gRNA sequence
agttgaggccaaaatccccg

SEQ ID NO: 2073 - DNA, 20 bp, Artificial
  CRISPR gRNA sequence
gttgaggccaaaatccccgc

SEQ ID NO: 2074 - DNA, 20 bp, Artificial
  CRISPR gRNA sequence
aggccaaaatccccgcgggt

SEQ ID NO: 2075 - DNA, 20 bp, Artificial
  CRISPR gRNA sequence
caaaatccccgcgggttggt

SEQ ID NO: 2076 - DNA, 20 bp, Artificial
  CRISPR gRNA sequence
aaaatccccgcgggttggtc

SEQ ID NO: 2077 - DNA, 20 bp, Artificial
  CRISPR gRNA sequence
aaatccccgcgggttggtcg

SEQ ID NO: 2078 - DNA, 20 bp, Artificial
  CRISPR gRNA sequence
tccccgcgggttggtcgggg

SEQ ID NO: 2079 - DNA, 20 bp, Artificial
  CRISPR gRNA sequence
ccccgcgggttggtcggggc

SEQ ID NO: 2080 - DNA, 20 bp, Artificial
  CRISPR gRNA sequence
cccgcgggttggtcggggcg

SEQ ID NO: 2081 - DNA, 20 bp, Artificial
  CRISPR gRNA sequence
gcgggttggtcggggcgggg

SEQ ID NO: 2082 - DNA, 20 bp, Artificial
  CRISPR gRNA sequence
cgggttggtcggggcggggc

SEQ ID NO: 2083 - DNA, 20 bp, Artificial
  CRISPR gRNA sequence
gggttggtcggggcggggcg

SEQ ID NO: 2084 - DNA, 20 bp, Artificial
  CRISPR gRNA sequence
ggtcggggcggggcggggct

SEQ ID NO: 2085 - DNA, 20 bp, Artificial
  CRISPR gRNA sequence
gtcggggcggggcggggctc

SEQ ID NO: 2086 - DNA, 20 bp, Artificial
  CRISPR gRNA sequence
tcggggcggggcggggctcg

SEQ ID NO: 2087 - DNA, 20 bp, Artificial
  CRISPR gRNA sequence
cggggcggggcggggctcgg

SEQ ID NO: 2088 - DNA, 20 bp, Artificial
  CRISPR gRNA sequence
cggggcggggctcgggggac

SEQ ID NO: 2089 - DNA, 20 bp, Artificial
  CRISPR gRNA sequence
ggggcggggctcgggggact

SEQ ID NO: 2090 - DNA, 20 bp, Artificial
  CRISPR gRNA sequence
tcgggggactgggctgaccg

SEQ ID NO: 2091 - DNA, 20 bp, Artificial
  CRISPR gRNA sequence
cgggggactgggctgaccgc

SEQ ID NO: 2092 - DNA, 20 bp, Artificial
  CRISPR gRNA sequence
gggggactgggctgaccgcg

SEQ ID NO: 2093 - DNA, 20 bp, Artificial
  CRISPR gRNA sequence
gactgggctgaccgcggggc

SEQ ID NO: 2094 - DNA, 20 bp, Artificial
  CRISPR gRNA sequence
actgggctgaccgcggggcc

SEQ ID NO: 2095 - DNA, 20 bp, Artificial
  CRISPR gRNA sequence
ctgggctgaccgcggggccg

SEQ ID NO: 2096 - DNA, 20 bp, Artificial
  CRISPR gRNA sequence
gctgaccgcggggccggggc

SEQ ID NO: 2097 - DNA, 20 bp, Artificial
  CRISPR gRNA sequence
ctgaccgcggggccggggcc

SEQ ID NO: 2098 - DNA, 20 bp, Artificial
  CRISPR gRNA sequence
tgaccgcggggccggggcca

SEQ ID NO: 2099 - DNA, 20 bp, Artificial
  CRISPR gRNA sequence
ggccagggtctcacaccctc

SEQ ID NO: 2100 - DNA, 20 bp, Artificial
  CRISPR gRNA sequence
ccagggtctcacaccctcca

SEQ ID NO: 2101 - DNA, 20 bp, Artificial
  CRISPR gRNA sequence
cacaccctccagagcatgta

SEQ ID NO: 2102 - DNA, 20 bp, Artificial
  CRISPR gRNA sequence
gagcatgtacggctgcgacg

SEQ ID NO: 2103 - DNA, 20 bp, Artificial
  CRISPR gRNA sequence
agcatgtacggctgcgacgt

SEQ ID NO: 2104 - DNA, 20 bp, Artificial
  CRISPR gRNA sequence
gcatgtacggctgcgacgtg

SEQ ID NO: 2105 - DNA, 20 bp, Artificial
  CRISPR gRNA sequence
gtacggctgcgacgtggggc

SEQ ID NO: 2106 - DNA, 20 bp, Artificial
  CRISPR gRNA sequence
ggctgcgacgtggggccgga

SEQ ID NO: 2107 - DNA, 20 bp, Artificial
  CRISPR gRNA sequence
gctgcgacgtggggccggac

SEQ ID NO: 2108 - DNA, 20 bp, Artificial
  CRISPR gRNA sequence
ccggacgggcgcctcctccg

SEQ ID NO: 2109 - DNA, 20 bp, Artificial
  CRISPR gRNA sequence
cggacgggcgcctcctccgc

SEQ ID NO: 2110 - DNA, 20 bp, Artificial
  CRISPR gRNA sequence
gcctcctccgcgggcatgac

SEQ ID NO: 2111 - DNA, 20 bp, Artificial
  CRISPR gRNA sequence
catgaccagtacgcctacga

SEQ ID NO: 2112 - DNA, 20 bp, Artificial
  CRISPR gRNA sequence
accagtacgcctacgacggc

SEQ ID NO: 2113 - DNA, 20 bp, Artificial
  CRISPR gRNA sequence
ccagtacgcctacgacggca

SEQ ID NO: 2114 - DNA, 20 bp, Artificial
  CRISPR gRNA sequence
aggattacatcgccctgaac

SEQ ID NO: 2115 - DNA, 20 bp, Artificial
  CRISPR gRNA sequence
ggattacatcgccctgaacg

SEQ ID NO: 2116 - DNA, 20 bp, Artificial
  CRISPR gRNA sequence
tgaacgaggacctgcgctcc

SEQ ID NO: 2117 - DNA, 20 bp, Artificial
  CRISPR gRNA sequence
cctgcgctcctggaccgccg

SEQ ID NO: 2118 - DNA, 20 bp, Artificial
  CRISPR gRNA sequence
ctcctggaccgccgcggaca

SEQ ID NO: 2119 - DNA, 20 bp, Artificial
  CRISPR gRNA sequence
ctggaccgccgcggacacgg

SEQ ID NO: 2120 - DNA, 20 bp, Artificial
  CRISPR gRNA sequence
ccgccgcggacacggcggct

SEQ ID NO: 2121 - DNA, 20 bp, Artificial
  CRISPR gRNA sequence
acacggcggctcagatcacc

SEQ ID NO: 2122 - DNA, 20 bp, Artificial
  CRISPR gRNA sequence
cggctcagatcacccagcgc

SEQ ID NO: 2123 - DNA, 20 bp, Artificial
  CRISPR gRNA sequence
ctcagatcacccagcgcaag

SEQ ID NO: 2124 - DNA, 20 bp, Artificial
  CRISPR gRNA sequence
tcagatcacccagcgcaagt

SEQ ID NO: 2125 - DNA, 20 bp, Artificial
  CRISPR gRNA sequence
agatcacccagcgcaagtgg

SEQ ID NO: 2126 - DNA, 20 bp, Artificial
  CRISPR gRNA sequence
gatcacccagcgcaagtggg

SEQ ID NO: 2127 - DNA, 20 bp, Artificial
  CRISPR gRNA sequence
cacccagcgcaagtgggagg

SEQ ID NO: 2128 - DNA, 20 bp, Artificial
  CRISPR gRNA sequence
gcaagtgggaggcggcccgt

SEQ ID NO: 2129 - DNA, 20 bp, Artificial
  CRISPR gRNA sequence
caagtgggaggcggcccgtg

SEQ ID NO: 2130 - DNA, 20 bp, Artificial
  CRISPR gRNA sequence
gtgggaggcggcccgtgagg

SEQ ID NO: 2131 - DNA, 20 bp, Artificial
  CRISPR gRNA sequence
gggaggcggcccgtgaggcg

SEQ ID NO: 2132 - DNA, 20 bp, Artificial
  CRISPR gRNA sequence
aggcggcccgtgaggcggag

SEQ ID NO: 2133 - DNA, 20 bp, Artificial
  CRISPR gRNA sequence
cggcccgtgaggcggagcag

SEQ ID NO: 2134 - DNA, 20 bp, Artificial
  CRISPR gRNA sequence
gcccgtgaggcggagcagcg

SEQ ID NO: 2135 - DNA, 20 bp, Artificial
  CRISPR gRNA sequence
ccgtgaggcggagcagcgga

SEQ ID NO: 2136 - DNA, 20 bp, Artificial
  CRISPR gRNA sequence
ggagcagcggagagcctacc

SEQ ID NO: 2137 - DNA, 20 bp, Artificial
  CRISPR gRNA sequence
agcagcggagagcctacctg

SEQ ID NO: 2138 - DNA, 20 bp, Artificial
  CRISPR gRNA sequence
gcagcggagagcctacctgg

SEQ ID NO: 2139 - DNA, 20 bp, Artificial
  CRISPR gRNA sequence
cagcggagagcctacctgga

SEQ ID NO: 2140 - DNA, 20 bp, Artificial
  CRISPR gRNA sequence
ggagagcctacctggagggc

SEQ ID NO: 2141 - DNA, 20 bp, Artificial
  CRISPR gRNA sequence
ctacctggagggcgagtgcg

SEQ ID NO: 2142 - DNA, 20 bp, Artificial
  CRISPR gRNA sequence
acctggagggcgagtgcgtg

SEQ ID NO: 2143 - DNA, 20 bp, Artificial
  CRISPR gRNA sequence
tggagggcgagtgcgtggag

SEQ ID NO: 2144 - DNA, 20 bp, Artificial
  CRISPR gRNA sequence
gagtgcgtggagtggctccg

SEQ ID NO: 2145 - DNA, 20 bp, Artificial
  CRISPR gRNA sequence
ggagtggctccgcagatacc

SEQ ID NO: 2146 - DNA, 20 bp, Artificial
  CRISPR gRNA sequence
agtggctccgcagatacctg

SEQ ID NO: 2147 - DNA, 20 bp, Artificial
  CRISPR gRNA sequence
ctccgcagatacctggagaa

SEQ ID NO: 2148 - DNA, 20 bp, Artificial
  CRISPR gRNA sequence
tccgcagatacctggagaac

SEQ ID NO: 2149 - DNA, 20 bp, Artificial
  CRISPR gRNA sequence
gcagatacctggagaacggg

SEQ ID NO: 2150 - DNA, 20 bp, Artificial
  CRISPR gRNA sequence
cagatacctggagaacggga

SEQ ID NO: 2151 - DNA, 20 bp, Artificial
  CRISPR gRNA sequence
acctggagaacgggaaggac

SEQ ID NO: 2152 - DNA, 20 bp, Artificial
  CRISPR gRNA sequence
ggagaacgggaaggacaagc

SEQ ID NO: 2153 - DNA, 20 bp, Artificial
  CRISPR gRNA sequence
agaacgggaaggacaagctg

SEQ ID NO: 2154 - DNA, 20 bp, Artificial
  CRISPR gRNA sequence
aaggacaagctggagcgcgc

SEQ ID NO: 2155 - DNA, 20 bp, Artificial
  CRISPR gRNA sequence
aagctggagcgcgctggtac

SEQ ID NO: 2156 - DNA, 20 bp, Artificial
  CRISPR gRNA sequence
agctggagcgcgctggtacc

SEQ ID NO: 2157 - DNA, 20 bp, Artificial
  CRISPR gRNA sequence
gctggagcgcgctggtacca

SEQ ID NO: 2158 - DNA, 20 bp, Artificial
  CRISPR gRNA sequence
ctggagcgcgctggtaccag

SEQ ID NO: 2159 - DNA, 20 bp, Artificial
  CRISPR gRNA sequence
gagcgcgctggtaccagggg

SEQ ID NO: 2160 - DNA, 20 bp, Artificial
  CRISPR gRNA sequence
cgcgctggtaccaggggcag

SEQ ID NO: 2161 - DNA, 20 bp, Artificial
  CRISPR gRNA sequence
gcgctggtaccaggggcagt

SEQ ID NO: 2162 - DNA, 20 bp, Artificial
  CRISPR gRNA sequence
cgctggtaccaggggcagtg

SEQ ID NO: 2163 - DNA, 20 bp, Artificial
  CRISPR gRNA sequence
ctggtaccaggggcagtggg

SEQ ID NO: 2164 - DNA, 20 bp, Artificial
  CRISPR gRNA sequence
ggagccttccccatctccta

SEQ ID NO: 2165 - DNA, 20 bp, Artificial
  CRISPR gRNA sequence
gagccttccccatctcctat

SEQ ID NO: 2166 - DNA, 20 bp, Artificial
  CRISPR gRNA sequence
ccccatctcctataggtcgc

SEQ ID NO: 2167 - DNA, 20 bp, Artificial
  CRISPR gRNA sequence
cccatctcctataggtcgcc

SEQ ID NO: 2168 - DNA, 20 bp, Artificial
  CRISPR gRNA sequence
ccatctcctataggtcgccg

SEQ ID NO: 2169 - DNA, 20 bp, Artificial
  CRISPR gRNA sequence
ctcctataggtcgccgggga

SEQ ID NO: 2170 - DNA, 20 bp, Artificial
  CRISPR gRNA sequence
cgccggggatggcctcccac

SEQ ID NO: 2171 - DNA, 20 bp, Artificial
  CRISPR gRNA sequence
cggggatggcctcccacgag

SEQ ID NO: 2172 - DNA, 20 bp, Artificial
  CRISPR gRNA sequence
gggatggcctcccacgagaa

SEQ ID NO: 2173 - DNA, 20 bp, Artificial
  CRISPR gRNA sequence
ggatggcctcccacgagaag

SEQ ID NO: 2174 - DNA, 20 bp, Artificial
  CRISPR gRNA sequence
atggcctcccacgagaagag

SEQ ID NO: 2175 - DNA, 20 bp, Artificial
  CRISPR gRNA sequence
tggcctcccacgagaagagg

SEQ ID NO: 2176 - DNA, 20 bp, Artificial
  CRISPR gRNA sequence
ccacgagaagaggaggaaaa

SEQ ID NO: 2177 - DNA, 20 bp, Artificial
  CRISPR gRNA sequence
cacgagaagaggaggaaaat

SEQ ID NO: 2178 - DNA, 20 bp, Artificial
  CRISPR gRNA sequence
gaagaggaggaaaatgggat

SEQ ID NO: 2179 - DNA, 20 bp, Artificial
  CRISPR gRNA sequence
gaggaaaatgggatcagcgc

SEQ ID NO: 2180 - DNA, 20 bp, Artificial
  CRISPR gRNA sequence
gaatgtcgccctccgttgaa

SEQ ID NO: 2181 - DNA, 20 bp, Artificial
  CRISPR gRNA sequence
atgtcgccctccgttgaatg

SEQ ID NO: 2182 - DNA, 20 bp, Artificial
  CRISPR gRNA sequence
gccctccgttgaatggagaa

SEQ ID NO: 2183 - DNA, 20 bp, Artificial
  CRISPR gRNA sequence
cgttgaatggagaatggcat

SEQ ID NO: 2184 - DNA, 20 bp, Artificial
  CRISPR gRNA sequence
agaatggcatgagttttcct

SEQ ID NO: 2185 - DNA, 20 bp, Artificial
  CRISPR gRNA sequence
agttttcctgagtttcctct

SEQ ID NO: 2186 - DNA, 20 bp, Artificial
  CRISPR gRNA sequence
gttttcctgagtttcctctg

SEQ ID NO: 2187 - DNA, 20 bp, Artificial
  CRISPR gRNA sequence
ttttcctgagtttcctctga

SEQ ID NO: 2188 - DNA, 20 bp, Artificial
  CRISPR gRNA sequence
tgagggccccctcttctctc

SEQ ID NO: 2189 - DNA, 20 bp, Artificial
  CRISPR gRNA sequence
cctcttctctctagacaatt

SEQ ID NO: 2190 - DNA, 20 bp, Artificial
  CRISPR gRNA sequence
ctcttctctctagacaatta

SEQ ID NO: 2191 - DNA, 20 bp, Artificial
  CRISPR gRNA sequence
aattaaggaatgacgtctct

SEQ ID NO: 2192 - DNA, 20 bp, Artificial
  CRISPR gRNA sequence
attaaggaatgacgtctctg

SEQ ID NO: 2193 - DNA, 20 bp, Artificial
  CRISPR gRNA sequence
gaatgacgtctctgaggaaa

SEQ ID NO: 2194 - DNA, 20 bp, Artificial
  CRISPR gRNA sequence
atgacgtctctgaggaaatg

SEQ ID NO: 2195 - DNA, 20 bp, Artificial
  CRISPR gRNA sequence
tgacgtctctgaggaaatgg

SEQ ID NO: 2196 - DNA, 20 bp, Artificial
  CRISPR gRNA sequence
gacgtctctgaggaaatgga

SEQ ID NO: 2197 - DNA, 20 bp, Artificial
  CRISPR gRNA sequence
acgtctctgaggaaatggag

SEQ ID NO: 2198 - DNA, 20 bp, Artificial
  CRISPR gRNA sequence
tctctgaggaaatggagggg

SEQ ID NO: 2199 - DNA, 20 bp, Artificial
  CRISPR gRNA sequence
tgaggaaatggaggggaaga

SEQ ID NO: 2200 - DNA, 20 bp, Artificial
  CRISPR gRNA sequence
atggaggggaagacagtccc

SEQ ID NO: 2201 - DNA, 20 bp, Artificial
  CRISPR gRNA sequence
acagtccctagaatactgat

SEQ ID NO: 2202 - DNA, 20 bp, Artificial
  CRISPR gRNA sequence
cagtccctagaatactgatc

SEQ ID NO: 2203 - DNA, 20 bp, Artificial
  CRISPR gRNA sequence
agtccctagaatactgatca

SEQ ID NO: 2204 - DNA, 20 bp, Artificial
  CRISPR gRNA sequence
gtccctagaatactgatcag

SEQ ID NO: 2205 - DNA, 20 bp, Artificial
  CRISPR gRNA sequence
ggggtcccctttgacccctg

SEQ ID NO: 2206 - DNA, 20 bp, Artificial
  CRISPR gRNA sequence
gtcccctttgacccctgcag

SEQ ID NO: 2207 - DNA, 20 bp, Artificial
  CRISPR gRNA sequence
tttgacccctgcagcagcct

SEQ ID NO: 2208 - DNA, 20 bp, Artificial
  CRISPR gRNA sequence
ttgacccctgcagcagcctt

SEQ ID NO: 2209 - DNA, 20 bp, Artificial
  CRISPR gRNA sequence
ggaaccgtgacttttcctct

SEQ ID NO: 2210 - DNA, 20 bp, Artificial
  CRISPR gRNA sequence
gaaccgtgacttttcctctc

SEQ ID NO: 2211 - DNA, 20 bp, Artificial
  CRISPR gRNA sequence
cttgttctctgcctcacact

SEQ ID NO: 2212 - DNA, 20 bp, Artificial
  CRISPR gRNA sequence
tgcctcacactcagtgtgtt

SEQ ID NO: 2213 - DNA, 20 bp, Artificial
  CRISPR gRNA sequence
gcctcacactcagtgtgttt

SEQ ID NO: 2214 - DNA, 20 bp, Artificial
  CRISPR gRNA sequence
cctcacactcagtgtgtttg

SEQ ID NO: 2215 - DNA, 20 bp, Artificial
  CRISPR gRNA sequence
tgtgtttggggctctgattc

SEQ ID NO: 2216 - DNA, 20 bp, Artificial
  CRISPR gRNA sequence
gctctgattccagcacttct

SEQ ID NO: 2217 - DNA, 20 bp, Artificial
  CRISPR gRNA sequence
tgagtcactttacctccact

SEQ ID NO: 2218 - DNA, 20 bp, Artificial
  CRISPR gRNA sequence
cactttacctccactcagat

SEQ ID NO: 2219 - DNA, 20 bp, Artificial
  CRISPR gRNA sequence
actttacctccactcagatc

SEQ ID NO: 2220 - DNA, 20 bp, Artificial
  CRISPR gRNA sequence
tttacctccactcagatcag

SEQ ID NO: 2221 - DNA, 20 bp, Artificial
  CRISPR gRNA sequence
acctccactcagatcaggag

SEQ ID NO: 2222 - DNA, 20 bp, Artificial
  CRISPR gRNA sequence
tccactcagatcaggagcag

SEQ ID NO: 2223 - DNA, 20 bp, Artificial
  CRISPR gRNA sequence
agaagtccctgttccccgct

SEQ ID NO: 2224 - DNA, 20 bp, Artificial
  CRISPR gRNA sequence
aagtccctgttccccgctca

SEQ ID NO: 2225 - DNA, 20 bp, Artificial
  CRISPR gRNA sequence
gactcgaactttccaatgaa

SEQ ID NO: 2226 - DNA, 20 bp, Artificial
  CRISPR gRNA sequence
actcgaactttccaatgaat

SEQ ID NO: 2227 - DNA, 20 bp, Artificial
  CRISPR gRNA sequence
tcgaactttccaatgaatag

SEQ ID NO: 2228 - DNA, 20 bp, Artificial
  CRISPR gRNA sequence
caatgaataggagattatcc

SEQ ID NO: 2229 - DNA, 20 bp, Artificial
  CRISPR gRNA sequence
aatgaataggagattatccc

SEQ ID NO: 2230 - DNA, 20 bp, Artificial
  CRISPR gRNA sequence
ttatcccaggtgcctgcgtc

SEQ ID NO: 2231 - DNA, 20 bp, Artificial
  CRISPR gRNA sequence
tatcccaggtgcctgcgtcc

SEQ ID NO: 2232 - DNA, 20 bp, Artificial
  CRISPR gRNA sequence
ccaggtgcctgcgtccaggc

SEQ ID NO: 2233 - DNA, 20 bp, Artificial
  CRISPR gRNA sequence
cctgcgtccaggctggtgtc

SEQ ID NO: 2234 - DNA, 20 bp, Artificial
  CRISPR gRNA sequence
ctgcgtccaggctggtgtct

SEQ ID NO: 2235 - DNA, 20 bp, Artificial
  CRISPR gRNA sequence
tctgtgccccttccccaccc

SEQ ID NO: 2236 - DNA, 20 bp, Artificial
  CRISPR gRNA sequence
ctgtgccccttccccacccc

SEQ ID NO: 2237 - DNA, 20 bp, Artificial
  CRISPR gRNA sequence
ccaggtgtcctgtccattct

SEQ ID NO: 2238 - DNA, 20 bp, Artificial
  CRISPR gRNA sequence
caggtgtcctgtccattctc

SEQ ID NO: 2239 - DNA, 20 bp, Artificial
  CRISPR gRNA sequence
tgtcctgtccattctcaggc

SEQ ID NO: 2240 - DNA, 20 bp, Artificial
  CRISPR gRNA sequence
ccattctcaggctggtcaca

SEQ ID NO: 2241 - DNA, 20 bp, Artificial
  CRISPR gRNA sequence
cattctcaggctggtcacat

SEQ ID NO: 2242 - DNA, 20 bp, Artificial
  CRISPR gRNA sequence
tctcaggctggtcacatggg

SEQ ID NO: 2243 - DNA, 20 bp, Artificial
  CRISPR gRNA sequence
gctggtcacatgggtggtcc

SEQ ID NO: 2244 - DNA, 20 bp, Artificial
  CRISPR gRNA sequence
ctggtcacatgggtggtcct

SEQ ID NO: 2245 - DNA, 20 bp, Artificial
  CRISPR gRNA sequence
tggtcacatgggtggtccta

SEQ ID NO: 2246 - DNA, 20 bp, Artificial
  CRISPR gRNA sequence
ggtcctagggtgtcccatga

SEQ ID NO: 2247 - DNA, 20 bp, Artificial
  CRISPR gRNA sequence
ggtgtcccatgaaagatgca

SEQ ID NO: 2248 - DNA, 20 bp, Artificial
  CRISPR gRNA sequence
aattttctgactcttcccat

SEQ ID NO: 2249 - DNA, 20 bp, Artificial
  CRISPR gRNA sequence
tcttcccatcagacccccca

SEQ ID NO: 2250 - DNA, 20 bp, Artificial
  CRISPR gRNA sequence
accaccccatctctgaccat

SEQ ID NO: 2251 - DNA, 20 bp, Artificial
  CRISPR gRNA sequence
ccaccccatctctgaccatg

SEQ ID NO: 2252 - DNA, 20 bp, Artificial
  CRISPR gRNA sequence
tctgaccatgaggccaccct

SEQ ID NO: 2253 - DNA, 20 bp, Artificial
  CRISPR gRNA sequence
ctgaccatgaggccaccctg

SEQ ID NO: 2254 - DNA, 20 bp, Artificial
  CRISPR gRNA sequence
atgaggccaccctgaggtgc

SEQ ID NO: 2255 - DNA, 20 bp, Artificial
  CRISPR gRNA sequence
tgaggccaccctgaggtgct

SEQ ID NO: 2256 - DNA, 20 bp, Artificial
  CRISPR gRNA sequence
caccctgaggtgctgggccc

SEQ ID NO: 2257 - DNA, 20 bp, Artificial
  CRISPR gRNA sequence
accctgaggtgctgggccct

SEQ ID NO: 2258 - DNA, 20 bp, Artificial
  CRISPR gRNA sequence
ggccctgggtttctaccctg

SEQ ID NO: 2259 - DNA, 20 bp, Artificial
  CRISPR gRNA sequence
ccctgggtttctaccctgcg

SEQ ID NO: 2260 - DNA, 20 bp, Artificial
  CRISPR gRNA sequence
ctgcggagatcacactgacc

SEQ ID NO: 2261 - DNA, 20 bp, Artificial
  CRISPR gRNA sequence
cggagatcacactgacctgg

SEQ ID NO: 2262 - DNA, 20 bp, Artificial
  CRISPR gRNA sequence
agatcacactgacctggcag

SEQ ID NO: 2263 - DNA, 20 bp, Artificial
  CRISPR gRNA sequence
gatcacactgacctggcagc

SEQ ID NO: 2264 - DNA, 20 bp, Artificial
  CRISPR gRNA sequence
acactgacctggcagcggga

SEQ ID NO: 2265 - DNA, 20 bp, Artificial
  CRISPR gRNA sequence
tgacctggcagcgggatggc

SEQ ID NO: 2266 - DNA, 20 bp, Artificial
  CRISPR gRNA sequence
gacctggcagcgggatggcg

SEQ ID NO: 2267 - DNA, 20 bp, Artificial
  CRISPR gRNA sequence
gggatggcgaggaccaaact

SEQ ID NO: 2268 - DNA, 20 bp, Artificial
  CRISPR gRNA sequence
ggatggcgaggaccaaactc

SEQ ID NO: 2269 - DNA, 20 bp, Artificial
  CRISPR gRNA sequence
aggaccaaactcaggacact

SEQ ID NO: 2270 - DNA, 20 bp, Artificial
  CRISPR gRNA sequence
aactcaggacactgagcttg

SEQ ID NO: 2271 - DNA, 20 bp, Artificial
  CRISPR gRNA sequence
ctcaggacactgagcttgtg

SEQ ID NO: 2272 - DNA, 20 bp, Artificial
  CRISPR gRNA sequence
gacactgagcttgtggagac

SEQ ID NO: 2273 - DNA, 20 bp, Artificial
  CRISPR gRNA sequence
tgagcttgtggagaccagac

SEQ ID NO: 2274 - DNA, 20 bp, Artificial
  CRISPR gRNA sequence
gcttgtggagaccagaccag

SEQ ID NO: 2275 - DNA, 20 bp, Artificial
  CRISPR gRNA sequence
cttgtggagaccagaccagc

SEQ ID NO: 2276 - DNA, 20 bp, Artificial
  CRISPR gRNA sequence
tgtggagaccagaccagcag

SEQ ID NO: 2277 - DNA, 20 bp, Artificial
  CRISPR gRNA sequence
gagaccagaccagcaggaga

SEQ ID NO: 2278 - DNA, 20 bp, Artificial
  CRISPR gRNA sequence
cagcaggagatagaaccttc

SEQ ID NO: 2279 - DNA, 20 bp, Artificial
  CRISPR gRNA sequence
caggagatagaaccttccag

SEQ ID NO: 2280 - DNA, 20 bp, Artificial
  CRISPR gRNA sequence
gagatagaaccttccagaag

SEQ ID NO: 2281 - DNA, 20 bp, Artificial
  CRISPR gRNA sequence
agatagaaccttccagaagt

SEQ ID NO: 2282 - DNA, 20 bp, Artificial
  CRISPR gRNA sequence
tagaaccttccagaagtggg

SEQ ID NO: 2283 - DNA, 20 bp, Artificial
  CRISPR gRNA sequence
cttccagaagtgggcagctg

SEQ ID NO: 2284 - DNA, 20 bp, Artificial
  CRISPR gRNA sequence
ccagaagtgggcagctgtgg

SEQ ID NO: 2285 - DNA, 20 bp, Artificial
  CRISPR gRNA sequence
gcagctgtggtggtgccttc

SEQ ID NO: 2286 - DNA, 20 bp, Artificial
  CRISPR gRNA sequence
agctgtggtggtgccttctg

SEQ ID NO: 2287 - DNA, 20 bp, Artificial
  CRISPR gRNA sequence
tgtggtggtgccttctggag

SEQ ID NO: 2288 - DNA, 20 bp, Artificial
  CRISPR gRNA sequence
tggtggtgccttctggagaa

SEQ ID NO: 2289 - DNA, 20 bp, Artificial
  CRISPR gRNA sequence
tggtgccttctggagaagag

SEQ ID NO: 2290 - DNA, 20 bp, Artificial
  CRISPR gRNA sequence
gtgccttctggagaagagca

SEQ ID NO: 2291 - DNA, 20 bp, Artificial
  CRISPR gRNA sequence
agagatacacatgccatgta

SEQ ID NO: 2292 - DNA, 20 bp, Artificial
  CRISPR gRNA sequence
acacatgccatgtacagcat

SEQ ID NO: 2293 - DNA, 20 bp, Artificial
  CRISPR gRNA sequence
cacatgccatgtacagcatg

SEQ ID NO: 2294 - DNA, 20 bp, Artificial
  CRISPR gRNA sequence
acatgccatgtacagcatga

SEQ ID NO: 2295 - DNA, 20 bp, Artificial
  CRISPR gRNA sequence
catgccatgtacagcatgag

SEQ ID NO: 2296 - DNA, 20 bp, Artificial
  CRISPR gRNA sequence
tacagcatgaggggctgccg

SEQ ID NO: 2297 - DNA, 20 bp, Artificial
  CRISPR gRNA sequence
ctgccgaagcccctcaccct

SEQ ID NO: 2298 - DNA, 20 bp, Artificial
  CRISPR gRNA sequence
cgaagcccctcaccctgaga

SEQ ID NO: 2299 - DNA, 20 bp, Artificial
  CRISPR gRNA sequence
gaagcccctcaccctgagat

SEQ ID NO: 2300 - DNA, 20 bp, Artificial
  CRISPR gRNA sequence
aagcccctcaccctgagatg

SEQ ID NO: 2301 - DNA, 20 bp, Artificial
  CRISPR gRNA sequence
ccctcaccctgagatggggt

SEQ ID NO: 2302 - DNA, 20 bp, Artificial
  CRISPR gRNA sequence
cctcaccctgagatggggta

SEQ ID NO: 2303 - DNA, 20 bp, Artificial
  CRISPR gRNA sequence
tcaccctgagatggggtaag

SEQ ID NO: 2304 - DNA, 20 bp, Artificial
  CRISPR gRNA sequence
caccctgagatggggtaagg

SEQ ID NO: 2305 - DNA, 20 bp, Artificial
  CRISPR gRNA sequence
accctgagatggggtaagga

SEQ ID NO: 2306 - DNA, 20 bp, Artificial
  CRISPR gRNA sequence
ccctgagatggggtaaggag

SEQ ID NO: 2307 - DNA, 20 bp, Artificial
  CRISPR gRNA sequence
cctgagatggggtaaggagg

SEQ ID NO: 2308 - DNA, 20 bp, Artificial
  CRISPR gRNA sequence
gatggggtaaggagggggat

SEQ ID NO: 2309 - DNA, 20 bp, Artificial
  CRISPR gRNA sequence
atggggtaaggagggggatg

SEQ ID NO: 2310 - DNA, 20 bp, Artificial
  CRISPR gRNA sequence
tggggtaaggagggggatga

SEQ ID NO: 2311 - DNA, 20 bp, Artificial
  CRISPR gRNA sequence
ggggtaaggagggggatgag

SEQ ID NO: 2312 - DNA, 20 bp, Artificial
  CRISPR gRNA sequence
tgaggggtcatatctcttct

SEQ ID NO: 2313 - DNA, 20 bp, Artificial
  CRISPR gRNA sequence
gaggggtcatatctcttctc

SEQ ID NO: 2314 - DNA, 20 bp, Artificial
  CRISPR gRNA sequence
aggggtcatatctcttctca

SEQ ID NO: 2315 - DNA, 20 bp, Artificial
  CRISPR gRNA sequence
gtcatatctcttctcaggga

SEQ ID NO: 2316 - DNA, 20 bp, Artificial
  CRISPR gRNA sequence
atatctcttctcagggaaag

SEQ ID NO: 2317 - DNA, 20 bp, Artificial
  CRISPR gRNA sequence
tatctcttctcagggaaagc

SEQ ID NO: 2318 - DNA, 20 bp, Artificial
  CRISPR gRNA sequence
tctcttctcagggaaagcag

SEQ ID NO: 2319 - DNA, 20 bp, Artificial
  CRISPR gRNA sequence
cagggaaagcaggagccctt

SEQ ID NO: 2320 - DNA, 20 bp, Artificial
  CRISPR gRNA sequence
ggaaagcaggagcccttcag

SEQ ID NO: 2321 - DNA, 20 bp, Artificial
  CRISPR gRNA sequence
gaaagcaggagcccttcagc

SEQ ID NO: 2322 - DNA, 20 bp, Artificial
  CRISPR gRNA sequence
aaagcaggagcccttcagca

SEQ ID NO: 2323 - DNA, 20 bp, Artificial
  CRISPR gRNA sequence
caggagcccttcagcagggt

SEQ ID NO: 2324 - DNA, 20 bp, Artificial
  CRISPR gRNA sequence
aggagcccttcagcagggtc

SEQ ID NO: 2325 - DNA, 20 bp, Artificial
  CRISPR gRNA sequence
ggagcccttcagcagggtca

SEQ ID NO: 2326 - DNA, 20 bp, Artificial
  CRISPR gRNA sequence
ctcatcttcccctcctttcc

SEQ ID NO: 2327 - DNA, 20 bp, Artificial
  CRISPR gRNA sequence
catcttcccctcctttccca

SEQ ID NO: 2328 - DNA, 20 bp, Artificial
  CRISPR gRNA sequence
ctttcccagagccgtcttcc

SEQ ID NO: 2329 - DNA, 20 bp, Artificial
  CRISPR gRNA sequence
ccagtccaccgtccccatcg

SEQ ID NO: 2330 - DNA, 20 bp, Artificial
  CRISPR gRNA sequence
cagtccaccgtccccatcgt

SEQ ID NO: 2331 - DNA, 20 bp, Artificial
  CRISPR gRNA sequence
cccatcgtgggcattgttgc

SEQ ID NO: 2332 - DNA, 20 bp, Artificial
  CRISPR gRNA sequence
cgtgggcattgttgctggcc

SEQ ID NO: 2333 - DNA, 20 bp, Artificial
  CRISPR gRNA sequence
tgttgctggcctggctgtcc

SEQ ID NO: 2334 - DNA, 20 bp, Artificial
  CRISPR gRNA sequence
tgctggcctggctgtcctag

SEQ ID NO: 2335 - DNA, 20 bp, Artificial
  CRISPR gRNA sequence
cctggctgtcctagcagttg

SEQ ID NO: 2336 - DNA, 20 bp, Artificial
  CRISPR gRNA sequence
gtcctagcagttgtggtcat

SEQ ID NO: 2337 - DNA, 20 bp, Artificial
  CRISPR gRNA sequence
cctagcagttgtggtcatcg

SEQ ID NO: 2338 - DNA, 20 bp, Artificial
  CRISPR gRNA sequence
agttgtggtcatcggagctg

SEQ ID NO: 2339 - DNA, 20 bp, Artificial
  CRISPR gRNA sequence
gtggtcgctgctgtgatgtg

SEQ ID NO: 2340 - DNA, 20 bp, Artificial
  CRISPR gRNA sequence
tggtcgctgctgtgatgtgt

SEQ ID NO: 2341 - DNA, 20 bp, Artificial
  CRISPR gRNA sequence
gtcgctgctgtgatgtgtag

SEQ ID NO: 2342 - DNA, 20 bp, Artificial
  CRISPR gRNA sequence
tcgctgctgtgatgtgtagg

SEQ ID NO: 2343 - DNA, 20 bp, Artificial
  CRISPR gRNA sequence
ctgctgtgatgtgtaggagg

SEQ ID NO: 2344 - DNA, 20 bp, Artificial
  CRISPR gRNA sequence
gctgtgatgtgtaggaggaa

SEQ ID NO: 2345 - DNA, 20 bp, Artificial
  CRISPR gRNA sequence
gatgtgtaggaggaagagtt

SEQ ID NO: 2346 - DNA, 20 bp, Artificial
  CRISPR gRNA sequence
atgtgtaggaggaagagttc

SEQ ID NO: 2347 - DNA, 20 bp, Artificial
  CRISPR gRNA sequence
tgtaggaggaagagttcagg

SEQ ID NO: 2348 - DNA, 20 bp, Artificial
  CRISPR gRNA sequence
gtaggaggaagagttcaggt

SEQ ID NO: 2349 - DNA, 20 bp, Artificial
  CRISPR gRNA sequence
taggaggaagagttcaggta

SEQ ID NO: 2350 - DNA, 20 bp, Artificial
  CRISPR gRNA sequence
gaggaagagttcaggtaggg

SEQ ID NO: 2351 - DNA, 20 bp, Artificial
  CRISPR gRNA sequence
aggaagagttcaggtaggga

SEQ ID NO: 2352 - DNA, 20 bp, Artificial
  CRISPR gRNA sequence
ggaagagttcaggtagggaa

SEQ ID NO: 2353 - DNA, 20 bp, Artificial
  CRISPR gRNA sequence
gaagagttcaggtagggaag

SEQ ID NO: 2354 - DNA, 20 bp, Artificial
  CRISPR gRNA sequence
agttcaggtagggaaggggt

SEQ ID NO: 2355 - DNA, 20 bp, Artificial
  CRISPR gRNA sequence
gttcaggtagggaaggggtg

SEQ ID NO: 2356 - DNA, 20 bp, Artificial
  CRISPR gRNA sequence
ttcaggtagggaaggggtga

SEQ ID NO: 2357 - DNA, 20 bp, Artificial
  CRISPR gRNA sequence
tcaggtagggaaggggtgag

SEQ ID NO: 2358 - DNA, 20 bp, Artificial
  CRISPR gRNA sequence
ggtagggaaggggtgagggg

SEQ ID NO: 2359 - DNA, 20 bp, Artificial
  CRISPR gRNA sequence
gtagggaaggggtgaggggt

SEQ ID NO: 2360 - DNA, 20 bp, Artificial
  CRISPR gRNA sequence
tagggaaggggtgaggggtg

SEQ ID NO: 2361 - DNA, 20 bp, Artificial
  CRISPR gRNA sequence
aaggggtgaggggtggggtc

SEQ ID NO: 2362 - DNA, 20 bp, Artificial
  CRISPR gRNA sequence
aggggtgaggggtggggtct

SEQ ID NO: 2363 - DNA, 20 bp, Artificial
  CRISPR gRNA sequence
tctgggttttcttgtcccac

SEQ ID NO: 2364 - DNA, 20 bp, Artificial
  CRISPR gRNA sequence
ctgggttttcttgtcccact

SEQ ID NO: 2365 - DNA, 20 bp, Artificial
  CRISPR gRNA sequence
tgggttttcttgtcccactg

SEQ ID NO: 2366 - DNA, 20 bp, Artificial
  CRISPR gRNA sequence
gggttttcttgtcccactgg

SEQ ID NO: 2367 - DNA, 20 bp, Artificial
  CRISPR gRNA sequence
cttgtcccactgggggtttc

SEQ ID NO: 2368 - DNA, 20 bp, Artificial
  CRISPR gRNA sequence
ccactgggggtttcaagccc

SEQ ID NO: 2369 - DNA, 20 bp, Artificial
  CRISPR gRNA sequence
cactgggggtttcaagcccc

SEQ ID NO: 2370 - DNA, 20 bp, Artificial
  CRISPR gRNA sequence
tgggggtttcaagccccagg

SEQ ID NO: 2371 - DNA, 20 bp, Artificial
  CRISPR gRNA sequence
gggtttcaagccccaggtag

SEQ ID NO: 2372 - DNA, 20 bp, Artificial
  CRISPR gRNA sequence
agtgttccctgcctcattac

SEQ ID NO: 2373 - DNA, 20 bp, Artificial
  CRISPR gRNA sequence
gtgttccctgcctcattact

SEQ ID NO: 2374 - DNA, 20 bp, Artificial
  CRISPR gRNA sequence
ttccctgcctcattactggg

SEQ ID NO: 2375 - DNA, 20 bp, Artificial
  CRISPR gRNA sequence
cctgcctcattactgggaag

SEQ ID NO: 2376 - DNA, 20 bp, Artificial
  CRISPR gRNA sequence
actgggaagcagcatgcaca

SEQ ID NO: 2377 - DNA, 20 bp, Artificial
  CRISPR gRNA sequence
ctgggaagcagcatgcacac

SEQ ID NO: 2378 - DNA, 20 bp, Artificial
  CRISPR gRNA sequence
tgggaagcagcatgcacaca

SEQ ID NO: 2379 - DNA, 20 bp, Artificial
  CRISPR gRNA sequence
gggaagcagcatgcacacag

SEQ ID NO: 2380 - DNA, 20 bp, Artificial
  CRISPR gRNA sequence
catgcacacaggggctaacg

SEQ ID NO: 2381 - DNA, 20 bp, Artificial
  CRISPR gRNA sequence
acacaggggctaacgcagcc

SEQ ID NO: 2382 - DNA, 20 bp, Artificial
  CRISPR gRNA sequence
cacaggggctaacgcagcct

SEQ ID NO: 2383 - DNA, 20 bp, Artificial
  CRISPR gRNA sequence
cagcctgggaccctgtgtgc

SEQ ID NO: 2384 - DNA, 20 bp, Artificial
  CRISPR gRNA sequence
ccagcacttactcttttgtg

SEQ ID NO: 2385 - DNA, 20 bp, Artificial
  CRISPR gRNA sequence
gtgcagcacatgtgacaatg

SEQ ID NO: 2386 - DNA, 20 bp, Artificial
  CRISPR gRNA sequence
tgcagcacatgtgacaatga

SEQ ID NO: 2387 - DNA, 20 bp, Artificial
  CRISPR gRNA sequence
gcacatgtgacaatgaagga

SEQ ID NO: 2388 - DNA, 20 bp, Artificial
  CRISPR gRNA sequence
ggatggatgtatcaccttga

SEQ ID NO: 2389 - DNA, 20 bp, Artificial
  CRISPR gRNA sequence
atgtatcaccttgatggttg

SEQ ID NO: 2390 - DNA, 20 bp, Artificial
  CRISPR gRNA sequence
caccttgatggttgtggtgt

SEQ ID NO: 2391 - DNA, 20 bp, Artificial
  CRISPR gRNA sequence
accttgatggttgtggtgtt

SEQ ID NO: 2392 - DNA, 20 bp, Artificial
  CRISPR gRNA sequence
ccttgatggttgtggtgttg

SEQ ID NO: 2393 - DNA, 20 bp, Artificial
  CRISPR gRNA sequence
tggtgttggggtcctgattc

SEQ ID NO: 2394 - DNA, 20 bp, Artificial
  CRISPR gRNA sequence
gtcctgattccagcattcat

SEQ ID NO: 2395 - DNA, 20 bp, Artificial
  CRISPR gRNA sequence
tgattccagcattcatgagt

SEQ ID NO: 2396 - DNA, 20 bp, Artificial
  CRISPR gRNA sequence
gattccagcattcatgagtc

SEQ ID NO: 2397 - DNA, 20 bp, Artificial
  CRISPR gRNA sequence
attccagcattcatgagtca

SEQ ID NO: 2398 - DNA, 20 bp, Artificial
  CRISPR gRNA sequence
ttccagcattcatgagtcag

SEQ ID NO: 2399 - DNA, 20 bp, Artificial
  CRISPR gRNA sequence
cagcattcatgagtcagggg

SEQ ID NO: 2400 - DNA, 20 bp, Artificial
  CRISPR gRNA sequence
agcattcatgagtcagggga

SEQ ID NO: 2401 - DNA, 20 bp, Artificial
  CRISPR gRNA sequence
gtcaggggaaggtccctgct

SEQ ID NO: 2402 - DNA, 20 bp, Artificial
  CRISPR gRNA sequence
tcaggggaaggtccctgcta

SEQ ID NO: 2403 - DNA, 20 bp, Artificial
  CRISPR gRNA sequence
gggaaggtccctgctaagga

SEQ ID NO: 2404 - DNA, 20 bp, Artificial
  CRISPR gRNA sequence
tccctgctaaggacagacct

SEQ ID NO: 2405 - DNA, 20 bp, Artificial
  CRISPR gRNA sequence
ccctgctaaggacagacctt

SEQ ID NO: 2406 - DNA, 20 bp, Artificial
  CRISPR gRNA sequence
ctgctaaggacagaccttag

SEQ ID NO: 2407 - DNA, 20 bp, Artificial
  CRISPR gRNA sequence
tgctaaggacagaccttagg

SEQ ID NO: 2408 - DNA, 20 bp, Artificial
  CRISPR gRNA sequence
gctaaggacagaccttagga

SEQ ID NO: 2409 - DNA, 20 bp, Artificial
  CRISPR gRNA sequence
aaggacagaccttaggaggg

SEQ ID NO: 2410 - DNA, 20 bp, Artificial
  CRISPR gRNA sequence
acagaccttaggagggcagt

SEQ ID NO: 2411 - DNA, 20 bp, Artificial
  CRISPR gRNA sequence
ccttaggagggcagttggtc

SEQ ID NO: 2412 - DNA, 20 bp, Artificial
  CRISPR gRNA sequence
cttaggagggcagttggtcc

SEQ ID NO: 2413 - DNA, 20 bp, Artificial
  CRISPR gRNA sequence
cgtgtttcctgatcctgccc

SEQ ID NO: 2414 - DNA, 20 bp, Artificial
  CRISPR gRNA sequence
gtgtttcctgatcctgccct

SEQ ID NO: 2415 - DNA, 20 bp, Artificial
  CRISPR gRNA sequence
ctgatcctgccctgggtctg

SEQ ID NO: 2416 - DNA, 20 bp, Artificial
  CRISPR gRNA sequence
tgggtctgtagtcatacttc

SEQ ID NO: 2417 - DNA, 20 bp, Artificial
  CRISPR gRNA sequence
atacttctggaaattccttt

SEQ ID NO: 2418 - DNA, 20 bp, Artificial
  CRISPR gRNA sequence
tacttctggaaattcctttt

SEQ ID NO: 2419 - DNA, 20 bp, Artificial
  CRISPR gRNA sequence
tggaaattccttttgggtcc

SEQ ID NO: 2420 - DNA, 20 bp, Artificial
  CRISPR gRNA sequence
attccttttgggtccaagac

SEQ ID NO: 2421 - DNA, 20 bp, Artificial
  CRISPR gRNA sequence
ttccttttgggtccaagact

SEQ ID NO: 2422 - DNA, 20 bp, Artificial
  CRISPR gRNA sequence
ccttttgggtccaagactag

SEQ ID NO: 2423 - DNA, 20 bp, Artificial
  CRISPR gRNA sequence
cttttgggtccaagactagg

SEQ ID NO: 2424 - DNA, 20 bp, Artificial
  CRISPR gRNA sequence
caagactaggaggttcctct

SEQ ID NO: 2425 - DNA, 20 bp, Artificial
  CRISPR gRNA sequence
gaggttcctctaagatctca

SEQ ID NO: 2426 - DNA, 20 bp, Artificial
  CRISPR gRNA sequence
ctcatggccctgcttcctcc

SEQ ID NO: 2427 - DNA, 20 bp, Artificial
  CRISPR gRNA sequence
gcttcctcccagtgccctca

SEQ ID NO: 2428 - DNA, 20 bp, Artificial
  CRISPR gRNA sequence
cttcctcccagtgccctcac

SEQ ID NO: 2429 - DNA, 20 bp, Artificial
  CRISPR gRNA sequence
cacaggacattttcttccca

SEQ ID NO: 2430 - DNA, 20 bp, Artificial
  CRISPR gRNA sequence
acaggacattttcttcccac

SEQ ID NO: 2431 - DNA, 20 bp, Artificial
  CRISPR gRNA sequence
ggacattttcttcccacagg

SEQ ID NO: 2432 - DNA, 20 bp, Artificial
  CRISPR gRNA sequence
ttttcttcccacaggtggaa

SEQ ID NO: 2433 - DNA, 20 bp, Artificial
  CRISPR gRNA sequence
tttcttcccacaggtggaaa

SEQ ID NO: 2434 - DNA, 20 bp, Artificial
  CRISPR gRNA sequence
tcttcccacaggtggaaaag

SEQ ID NO: 2435 - DNA, 20 bp, Artificial
  CRISPR gRNA sequence
cttcccacaggtggaaaagg

SEQ ID NO: 2436 - DNA, 20 bp, Artificial
  CRISPR gRNA sequence
ttcccacaggtggaaaagga

SEQ ID NO: 2437 - DNA, 20 bp, Artificial
  CRISPR gRNA sequence
cccacaggtggaaaaggagg

SEQ ID NO: 2438 - DNA, 20 bp, Artificial
  CRISPR gRNA sequence
gaaaaggagggagctactct

SEQ ID NO: 2439 - DNA, 20 bp, Artificial
  CRISPR gRNA sequence
aaaaggagggagctactctc

SEQ ID NO: 2440 - DNA, 20 bp, Artificial
  CRISPR gRNA sequence
gctactctcaggctgcgtgt

SEQ ID NO: 2441 - DNA, 20 bp, Artificial
  CRISPR gRNA sequence
actctcaggctgcgtgtaag

SEQ ID NO: 2442 - DNA, 20 bp, Artificial
  CRISPR gRNA sequence
ctcaggctgcgtgtaagtgg

SEQ ID NO: 2443 - DNA, 20 bp, Artificial
  CRISPR gRNA sequence
tcaggctgcgtgtaagtggt

SEQ ID NO: 2444 - DNA, 20 bp, Artificial
  CRISPR gRNA sequence
caggctgcgtgtaagtggtg

SEQ ID NO: 2445 - DNA, 20 bp, Artificial
  CRISPR gRNA sequence
aggctgcgtgtaagtggtgg

SEQ ID NO: 2446 - DNA, 20 bp, Artificial
  CRISPR gRNA sequence
ctgcgtgtaagtggtggggg

SEQ ID NO: 2447 - DNA, 20 bp, Artificial
  CRISPR gRNA sequence
tgcgtgtaagtggtgggggt

SEQ ID NO: 2448 - DNA, 20 bp, Artificial
  CRISPR gRNA sequence
cgtgtaagtggtgggggtgg

SEQ ID NO: 2449 - DNA, 20 bp, Artificial
  CRISPR gRNA sequence
aagtggtgggggtgggagtg

SEQ ID NO: 2450 - DNA, 20 bp, Artificial
  CRISPR gRNA sequence
gtggtgggggtgggagtgtg

SEQ ID NO: 2451 - DNA, 20 bp, Artificial
  CRISPR gRNA sequence
tggtgggggtgggagtgtgg

SEQ ID NO: 2452 - DNA, 20 bp, Artificial
  CRISPR gRNA sequence
gtgggggtgggagtgtggag

SEQ ID NO: 2453 - DNA, 20 bp, Artificial
  CRISPR gRNA sequence
ctcctgtcccacgtctcctg

SEQ ID NO: 2454 - DNA, 20 bp, Artificial
  CRISPR gRNA sequence
tcctgtcccacgtctcctgc

SEQ ID NO: 2455 - DNA, 20 bp, Artificial
  CRISPR gRNA sequence
cgtctcctgcgggctctgac

SEQ ID NO: 2456 - DNA, 20 bp, Artificial
  CRISPR gRNA sequence
gtctcctgcgggctctgacc

SEQ ID NO: 2457 - DNA, 20 bp, Artificial
  CRISPR gRNA sequence
gtcctgtttttgttctactc

SEQ ID NO: 2458 - DNA, 20 bp, Artificial
  CRISPR gRNA sequence
tcctgtttttgttctactcc

SEQ ID NO: 2459 - DNA, 20 bp, Artificial
  CRISPR gRNA sequence
tgtttttgttctactccagg

SEQ ID NO: 2460 - DNA, 20 bp, Artificial
  CRISPR gRNA sequence
tgttctactccaggcagcga

SEQ ID NO: 2461 - DNA, 20 bp, Artificial
  CRISPR gRNA sequence
ctccaggcagcgacagtgcc

SEQ ID NO: 2462 - DNA, 20 bp, Artificial
  CRISPR gRNA sequence
tccaggcagcgacagtgccc

SEQ ID NO: 2463 - DNA, 20 bp, Artificial
  CRISPR gRNA sequence
ccaggcagcgacagtgccca

SEQ ID NO: 2464 - DNA, 20 bp, Artificial
  CRISPR gRNA sequence
gggctctgatgtgtctctca

SEQ ID NO: 2465 - DNA, 20 bp, Artificial
  CRISPR gRNA sequence
tgtgtctctcacagcttgaa

SEQ ID NO: 2466 - DNA, 20 bp, Artificial
  CRISPR gRNA sequence
gtgtctctcacagcttgaaa

SEQ ID NO: 2467 - DNA, 20 bp, Artificial
  CRISPR gRNA sequence
ctctcacagcttgaaaaggt

SEQ ID NO: 2468 - DNA, 20 bp, Artificial
  CRISPR gRNA sequence
gcttgaaaaggtgagattct

SEQ ID NO: 2469 - DNA, 20 bp, Artificial
  CRISPR gRNA sequence
cttgaaaaggtgagattctt

SEQ ID NO: 2470 - DNA, 20 bp, Artificial
  CRISPR gRNA sequence
ttgaaaaggtgagattcttg

SEQ ID NO: 2471 - DNA, 20 bp, Artificial
  CRISPR gRNA sequence
aaggtgagattcttggggtc

SEQ ID NO: 2472 - DNA, 20 bp, Artificial
  CRISPR gRNA sequence
ggtgagattcttggggtcta

SEQ ID NO: 2473 - DNA, 20 bp, Artificial
  CRISPR gRNA sequence
gagattcttggggtctagag

SEQ ID NO: 2474 - DNA, 20 bp, Artificial
  CRISPR gRNA sequence
agattcttggggtctagagt

SEQ ID NO: 2475 - DNA, 20 bp, Artificial
  CRISPR gRNA sequence
ttcttggggtctagagtggg

SEQ ID NO: 2476 - DNA, 20 bp, Artificial
  CRISPR gRNA sequence
tcttggggtctagagtgggt

SEQ ID NO: 2477 - DNA, 20 bp, Artificial
  CRISPR gRNA sequence
cttggggtctagagtgggtg

SEQ ID NO: 2478 - DNA, 20 bp, Artificial
  CRISPR gRNA sequence
ggggtctagagtgggtgggg

SEQ ID NO: 2479 - DNA, 20 bp, Artificial
  CRISPR gRNA sequence
gtctagagtgggtggggtgg

SEQ ID NO: 2480 - DNA, 20 bp, Artificial
  CRISPR gRNA sequence
tctagagtgggtggggtggc

SEQ ID NO: 2481 - DNA, 20 bp, Artificial
  CRISPR gRNA sequence
agtgggtggggtggcgggtc

SEQ ID NO: 2482 - DNA, 20 bp, Artificial
  CRISPR gRNA sequence
gtgggtggggtggcgggtct

SEQ ID NO: 2483 - DNA, 20 bp, Artificial
  CRISPR gRNA sequence
tgggtggggtggcgggtctg

SEQ ID NO: 2484 - DNA, 20 bp, Artificial
  CRISPR gRNA sequence
gggtggggtggcgggtctgg

SEQ ID NO: 2485 - DNA, 20 bp, Artificial
  CRISPR gRNA sequence
tggggtggcgggtctggggg

SEQ ID NO: 2486 - DNA, 20 bp, Artificial
  CRISPR gRNA sequence
ggggtggcgggtctgggggt

SEQ ID NO: 2487 - DNA, 20 bp, Artificial
  CRISPR gRNA sequence
gtggcgggtctgggggtggg

SEQ ID NO: 2488 - DNA, 20 bp, Artificial
  CRISPR gRNA sequence
tggcgggtctgggggtgggt

SEQ ID NO: 2489 - DNA, 20 bp, Artificial
  CRISPR gRNA sequence
ggcgggtctgggggtgggtg

SEQ ID NO: 2490 - DNA, 20 bp, Artificial
  CRISPR gRNA sequence
gggtctgggggtgggtgggg

SEQ ID NO: 2491 - DNA, 20 bp, Artificial
  CRISPR gRNA sequence
gtctgggggtgggtggggca

SEQ ID NO: 2492 - DNA, 20 bp, Artificial
  CRISPR gRNA sequence
tctgggggtgggtggggcag

SEQ ID NO: 2493 - DNA, 20 bp, Artificial
  CRISPR gRNA sequence
ctgggggtgggtggggcaga

SEQ ID NO: 2494 - DNA, 20 bp, Artificial
  CRISPR gRNA sequence
tgggggtgggtggggcagag

SEQ ID NO: 2495 - DNA, 20 bp, Artificial
  CRISPR gRNA sequence
ggtgggtggggcagagggga

SEQ ID NO: 2496 - DNA, 20 bp, Artificial
  CRISPR gRNA sequence
gtgggtggggcagaggggaa

SEQ ID NO: 2497 - DNA, 20 bp, Artificial
  CRISPR gRNA sequence
tggggcagaggggaaaggcc

SEQ ID NO: 2498 - DNA, 20 bp, Artificial
  CRISPR gRNA sequence
ggggcagaggggaaaggcct

SEQ ID NO: 2499 - DNA, 20 bp, Artificial
  CRISPR gRNA sequence
gaggggaaaggcctgggtaa

SEQ ID NO: 2500 - DNA, 20 bp, Artificial
  CRISPR gRNA sequence
aggggaaaggcctgggtaat

SEQ ID NO: 2501 - DNA, 20 bp, Artificial
  CRISPR gRNA sequence
ggggaaaggcctgggtaatg

SEQ ID NO: 2502 - DNA, 20 bp, Artificial
  CRISPR gRNA sequence
ggtaatggggattctttgat

SEQ ID NO: 2503 - DNA, 20 bp, Artificial
  CRISPR gRNA sequence
gtaatggggattctttgatt

SEQ ID NO: 2504 - DNA, 20 bp, Artificial
  CRISPR gRNA sequence
ccccacccactctagacccc

SEQ ID NO: 2505 - DNA, 20 bp, Artificial
  CRISPR gRNA sequence
ccctgggcactgtcgctgcc

SEQ ID NO: 2506 - DNA, 20 bp, Artificial
  CRISPR gRNA sequence
cgcaggagacgtgggacagg

SEQ ID NO: 2507 - DNA, 20 bp, Artificial
  CRISPR gRNA sequence
acgtgggacaggaggaatta

SEQ ID NO: 2508 - DNA, 20 bp, Artificial
  CRISPR gRNA sequence
gggacaggaggaattatggg

SEQ ID NO: 2509 - DNA, 20 bp, Artificial
  CRISPR gRNA sequence
ccaccacttacacgcagcct

SEQ ID NO: 2510 - DNA, 20 bp, Artificial
  CRISPR gRNA sequence
ctcctagtcttggacccaaa

SEQ ID NO: 2511 - DNA, 20 bp, Artificial
  CRISPR gRNA sequence
gtatgactacagacccaggg

SEQ ID NO: 2512 - DNA, 20 bp, Artificial
  CRISPR gRNA sequence
gaaacacgaggaaagcaagt

SEQ ID NO: 2513 - DNA, 20 bp, Artificial
  CRISPR gRNA sequence
cagggaccttcccctgactc

SEQ ID NO: 2514 - DNA, 20 bp, Artificial
  CRISPR gRNA sequence
ttcccctgactcatgaatgc

SEQ ID NO: 2515 - DNA, 20 bp, Artificial
  CRISPR gRNA sequence
ttgtcacatgtgctgcacaa

SEQ ID NO: 2516 - DNA, 20 bp, Artificial
  CRISPR gRNA sequence
aaagagtaagtgctggcaca

SEQ ID NO: 2517 - DNA, 20 bp, Artificial
  CRISPR gRNA sequence
tccccctccttaccccatct

SEQ ID NO: 2518 - DNA, 20 bp, Artificial
  CRISPR gRNA sequence
gtctccacaagctcagtgtc

SEQ ID NO: 2519 - DNA, 20 bp, Artificial
  CRISPR gRNA sequence
ccaggtcagtgtgatctccg

SEQ ID NO: 2520 - DNA, 20 bp, Artificial
  CRISPR gRNA sequence
aaacccagggcccagcacct

SEQ ID NO: 2521 - DNA, 20 bp, Artificial
  CRISPR gRNA sequence
ggtggcctcatggtcagaga

SEQ ID NO: 2522 - DNA, 20 bp, Artificial
  CRISPR gRNA sequence
tcatggtcagagatggggtg

SEQ ID NO: 2523 - DNA, 20 bp, Artificial
  CRISPR gRNA sequence
gtgggtcacgtgtgtctttg

SEQ ID NO: 2524 - DNA, 20 bp, Artificial
  CRISPR gRNA sequence
tctttggggggtctgatggg

SEQ ID NO: 2525 - DNA, 20 bp, Artificial
  CRISPR gRNA sequence
accacccatgtgaccagcct

SEQ ID NO: 2526 - DNA, 20 bp, Artificial
  CRISPR gRNA sequence
ctgagaatggacaggacacc

SEQ ID NO: 2527 - DNA, 20 bp, Artificial
  CRISPR gRNA sequence
ccagcctggacgcaggcacc

SEQ ID NO: 2528 - DNA, 20 bp, Artificial
  CRISPR gRNA sequence
tctcctattcattggaaagt

SEQ ID NO: 2529 - DNA, 20 bp, Artificial
  CRISPR gRNA sequence
cagggacttctgctcctgat

SEQ ID NO: 2530 - DNA, 20 bp, Artificial
  CRISPR gRNA sequence
gtaaagtgactcagaagtgc

SEQ ID NO: 2531 - DNA, 20 bp, Artificial
  CRISPR gRNA sequence
gaatcagagccccaaacaca

SEQ ID NO: 2532 - DNA, 20 bp, Artificial
  CRISPR gRNA sequence
acggttcccaaggctgctgc

SEQ ID NO: 2533 - DNA, 20 bp, Artificial
  CRISPR gRNA sequence
cgggccgcctcccacttgcg

SEQ ID NO: 2534 - DNA, 20 bp, Artificial
  CRISPR gRNA sequence
tcgcagccgtacatgctctg

SEQ ID NO: 2535 - DNA, 20 bp, Artificial
  CRISPR gRNA sequence
ccccgccccgaccaacccgc

SEQ ID NO: 2536 - DNA, 20 bp, Artificial
  CRISPR gRNA sequence
ggcctcaactgaaaatgaaa

SEQ ID NO: 2537 - DNA, 20 bp, Artificial
  CRISPR gRNA sequence
gcctggggctctcgccggtc

SEQ ID NO: 2538 - DNA, 20 bp, Artificial
  CRISPR gRNA sequence
ctcgccggtcgagggtctgg

SEQ ID NO: 2539 - DNA, 20 bp, Artificial
  CRISPR gRNA sequence
ggtcccgcggcctcagggag

SEQ ID NO: 2540 - DNA, 20 bp, Artificial
  CRISPR gRNA sequence
ggcgacccgggccgtacgtg

SEQ ID NO: 2541 - DNA, 20 bp, Artificial
  CRISPR gRNA sequence
cgggccgtacgtgggggatg

SEQ ID NO: 2542 - DNA, 20 bp, Artificial
  CRISPR gRNA sequence
tcgtgacctgcgccccgggc

SEQ ID NO: 2543 - DNA, 20 bp, Artificial
  CRISPR gRNA sequence
tcgctgtcgaacctcacgaa

SEQ ID NO: 2544 - DNA, 20 bp, Artificial
  CRISPR gRNA sequence
ggaggtgtagaaatacctca

SEQ ID NO: 2545 - DNA, 20 bp, Artificial
  CRISPR gRNA sequence
acctcatggagtgggagcct

SEQ ID NO: 2546 - DNA, 20 bp, Artificial
  CRISPR gRNA sequence
tctcggcgtctgaggagact

SEQ ID NO: 2547 - DNA, 20 bp, Artificial
  CRISPR gRNA sequence
cgtctgaggagactctgagt

SEQ ID NO: 2548 - DNA, 20 bp, Artificial
  CRISPR gRNA sequence
tgaggagactctgagtccgg

SEQ ID NO: 2549 - DNA, 20 bp, Artificial
  CRISPR gRNA sequence
cccacgcacccacccggact

SEQ ID NO: 2550 - DNA, 20 bp, Artificial
  CRISPR gRNA sequence
cctgaccgagacctgggccg

SEQ ID NO: 2551 - DNA, 20 bp, Artificial
  CRISPR gRNA sequence
cgagacctgggccggtgagt

SEQ ID NO: 2552 - DNA, 20 bp, Artificial
  CRISPR gRNA sequence
ctgaggagccgcgccgggag

SEQ ID NO: 2553 - DNA, 20 bp, Artificial
  CRISPR gRNA sequence
cgcgccgggaggagggtcgg

SEQ ID NO: 2554 - DNA, 20 bp, Artificial
  CRISPR gRNA sequence
tgaggttcgacagcgacgcc

SEQ ID NO: 2555 - DNA, 20 bp, Artificial
  CRISPR gRNA sequence
agagaggagccgcgggcgcc

SEQ ID NO: 2556 - DNA, 20 bp, Artificial
  CRISPR gRNA sequence
gtggatagagcaggaggggc

SEQ ID NO: 2557 - DNA, 20 bp, Artificial
  CRISPR gRNA sequence
ctacaaccagagcgaggccg

SEQ ID NO: 2558 - DNA, 20 bp, Artificial
  CRISPR gRNA sequence
ccccatcccccacgtacggc

SEQ ID NO: 2559 - DNA, 20 bp, Artificial
  CRISPR gRNA sequence
cacgtacggcccgggtcgcc

SEQ ID NO: 2560 - DNA, 20 bp, Artificial
  CRISPR gRNA sequence
gcccgggtcgccccgagtct

SEQ ID NO: 2561 - DNA, 20 bp, Artificial
  CRISPR gRNA sequence
cagttgaggccaaaatcccc

SEQ ID NO: 2562 - DNA, 20 bp, Artificial
  CRISPR gRNA sequence
gctgaccgcggggccggggc

SEQ ID NO: 2563 - DNA, 20 bp, Artificial
  CRISPR gRNA sequence
accagtacgcctacgacggc

SEQ ID NO: 2564 - DNA, 20 bp, Artificial
  CRISPR gRNA sequence
gcggagagcctacctggagg

SEQ ID NO: 2565 - DNA, 20 bp, Artificial
  CRISPR gRNA sequence
ctacctggagggcgagtgcg

SEQ ID NO: 2566 - DNA, 20 bp, Artificial
  CRISPR gRNA sequence
cccatctcctataggtcgcc

SEQ ID NO: 2567 - DNA, 20 bp, Artificial
  CRISPR gRNA sequence
ccacgagaagaggaggaaaa

SEQ ID NO: 2568 - DNA, 20 bp, Artificial
  CRISPR gRNA sequence
gaggaaaatgggatcagcgc

SEQ ID NO: 2569 - DNA, 20 bp, Artificial
  CRISPR gRNA sequence
cgctagaatgtcgccctccg

SEQ ID NO: 2570 - DNA, 20 bp, Artificial
  CRISPR gRNA sequence
atgtcgccctccgttgaatg

SEQ ID NO: 2571 - DNA, 20 bp, Artificial
  CRISPR gRNA sequence
tccgttgaatggagaatggc

SEQ ID NO: 2572 - DNA, 20 bp, Artificial
  CRISPR gRNA sequence
ggagaatggcatgagttttc

SEQ ID NO: 2573 - DNA, 20 bp, Artificial
  CRISPR gRNA sequence
ctcttctctctagacaatta

SEQ ID NO: 2574 - DNA, 20 bp, Artificial
  CRISPR gRNA sequence
atggaggggaagacagtccc

SEQ ID NO: 2575 - DNA, 20 bp, Artificial
  CRISPR gRNA sequence
cagtccctagaatactgatc

SEQ ID NO: 2576 - DNA, 20 bp, Artificial
  CRISPR gRNA sequence
gggctctgattccagcactt

SEQ ID NO: 2577 - DNA, 20 bp, Artificial
  CRISPR gRNA sequence
tcagagactcgaactttcca

SEQ ID NO: 2578 - DNA, 20 bp, Artificial
  CRISPR gRNA sequence
gcctgcgtccaggctggtgt

SEQ ID NO: 2579 - DNA, 20 bp, Artificial
  CRISPR gRNA sequence
tccattctcaggctggtcac

SEQ ID NO: 2580 - DNA, 20 bp, Artificial
  CRISPR gRNA sequence
gctggtcacatgggtggtcc

SEQ ID NO: 2581 - DNA, 20 bp, Artificial
  CRISPR gRNA sequence
ccatgaaagatgcaaagcgc

SEQ ID NO: 2582 - DNA, 20 bp, Artificial
  CRISPR gRNA sequence
ccaccctgaggtgctgggcc

SEQ ID NO: 2583 - DNA, 20 bp, Artificial
  CRISPR gRNA sequence
agatcacactgacctggcag

SEQ ID NO: 2584 - DNA, 20 bp, Artificial
  CRISPR gRNA sequence
cgaagcccctcaccctgaga

SEQ ID NO: 2585 - DNA, 20 bp, Artificial
  CRISPR gRNA sequence
ccctgagatggggtaaggag

SEQ ID NO: 2586 - DNA, 20 bp, Artificial
  CRISPR gRNA sequence
atggggtaaggagggggatg

SEQ ID NO: 2587 - DNA, 20 bp, Artificial
  CRISPR gRNA sequence
ggaaagcaggagcccttcag

SEQ ID NO: 2588 - DNA, 20 bp, Artificial
  CRISPR gRNA sequence
ctgctgtgatgtgtaggagg

SEQ ID NO: 2589 - DNA, 20 bp, Artificial
  CRISPR gRNA sequence
aggaagagttcaggtaggga

SEQ ID NO: 2590 - DNA, 20 bp, Artificial
  CRISPR gRNA sequence
gttcaggtagggaaggggtg

SEQ ID NO: 2591 - DNA, 20 bp, Artificial
  CRISPR gRNA sequence
ggtagggaaggggtgagggg

SEQ ID NO: 2592 - DNA, 20 bp, Artificial
  CRISPR gRNA sequence
gaaggggtgaggggtggggt

SEQ ID NO: 2593 - DNA, 20 bp, Artificial
  CRISPR gRNA sequence
ctgggttttcttgtcccact

SEQ ID NO: 2594 - DNA, 20 bp, Artificial
  CRISPR gRNA sequence
gtgcagcacatgtgacaatg

SEQ ID NO: 2595 - DNA, 20 bp, Artificial
  CRISPR gRNA sequence
agcacatgtgacaatgaagg

SEQ ID NO: 2596 - DNA, 20 bp, Artificial
  CRISPR gRNA sequence
caccttgatggttgtggtgt

SEQ ID NO: 2597 - DNA, 20 bp, Artificial
  CRISPR gRNA sequence
gggtcctgattccagcattc

SEQ ID NO: 2598 - DNA, 20 bp, Artificial
  CRISPR gRNA sequence
tcgtgtttcctgatcctgcc

SEQ ID NO: 2599 - DNA, 20 bp, Artificial
  CRISPR gRNA sequence
catacttctggaaattcctt

SEQ ID NO: 2600 - DNA, 20 bp, Artificial
  CRISPR gRNA sequence
tcaggctgcgtgtaagtggt

SEQ ID NO: 2601 - DNA, 20 bp, Artificial
  CRISPR gRNA sequence
tgcgtgtaagtggtgggggt

SEQ ID NO: 2602 - DNA, 20 bp, Artificial
  CRISPR gRNA sequence
gcttgaaaaggtgagattct

SEQ ID NO: 2603 - DNA, 20 bp, Artificial
  CRISPR gRNA sequence
aaggtgagattcttggggtc

SEQ ID NO: 2604 - DNA, 20 bp, Artificial
  CRISPR gRNA sequence
tgagattcttggggtctaga

SEQ ID NO: 2605 - DNA, 20 bp, Artificial
  CRISPR gRNA sequence
ttcttggggtctagagtggg

SEQ ID NO: 2606 - DNA, 20 bp, Artificial
  CRISPR gRNA sequence
ggtctagagtgggtggggtg

SEQ ID NO: 2607 - DNA, 20 bp, Artificial
  CRISPR gRNA sequence
gtgggtggggtggcgggtct

SEQ ID NO: 2608 - DNA, 20 bp, Artificial
  CRISPR gRNA sequence
gtggggtggcgggtctgggg

SEQ ID NO: 2609 - DNA, 20 bp, Artificial
  CRISPR gRNA sequence
gtggggcagaggggaaaggc

SEQ ID NO: 2610 - DNA, 20 bp, Artificial
  CRISPR gRNA sequence
aggggaaaggcctgggtaat

SEQ ID NO: 2611 - DNA, 20 bp, Artificial
  CRISPR gRNA sequence
tgcgttagcccctgtgtgca

SEQ ID NO: 2612 - DNA, 20 bp, Artificial
  CRISPR gRNA sequence
aggcagggaacacttctacc

SEQ ID NO: 2613 - DNA, 20 bp, Artificial
  CRISPR gRNA sequence
ccctgaccctgctgaagggc

SEQ ID NO: 2614 - DNA, 20 bp, Artificial
  CRISPR gRNA sequence
ccttaccccatctcagggtg

SEQ ID NO: 2615 - DNA, 20 bp, Artificial
  CRISPR gRNA sequence
gtctccacaagctcagtgtc

SEQ ID NO: 2616 - DNA, 20 bp, Artificial
  CRISPR gRNA sequence
tgggaagagtcagaaaattc

SEQ ID NO: 2617 - DNA, 20 bp, Artificial
  CRISPR gRNA sequence
tgcccctggtaccagcgcgc

SEQ ID NO: 2618 - DNA, 20 bp, Artificial
  CRISPR gRNA sequence
gccccgccccgaccaacccg

SEQ ID NO: 2619 - DNA, 20 bp, Artificial
  CRISPR gRNA sequence
tagaactgggaccgcggcga

SEQ ID NO: 2620 - DNA, 20 bp, Artificial
  CRISPR gRNA sequence
ctgggaccgcggcgacgctg

SEQ ID NO: 2621 - DNA, 20 bp, Artificial
  CRISPR gRNA sequence
cccggcccggccgcggggag

SEQ ID NO: 2622 - DNA, 20 bp, Artificial
  CRISPR gRNA sequence
tcgaccggcgagagccccag

SEQ ID NO: 2623 - DNA, 20 bp, Artificial
  CRISPR gRNA sequence
gagagccccaggcgcgttta

SEQ ID NO: 2624 - DNA, 20 bp, Artificial
  CRISPR gRNA sequence
gaccagtacgcctacgacgg

SEQ ID NO: 2625 - DNA, 20 bp, Artificial
  CRISPR gRNA sequence
tccgttgaatggagaatggc

SEQ ID NO: 2626 - DNA, 20 bp, Artificial
  CRISPR gRNA sequence
ggagaatggcatgagttttc

SEQ ID NO: 2627 - DNA, 20 bp, Artificial
  CRISPR gRNA sequence
tgttctctgcctcacactca

SEQ ID NO: 2628 - DNA, 20 bp, Artificial
  CRISPR gRNA sequence
cacactcagtgtgtttgggg

SEQ ID NO: 2629 - DNA, 20 bp, Artificial
  CRISPR gRNA sequence
actcgaactttccaatgaat

SEQ ID NO: 2630 - DNA, 20 bp, Artificial
  CRISPR gRNA sequence
ccaccctgaggtgctgggcc

SEQ ID NO: 2631 - DNA, 20 bp, Artificial
  CRISPR gRNA sequence
cgaggaccaaactcaggaca

SEQ ID NO: 2632 - DNA, 20 bp, Artificial
  CRISPR gRNA sequence
gaaggggtgaggggtggggt

SEQ ID NO: 2633 - DNA, 20 bp, Artificial
  CRISPR gRNA sequence
ctgggttttcttgtcccact

SEQ ID NO: 2634 - DNA, 20 bp, Artificial
  CRISPR gRNA sequence
tgatggttgtggtgttgggg

SEQ ID NO: 2635 - DNA, 20 bp, Artificial
  CRISPR gRNA sequence
gcagttggtccaggacccac

SEQ ID NO: 2636 - DNA, 20 bp, Artificial
  CRISPR gRNA sequence
aggacccacacttgctttcc

SEQ ID NO: 2637 - DNA, 20 bp, Artificial
  CRISPR gRNA sequence
gttcctctaagatctcatgg

SEQ ID NO: 2638 - DNA, 20 bp, Artificial
  CRISPR gRNA sequence
tcctgcgggctctgaccagg

SEQ ID NO: 2639 - DNA, 20 bp, Artificial
  CRISPR gRNA sequence
cagggctctgatgtgtctct

SEQ ID NO: 2640 - DNA, 20 bp, Artificial
  CRISPR gRNA sequence
gtctctcacagcttgaaaag

SEQ ID NO: 2641 - DNA, 20 bp, Artificial
  CRISPR gRNA sequence
gaggggaaaggcctgggtaa

SEQ ID NO: 2642 - DNA, 20 bp, Artificial
  CRISPR gRNA sequence
aggcctgggtaatggggatt

SEQ ID NO: 2643 - DNA, 20 bp, Artificial
  CRISPR gRNA sequence
accccacccactctagaccc

SEQ ID NO: 2644 - DNA, 20 bp, Artificial
  CRISPR gRNA sequence
ccctccttttccacctgtgg

SEQ ID NO: 2645 - DNA, 20 bp, Artificial
  CRISPR gRNA sequence
gcttgaaacccccagtggga

SEQ ID NO: 2646 - DNA, 20 bp, Artificial
  CRISPR gRNA sequence
gtcagtgtgatctccgcagg

SEQ ID NO: 2647 - DNA, 20 bp, Artificial
  CRISPR gRNA sequence
ggggggtctgatgggaagag

SEQ ID NO: 2648 - DNA, 20 bp, Artificial
  CRISPR gRNA sequence
gaccacccatgtgaccagcc

SEQ ID NO: 2649 - DNA, 20 bp, Artificial
  CRISPR gRNA sequence
ccgggccgggacacggaggt

SEQ ID NO: 2650 - DNA, 20 bp, Artificial
  CRISPR gRNA sequence
ggaggaaaatgggatcagcg

SEQ ID NO: 2651 - DNA, 20 bp, Artificial
  CRISPR gRNA sequence
aatgtcgccctccgttgaat

SEQ ID NO: 2652 - DNA, 20 bp, Artificial
  CRISPR gRNA sequence
aatggaggggaagacagtcc

SEQ ID NO: 2653 - DNA, 20 bp, Artificial
  CRISPR gRNA sequence
gtcgctgcctggagtagaac

SEQ ID NO: 2654 - DNA, 20 bp, Artificial
  CRISPR gRNA sequence
tgaaacccccagtgggacaa

SEQ ID NO: 2655 - DNA, 20 bp, Artificial
  CRISPR gRNA sequence
ggccctcagaggaaactcag

SEQ ID NO: 2656 - DNA, 20 bp, Artificial
  CRISPR gRNA sequence
cccaggcctttcccctctgc

SEQ ID NO: 2657 - DNA, 20 bp, Artificial
  CRISPR gRNA sequence
tcccctctgccccacccacc

SEQ ID NO: 2658 - DNA, 20 bp, Artificial
  CRISPR gRNA sequence
cccctctgccccacccaccc

SEQ ID NO: 2659 - DNA, 20 bp, Artificial
  CRISPR gRNA sequence
ccctctgccccacccacccc

SEQ ID NO: 2660 - DNA, 20 bp, Artificial
  CRISPR gRNA sequence
tgccccacccacccccagac

SEQ ID NO: 2661 - DNA, 20 bp, Artificial
  CRISPR gRNA sequence
ccccacccacccccagaccc

SEQ ID NO: 2662 - DNA, 20 bp, Artificial
  CRISPR gRNA sequence
tagaccccaagaatctcacc

SEQ ID NO: 2663 - DNA, 20 bp, Artificial
  CRISPR gRNA sequence
gaccccaagaatctcacctt

SEQ ID NO: 2664 - DNA, 20 bp, Artificial
  CRISPR gRNA sequence
accttttcaagctgtgagag

SEQ ID NO: 2665 - DNA, 20 bp, Artificial
  CRISPR gRNA sequence
ttcaagctgtgagagacaca

SEQ ID NO: 2666 - DNA, 20 bp, Artificial
  CRISPR gRNA sequence
tcaagctgtgagagacacat

SEQ ID NO: 2667 - DNA, 20 bp, Artificial
  CRISPR gRNA sequence
caagctgtgagagacacatc

SEQ ID NO: 2668 - DNA, 20 bp, Artificial
  CRISPR gRNA sequence
aagctgtgagagacacatca

SEQ ID NO: 2669 - DNA, 20 bp, Artificial
  CRISPR gRNA sequence
tgagagacacatcagagccc

SEQ ID NO: 2670 - DNA, 20 bp, Artificial
  CRISPR gRNA sequence
ggcactgtcgctgcctggag

SEQ ID NO: 2671 - DNA, 20 bp, Artificial
  CRISPR gRNA sequence
tcgctgcctggagtagaaca

SEQ ID NO: 2672 - DNA, 20 bp, Artificial
  CRISPR gRNA sequence
cctggagtagaacaaaaaca

SEQ ID NO: 2673 - DNA, 20 bp, Artificial
  CRISPR gRNA sequence
gagtagaacaaaaacaggac

SEQ ID NO: 2674 - DNA, 20 bp, Artificial
  CRISPR gRNA sequence
gtcagagcccgcaggagacg

SEQ ID NO: 2675 - DNA, 20 bp, Artificial
  CRISPR gRNA sequence
tggggtgggtgagctcctcc

SEQ ID NO: 2676 - DNA, 20 bp, Artificial
  CRISPR gRNA sequence
ctccacactcccacccccac

SEQ ID NO: 2677 - DNA, 20 bp, Artificial
  CRISPR gRNA sequence
cacactcccacccccaccac

SEQ ID NO: 2678 - DNA, 20 bp, Artificial
  CRISPR gRNA sequence
ccacccccaccacttacacg

SEQ ID NO: 2679 - DNA, 20 bp, Artificial
  CRISPR gRNA sequence
acacgcagcctgagagtagc

SEQ ID NO: 2680 - DNA, 20 bp, Artificial
  CRISPR gRNA sequence
cacgcagcctgagagtagct

SEQ ID NO: 2681 - DNA, 20 bp, Artificial
  CRISPR gRNA sequence
agagtagctccctccttttc

SEQ ID NO: 2682 - DNA, 20 bp, Artificial
  CRISPR gRNA sequence
cctccttttccacctgtggg

SEQ ID NO: 2683 - DNA, 20 bp, Artificial
  CRISPR gRNA sequence
cttttccacctgtgggaaga

SEQ ID NO: 2684 - DNA, 20 bp, Artificial
  CRISPR gRNA sequence
ttccacctgtgggaagaaaa

SEQ ID NO: 2685 - DNA, 20 bp, Artificial
  CRISPR gRNA sequence
tccacctgtgggaagaaaat

SEQ ID NO: 2686 - DNA, 20 bp, Artificial
  CRISPR gRNA sequence
ccacctgtgggaagaaaatg

SEQ ID NO: 2687 - DNA, 20 bp, Artificial
  CRISPR gRNA sequence
cacctgtgggaagaaaatgt

SEQ ID NO: 2688 - DNA, 20 bp, Artificial
  CRISPR gRNA sequence
tgggaagaaaatgtcctgtg

SEQ ID NO: 2689 - DNA, 20 bp, Artificial
  CRISPR gRNA sequence
tgagggcactgggaggaagc

SEQ ID NO: 2690 - DNA, 20 bp, Artificial
  CRISPR gRNA sequence
ggaggaagcagggccatgag

SEQ ID NO: 2691 - DNA, 20 bp, Artificial
  CRISPR gRNA sequence
agaggaacctcctagtcttg

SEQ ID NO: 2692 - DNA, 20 bp, Artificial
  CRISPR gRNA sequence
gaggaacctcctagtcttgg

SEQ ID NO: 2693 - DNA, 20 bp, Artificial
  CRISPR gRNA sequence
ctagtcttggacccaaaagg

SEQ ID NO: 2694 - DNA, 20 bp, Artificial
  CRISPR gRNA sequence
gtcttggacccaaaaggaat

SEQ ID NO: 2695 - DNA, 20 bp, Artificial
  CRISPR gRNA sequence
ggacccaaaaggaatttcca

SEQ ID NO: 2696 - DNA, 20 bp, Artificial
  CRISPR gRNA sequence
gacccaaaaggaatttccag

SEQ ID NO: 2697 - DNA, 20 bp, Artificial
  CRISPR gRNA sequence
ccagaagtatgactacagac

SEQ ID NO: 2698 - DNA, 20 bp, Artificial
  CRISPR gRNA sequence
cagaagtatgactacagacc

SEQ ID NO: 2699 - DNA, 20 bp, Artificial
  CRISPR gRNA sequence
cagacccagggcaggatcag

SEQ ID NO: 2700 - DNA, 20 bp, Artificial
  CRISPR gRNA sequence
gaccaactgccctcctaagg

SEQ ID NO: 2701 - DNA, 20 bp, Artificial
  CRISPR gRNA sequence
ccctcctaaggtctgtcctt

SEQ ID NO: 2702 - DNA, 20 bp, Artificial
  CRISPR gRNA sequence
ctaaggtctgtccttagcag

SEQ ID NO: 2703 - DNA, 20 bp, Artificial
  CRISPR gRNA sequence
aggtctgtccttagcaggga

SEQ ID NO: 2704 - DNA, 20 bp, Artificial
  CRISPR gRNA sequence
tccttagcagggaccttccc

SEQ ID NO: 2705 - DNA, 20 bp, Artificial
  CRISPR gRNA sequence
agcagggaccttcccctgac

SEQ ID NO: 2706 - DNA, 20 bp, Artificial
  CRISPR gRNA sequence
gcagggaccttcccctgact

SEQ ID NO: 2707 - DNA, 20 bp, Artificial
  CRISPR gRNA sequence
cccctgactcatgaatgctg

SEQ ID NO: 2708 - DNA, 20 bp, Artificial
  CRISPR gRNA sequence
ccctgactcatgaatgctgg

SEQ ID NO: 2709 - DNA, 20 bp, Artificial
  CRISPR gRNA sequence
actcatgaatgctggaatca

SEQ ID NO: 2710 - DNA, 20 bp, Artificial
  CRISPR gRNA sequence
atgaatgctggaatcaggac

SEQ ID NO: 2711 - DNA, 20 bp, Artificial
  CRISPR gRNA sequence
gaatcaggaccccaacacca

SEQ ID NO: 2712 - DNA, 20 bp, Artificial
  CRISPR gRNA sequence
cattgtcacatgtgctgcac

SEQ ID NO: 2713 - DNA, 20 bp, Artificial
  CRISPR gRNA sequence
attgtcacatgtgctgcaca

SEQ ID NO: 2714 - DNA, 20 bp, Artificial
  CRISPR gRNA sequence
tcacatgtgctgcacaaaag

SEQ ID NO: 2715 - DNA, 20 bp, Artificial
  CRISPR gRNA sequence
cacaaaagagtaagtgctgg

SEQ ID NO: 2716 - DNA, 20 bp, Artificial
  CRISPR gRNA sequence
gcacacagggtcccaggctg

SEQ ID NO: 2717 - DNA, 20 bp, Artificial
  CRISPR gRNA sequence
cgttagcccctgtgtgcatg

SEQ ID NO: 2718 - DNA, 20 bp, Artificial
  CRISPR gRNA sequence
gcccctgtgtgcatgctgct

SEQ ID NO: 2719 - DNA, 20 bp, Artificial
  CRISPR gRNA sequence
tgtgcatgctgcttcccagt

SEQ ID NO: 2720 - DNA, 20 bp, Artificial
  CRISPR gRNA sequence
cttcccagtaatgaggcagg

SEQ ID NO: 2721 - DNA, 20 bp, Artificial
  CRISPR gRNA sequence
cccagtaatgaggcagggaa

SEQ ID NO: 2722 - DNA, 20 bp, Artificial
  CRISPR gRNA sequence
ccagtaatgaggcagggaac

SEQ ID NO: 2723 - DNA, 20 bp, Artificial
  CRISPR gRNA sequence
ctacctggggcttgaaaccc

SEQ ID NO: 2724 - DNA, 20 bp, Artificial
  CRISPR gRNA sequence
tacctggggcttgaaacccc

SEQ ID NO: 2725 - DNA, 20 bp, Artificial
  CRISPR gRNA sequence
cctggggcttgaaaccccca

SEQ ID NO: 2726 - DNA, 20 bp, Artificial
  CRISPR gRNA sequence
gggcttgaaacccccagtgg

SEQ ID NO: 2727 - DNA, 20 bp, Artificial
  CRISPR gRNA sequence
gaaacccccagtgggacaag

SEQ ID NO: 2728 - DNA, 20 bp, Artificial
  CRISPR gRNA sequence
aaacccccagtgggacaaga

SEQ ID NO: 2729 - DNA, 20 bp, Artificial
  CRISPR gRNA sequence
accccttccctacctgaact

SEQ ID NO: 2730 - DNA, 20 bp, Artificial
  CRISPR gRNA sequence
ccctacctgaactcttcctc

SEQ ID NO: 2731 - DNA, 20 bp, Artificial
  CRISPR gRNA sequence
cctacctgaactcttcctcc

SEQ ID NO: 2732 - DNA, 20 bp, Artificial
  CRISPR gRNA sequence
cctgaactcttcctcctaca

SEQ ID NO: 2733 - DNA, 20 bp, Artificial
  CRISPR gRNA sequence
aactcttcctcctacacatc

SEQ ID NO: 2734 - DNA, 20 bp, Artificial
  CRISPR gRNA sequence
ttcctcctacacatcacagc

SEQ ID NO: 2735 - DNA, 20 bp, Artificial
  CRISPR gRNA sequence
cctcctacacatcacagcag

SEQ ID NO: 2736 - DNA, 20 bp, Artificial
  CRISPR gRNA sequence
ctcctacacatcacagcagc

SEQ ID NO: 2737 - DNA, 20 bp, Artificial
  CRISPR gRNA sequence
ctacacatcacagcagcgac

SEQ ID NO: 2738 - DNA, 20 bp, Artificial
  CRISPR gRNA sequence
cacatcacagcagcgaccac

SEQ ID NO: 2739 - DNA, 20 bp, Artificial
  CRISPR gRNA sequence
cgatgaccacaactgctagg

SEQ ID NO: 2740 - DNA, 20 bp, Artificial
  CRISPR gRNA sequence
ctaggacagccaggccagca

SEQ ID NO: 2741 - DNA, 20 bp, Artificial
  CRISPR gRNA sequence
ggacagccaggccagcaaca

SEQ ID NO: 2742 - DNA, 20 bp, Artificial
  CRISPR gRNA sequence
ggaagacggctctgggaaag

SEQ ID NO: 2743 - DNA, 20 bp, Artificial
  CRISPR gRNA sequence
tgggaaaggaggggaagatg

SEQ ID NO: 2744 - DNA, 20 bp, Artificial
  CRISPR gRNA sequence
ggaaaggaggggaagatgag

SEQ ID NO: 2745 - DNA, 20 bp, Artificial
  CRISPR gRNA sequence
accctgctgaagggctcctg

SEQ ID NO: 2746 - DNA, 20 bp, Artificial
  CRISPR gRNA sequence
ctgaagggctcctgctttcc

SEQ ID NO: 2747 - DNA, 20 bp, Artificial
  CRISPR gRNA sequence
aagggctcctgctttccctg

SEQ ID NO: 2748 - DNA, 20 bp, Artificial
  CRISPR gRNA sequence
ctgctttccctgagaagaga

SEQ ID NO: 2749 - DNA, 20 bp, Artificial
  CRISPR gRNA sequence
ctttccctgagaagagatat

SEQ ID NO: 2750 - DNA, 20 bp, Artificial
  CRISPR gRNA sequence
tccctgagaagagatatgac

SEQ ID NO: 2751 - DNA, 20 bp, Artificial
  CRISPR gRNA sequence
ccctgagaagagatatgacc

SEQ ID NO: 2752 - DNA, 20 bp, Artificial
  CRISPR gRNA sequence
cctgagaagagatatgaccc

SEQ ID NO: 2753 - DNA, 20 bp, Artificial
  CRISPR gRNA sequence
agaagagatatgacccctca

SEQ ID NO: 2754 - DNA, 20 bp, Artificial
  CRISPR gRNA sequence
atccccctccttaccccatc

SEQ ID NO: 2755 - DNA, 20 bp, Artificial
  CRISPR gRNA sequence
cttaccccatctcagggtga

SEQ ID NO: 2756 - DNA, 20 bp, Artificial
  CRISPR gRNA sequence
accccatctcagggtgaggg

SEQ ID NO: 2757 - DNA, 20 bp, Artificial
  CRISPR gRNA sequence
ccccatctcagggtgagggg

SEQ ID NO: 2758 - DNA, 20 bp, Artificial
  CRISPR gRNA sequence
agggtgaggggcttcggcag

SEQ ID NO: 2759 - DNA, 20 bp, Artificial
  CRISPR gRNA sequence
cggcagcccctcatgctgta

SEQ ID NO: 2760 - DNA, 20 bp, Artificial
  CRISPR gRNA sequence
ggcagcccctcatgctgtac

SEQ ID NO: 2761 - DNA, 20 bp, Artificial
  CRISPR gRNA sequence
atgctgtacatggcatgtgt

SEQ ID NO: 2762 - DNA, 20 bp, Artificial
  CRISPR gRNA sequence
tacatggcatgtgtatctct

SEQ ID NO: 2763 - DNA, 20 bp, Artificial
  CRISPR gRNA sequence
tgctcttctccagaaggcac

SEQ ID NO: 2764 - DNA, 20 bp, Artificial
  CRISPR gRNA sequence
ctcttctccagaaggcacca

SEQ ID NO: 2765 - DNA, 20 bp, Artificial
  CRISPR gRNA sequence
ttctccagaaggcaccacca

SEQ ID NO: 2766 - DNA, 20 bp, Artificial
  CRISPR gRNA sequence
ctccagaaggcaccaccaca

SEQ ID NO: 2767 - DNA, 20 bp, Artificial
  CRISPR gRNA sequence
tccagaaggcaccaccacag

SEQ ID NO: 2768 - DNA, 20 bp, Artificial
  CRISPR gRNA sequence
cagaaggcaccaccacagct

SEQ ID NO: 2769 - DNA, 20 bp, Artificial
  CRISPR gRNA sequence
cccacttctggaaggttcta

SEQ ID NO: 2770 - DNA, 20 bp, Artificial
  CRISPR gRNA sequence
ctggaaggttctatctcctg

SEQ ID NO: 2771 - DNA, 20 bp, Artificial
  CRISPR gRNA sequence
tggaaggttctatctcctgc

SEQ ID NO: 2772 - DNA, 20 bp, Artificial
  CRISPR gRNA sequence
gaaggttctatctcctgctg

SEQ ID NO: 2773 - DNA, 20 bp, Artificial
  CRISPR gRNA sequence
tatctcctgctggtctggtc

SEQ ID NO: 2774 - DNA, 20 bp, Artificial
  CRISPR gRNA sequence
tctcctgctggtctggtctc

SEQ ID NO: 2775 - DNA, 20 bp, Artificial
  CRISPR gRNA sequence
ctgctggtctggtctccaca

SEQ ID NO: 2776 - DNA, 20 bp, Artificial
  CRISPR gRNA sequence
ctggtctggtctccacaagc

SEQ ID NO: 2777 - DNA, 20 bp, Artificial
  CRISPR gRNA sequence
gtctggtctccacaagctca

SEQ ID NO: 2778 - DNA, 20 bp, Artificial
  CRISPR gRNA sequence
gtctccacaagctcagtgtc

SEQ ID NO: 2779 - DNA, 20 bp, Artificial
  CRISPR gRNA sequence
cacaagctcagtgtcctgag

SEQ ID NO: 2780 - DNA, 20 bp, Artificial
  CRISPR gRNA sequence
agtgtcctgagtttggtcct

SEQ ID NO: 2781 - DNA, 20 bp, Artificial
  CRISPR gRNA sequence
agtttggtcctcgccatccc

SEQ ID NO: 2782 - DNA, 20 bp, Artificial
  CRISPR gRNA sequence
ggtcctcgccatcccgctgc

SEQ ID NO: 2783 - DNA, 20 bp, Artificial
  CRISPR gRNA sequence
gtcctcgccatcccgctgcc

SEQ ID NO: 2784 - DNA, 20 bp, Artificial
  CRISPR gRNA sequence
gccatcccgctgccaggtca

SEQ ID NO: 2785 - DNA, 20 bp, Artificial
  CRISPR gRNA sequence
ccaggtcagtgtgatctccg

SEQ ID NO: 2786 - DNA, 20 bp, Artificial
  CRISPR gRNA sequence
cgcagggtagaaacccaggg

SEQ ID NO: 2787 - DNA, 20 bp, Artificial
  CRISPR gRNA sequence
agggtggcctcatggtcaga

SEQ ID NO: 2788 - DNA, 20 bp, Artificial
  CRISPR gRNA sequence
atggtcagagatggggtggt

SEQ ID NO: 2789 - DNA, 20 bp, Artificial
  CRISPR gRNA sequence
tggggggtctgatgggaaga

SEQ ID NO: 2790 - DNA, 20 bp, Artificial
  CRISPR gRNA sequence
ggggggtctgatgggaagag

SEQ ID NO: 2791 - DNA, 20 bp, Artificial
  CRISPR gRNA sequence
gggggtctgatgggaagagt

SEQ ID NO: 2792 - DNA, 20 bp, Artificial
  CRISPR gRNA sequence
atgggaagagtcagaaaatt

SEQ ID NO: 2793 - DNA, 20 bp, Artificial
  CRISPR gRNA sequence
aggcgctttgcatctttcat

SEQ ID NO: 2794 - DNA, 20 bp, Artificial
  CRISPR gRNA sequence
tgcatctttcatgggacacc

SEQ ID NO: 2795 - DNA, 20 bp, Artificial
  CRISPR gRNA sequence
gcatctttcatgggacaccc

SEQ ID NO: 2796 - DNA, 20 bp, Artificial
  CRISPR gRNA sequence
catctttcatgggacaccct

SEQ ID NO: 2797 - DNA, 20 bp, Artificial
  CRISPR gRNA sequence
tcatgggacaccctaggacc

SEQ ID NO: 2798 - DNA, 20 bp, Artificial
  CRISPR gRNA sequence
catgggacaccctaggacca

SEQ ID NO: 2799 - DNA, 20 bp, Artificial
  CRISPR gRNA sequence
atgggacaccctaggaccac

SEQ ID NO: 2800 - DNA, 20 bp, Artificial
  CRISPR gRNA sequence
ggaccacccatgtgaccagc

SEQ ID NO: 2801 - DNA, 20 bp, Artificial
  CRISPR gRNA sequence
agaatggacaggacacctgg

SEQ ID NO: 2802 - DNA, 20 bp, Artificial
  CRISPR gRNA sequence
gggtggggaaggggcacaga

SEQ ID NO: 2803 - DNA, 20 bp, Artificial
  CRISPR gRNA sequence
gacgcaggcacctgggataa

SEQ ID NO: 2804 - DNA, 20 bp, Artificial
  CRISPR gRNA sequence
ggataatctcctattcattg

SEQ ID NO: 2805 - DNA, 20 bp, Artificial
  CRISPR gRNA sequence
ctattcattggaaagttcga

SEQ ID NO: 2806 - DNA, 20 bp, Artificial
  CRISPR gRNA sequence
ttcattggaaagttcgagtc

SEQ ID NO: 2807 - DNA, 20 bp, Artificial
  CRISPR gRNA sequence
attggaaagttcgagtctct

SEQ ID NO: 2808 - DNA, 20 bp, Artificial
  CRISPR gRNA sequence
gaaagttcgagtctctgagc

SEQ ID NO: 2809 - DNA, 20 bp, Artificial
  CRISPR gRNA sequence
gagtctctgagcggggaaca

SEQ ID NO: 2810 - DNA, 20 bp, Artificial
  CRISPR gRNA sequence
tgagcggggaacagggactt

SEQ ID NO: 2811 - DNA, 20 bp, Artificial
  CRISPR gRNA sequence
agcggggaacagggacttct

SEQ ID NO: 2812 - DNA, 20 bp, Artificial
  CRISPR gRNA sequence
ctgctcctgatctgagtgga

SEQ ID NO: 2813 - DNA, 20 bp, Artificial
  CRISPR gRNA sequence
tgctcctgatctgagtggag

SEQ ID NO: 2814 - DNA, 20 bp, Artificial
  CRISPR gRNA sequence
ctcctgatctgagtggaggt

SEQ ID NO: 2815 - DNA, 20 bp, Artificial
  CRISPR gRNA sequence
ctgatctgagtggaggtaaa

SEQ ID NO: 2816 - DNA, 20 bp, Artificial
  CRISPR gRNA sequence
atctgagtggaggtaaagtg

SEQ ID NO: 2817 - DNA, 20 bp, Artificial
  CRISPR gRNA sequence
agtggaggtaaagtgactca

SEQ ID NO: 2818 - DNA, 20 bp, Artificial
  CRISPR gRNA sequence
agaagtgctggaatcagagc

SEQ ID NO: 2819 - DNA, 20 bp, Artificial
  CRISPR gRNA sequence
gaatcagagccccaaacaca

SEQ ID NO: 2820 - DNA, 20 bp, Artificial
  CRISPR gRNA sequence
agtgtgaggcagagaacaag

SEQ ID NO: 2821 - DNA, 20 bp, Artificial
  CRISPR gRNA sequence
agaggaaaagtcacggttcc

SEQ ID NO: 2822 - DNA, 20 bp, Artificial
  CRISPR gRNA sequence
ccaaggctgctgcaggggtc

SEQ ID NO: 2823 - DNA, 20 bp, Artificial
  CRISPR gRNA sequence
ctgcaggggtcaaaggggac

SEQ ID NO: 2824 - DNA, 20 bp, Artificial
  CRISPR gRNA sequence
caggggtcaaaggggacccc

SEQ ID NO: 2825 - DNA, 20 bp, Artificial
  CRISPR gRNA sequence
atcagtattctagggactgt

SEQ ID NO: 2826 - DNA, 20 bp, Artificial
  CRISPR gRNA sequence
tagggactgtcttcccctcc

SEQ ID NO: 2827 - DNA, 20 bp, Artificial
  CRISPR gRNA sequence
gggactgtcttcccctccat

SEQ ID NO: 2828 - DNA, 20 bp, Artificial
  CRISPR gRNA sequence
tcttcccctccatttcctca

SEQ ID NO: 2829 - DNA, 20 bp, Artificial
  CRISPR gRNA sequence
cccctccatttcctcagaga

SEQ ID NO: 2830 - DNA, 20 bp, Artificial
  CRISPR gRNA sequence
ccctccatttcctcagagac

SEQ ID NO: 2831 - DNA, 20 bp, Artificial
  CRISPR gRNA sequence
catttcctcagagacgtcat

SEQ ID NO: 2832 - DNA, 20 bp, Artificial
  CRISPR gRNA sequence
cctcagagacgtcattcctt

SEQ ID NO: 2833 - DNA, 20 bp, Artificial
  CRISPR gRNA sequence
ctcagagacgtcattcctta

SEQ ID NO: 2834 - DNA, 20 bp, Artificial
  CRISPR gRNA sequence
agagacgtcattccttaatt

SEQ ID NO: 2835 - DNA, 20 bp, Artificial
  CRISPR gRNA sequence
cttaattgtctagagagaag

SEQ ID NO: 2836 - DNA, 20 bp, Artificial
  CRISPR gRNA sequence
aattgtctagagagaagagg

SEQ ID NO: 2837 - DNA, 20 bp, Artificial
  CRISPR gRNA sequence
attgtctagagagaagaggg

SEQ ID NO: 2838 - DNA, 20 bp, Artificial
  CRISPR gRNA sequence
tctagagagaagagggggcc

SEQ ID NO: 2839 - DNA, 20 bp, Artificial
  CRISPR gRNA sequence
gagagaagagggggccctca

SEQ ID NO: 2840 - DNA, 20 bp, Artificial
  CRISPR gRNA sequence
agaggaaactcaggaaaact

SEQ ID NO: 2841 - DNA, 20 bp, Artificial
  CRISPR gRNA sequence
aggaaaactcatgccattct

SEQ ID NO: 2842 - DNA, 20 bp, Artificial
  CRISPR gRNA sequence
atgccattctccattcaacg

SEQ ID NO: 2843 - DNA, 20 bp, Artificial
  CRISPR gRNA sequence
tccattcaacggagggcgac

SEQ ID NO: 2844 - DNA, 20 bp, Artificial
  CRISPR gRNA sequence
cattcaacggagggcgacat

SEQ ID NO: 2845 - DNA, 20 bp, Artificial
  CRISPR gRNA sequence
aacggagggcgacattctag

SEQ ID NO: 2846 - DNA, 20 bp, Artificial
  CRISPR gRNA sequence
tagcgctgatcccattttcc

SEQ ID NO: 2847 - DNA, 20 bp, Artificial
  CRISPR gRNA sequence
gcgctgatcccattttcctc

SEQ ID NO: 2848 - DNA, 20 bp, Artificial
  CRISPR gRNA sequence
atcccattttcctcctcttc

SEQ ID NO: 2849 - DNA, 20 bp, Artificial
  CRISPR gRNA sequence
tcctcctcttctcgtgggag

SEQ ID NO: 2850 - DNA, 20 bp, Artificial
  CRISPR gRNA sequence
cctcctcttctcgtgggagg

SEQ ID NO: 2851 - DNA, 20 bp, Artificial
  CRISPR gRNA sequence
ctcctcttctcgtgggaggc

SEQ ID NO: 2852 - DNA, 20 bp, Artificial
  CRISPR gRNA sequence
ctcttctcgtgggaggccat

SEQ ID NO: 2853 - DNA, 20 bp, Artificial
  CRISPR gRNA sequence
ttctcgtgggaggccatccc

SEQ ID NO: 2854 - DNA, 20 bp, Artificial
  CRISPR gRNA sequence
ctcgtgggaggccatccccg

SEQ ID NO: 2855 - DNA, 20 bp, Artificial
  CRISPR gRNA sequence
tcgtgggaggccatccccgg

SEQ ID NO: 2856 - DNA, 20 bp, Artificial
  CRISPR gRNA sequence
gtgggaggccatccccggcg

SEQ ID NO: 2857 - DNA, 20 bp, Artificial
  CRISPR gRNA sequence
taggagatggggaaggctcc

SEQ ID NO: 2858 - DNA, 20 bp, Artificial
  CRISPR gRNA sequence
cccactgcccctggtaccag

SEQ ID NO: 2859 - DNA, 20 bp, Artificial
  CRISPR gRNA sequence
cccctggtaccagcgcgctc

SEQ ID NO: 2860 - DNA, 20 bp, Artificial
  CRISPR gRNA sequence
gtaccagcgcgctccagctt

SEQ ID NO: 2861 - DNA, 20 bp, Artificial
  CRISPR gRNA sequence
cagcttgtccttcccgttct

SEQ ID NO: 2862 - DNA, 20 bp, Artificial
  CRISPR gRNA sequence
gtccttcccgttctccaggt

SEQ ID NO: 2863 - DNA, 20 bp, Artificial
  CRISPR gRNA sequence
tccttcccgttctccaggta

SEQ ID NO: 2864 - DNA, 20 bp, Artificial
  CRISPR gRNA sequence
cccgttctccaggtatctgc

SEQ ID NO: 2865 - DNA, 20 bp, Artificial
  CRISPR gRNA sequence
ccgttctccaggtatctgcg

SEQ ID NO: 2866 - DNA, 20 bp, Artificial
  CRISPR gRNA sequence
tccaggtatctgcggagcca

SEQ ID NO: 2867 - DNA, 20 bp, Artificial
  CRISPR gRNA sequence
caggtatctgcggagccact

SEQ ID NO: 2868 - DNA, 20 bp, Artificial
  CRISPR gRNA sequence
cggagccactccacgcactc

SEQ ID NO: 2869 - DNA, 20 bp, Artificial
  CRISPR gRNA sequence
cacgcactcgccctccaggt

SEQ ID NO: 2870 - DNA, 20 bp, Artificial
  CRISPR gRNA sequence
gccctccaggtaggctctcc

SEQ ID NO: 2871 - DNA, 20 bp, Artificial
  CRISPR gRNA sequence
caggtaggctctccgctgct

SEQ ID NO: 2872 - DNA, 20 bp, Artificial
  CRISPR gRNA sequence
tccgctgctccgcctcacgg

SEQ ID NO: 2873 - DNA, 20 bp, Artificial
  CRISPR gRNA sequence
cgctgctccgcctcacgggc

SEQ ID NO: 2874 - DNA, 20 bp, Artificial
  CRISPR gRNA sequence
ctccgcctcacgggccgcct

SEQ ID NO: 2875 - DNA, 20 bp, Artificial
  CRISPR gRNA sequence
cgcctcacgggccgcctccc

SEQ ID NO: 2876 - DNA, 20 bp, Artificial
  CRISPR gRNA sequence
acgggccgcctcccacttgc

SEQ ID NO: 2877 - DNA, 20 bp, Artificial
  CRISPR gRNA sequence
ccacttgcgctgggtgatct

SEQ ID NO: 2878 - DNA, 20 bp, Artificial
  CRISPR gRNA sequence
gcgctgggtgatctgagccg

SEQ ID NO: 2879 - DNA, 20 bp, Artificial
  CRISPR gRNA sequence
cgctgggtgatctgagccgc

SEQ ID NO: 2880 - DNA, 20 bp, Artificial
  CRISPR gRNA sequence
ggtgatctgagccgccgtgt

SEQ ID NO: 2881 - DNA, 20 bp, Artificial
  CRISPR gRNA sequence
agccgccgtgtccgcggcgg

SEQ ID NO: 2882 - DNA, 20 bp, Artificial
  CRISPR gRNA sequence
gttcagggcgatgtaatcct

SEQ ID NO: 2883 - DNA, 20 bp, Artificial
  CRISPR gRNA sequence
agggcgatgtaatccttgcc

SEQ ID NO: 2884 - DNA, 20 bp, Artificial
  CRISPR gRNA sequence
gccgtcgtaggcgtactggt

SEQ ID NO: 2885 - DNA, 20 bp, Artificial
  CRISPR gRNA sequence
ccgtcgtaggcgtactggtc

SEQ ID NO: 2886 - DNA, 20 bp, Artificial
  CRISPR gRNA sequence
gtcatgcccgcggaggaggc

SEQ ID NO: 2887 - DNA, 20 bp, Artificial
  CRISPR gRNA sequence
tggagggtgtgagaccctgg

SEQ ID NO: 2888 - DNA, 20 bp, Artificial
  CRISPR gRNA sequence
gagggtgtgagaccctggcc

SEQ ID NO: 2889 - DNA, 20 bp, Artificial
  CRISPR gRNA sequence
gccccggccccgcggtcagc

SEQ ID NO: 2890 - DNA, 20 bp, Artificial
  CRISPR gRNA sequence
tggcctcaactgaaaatgaa

SEQ ID NO: 2891 - DNA, 20 bp, Artificial
  CRISPR gRNA sequence
ggcctcaactgaaaatgaaa

SEQ ID NO: 2892 - DNA, 20 bp, Artificial
  CRISPR gRNA sequence
gcctcaactgaaaatgaaac

SEQ ID NO: 2893 - DNA, 20 bp, Artificial
  CRISPR gRNA sequence
aactgaaaatgaaaccgggt

SEQ ID NO: 2894 - DNA, 20 bp, Artificial
  CRISPR gRNA sequence
aaaatgaaaccgggtaaacg

SEQ ID NO: 2895 - DNA, 20 bp, Artificial
  CRISPR gRNA sequence
gggctctcgccggtcgaggg

SEQ ID NO: 2896 - DNA, 20 bp, Artificial
  CRISPR gRNA sequence
tcgccggtcgagggtctggg

SEQ ID NO: 2897 - DNA, 20 bp, Artificial
  CRISPR gRNA sequence
gccggtcgagggtctgggcg

SEQ ID NO: 2898 - DNA, 20 bp, Artificial
  CRISPR gRNA sequence
ggcgggtcccgcggcctcag

SEQ ID NO: 2899 - DNA, 20 bp, Artificial
  CRISPR gRNA sequence
agggaggcggatctcggacc

SEQ ID NO: 2900 - DNA, 20 bp, Artificial
  CRISPR gRNA sequence
ggacccggagactcggggcg

SEQ ID NO: 2901 - DNA, 20 bp, Artificial
  CRISPR gRNA sequence
ggggcgacccgggccgtacg

SEQ ID NO: 2902 - DNA, 20 bp, Artificial
  CRISPR gRNA sequence
cgccccgggccggggtcact

SEQ ID NO: 2903 - DNA, 20 bp, Artificial
  CRISPR gRNA sequence
accggcctcgctctggttgt

SEQ ID NO: 2904 - DNA, 20 bp, Artificial
  CRISPR gRNA sequence
gctctggttgtagtagccgc

SEQ ID NO: 2905 - DNA, 20 bp, Artificial
  CRISPR gRNA sequence
tggttgtagtagccgcgcag

SEQ ID NO: 2906 - DNA, 20 bp, Artificial
  CRISPR gRNA sequence
gttgtagtagccgcgcaggt

SEQ ID NO: 2907 - DNA, 20 bp, Artificial
  CRISPR gRNA sequence
tagtagccgcgcaggttccg

SEQ ID NO: 2908 - DNA, 20 bp, Artificial
  CRISPR gRNA sequence
cgcaggctctctcggtcagt

SEQ ID NO: 2909 - DNA, 20 bp, Artificial
  CRISPR gRNA sequence
tctcggtcagtctgtgcctg

SEQ ID NO: 2910 - DNA, 20 bp, Artificial
  CRISPR gRNA sequence
tcggtcagtctgtgcctggg

SEQ ID NO: 2911 - DNA, 20 bp, Artificial
  CRISPR gRNA sequence
ggtcagtctgtgcctgggcc

SEQ ID NO: 2912 - DNA, 20 bp, Artificial
  CRISPR gRNA sequence
tgcctgggccttgtagatct

SEQ ID NO: 2913 - DNA, 20 bp, Artificial
  CRISPR gRNA sequence
ggccttgtagatctgtgtgt

SEQ ID NO: 2914 - DNA, 20 bp, Artificial
  CRISPR gRNA sequence
gtagatctgtgtgttccggt

SEQ ID NO: 2915 - DNA, 20 bp, Artificial
  CRISPR gRNA sequence
tagatctgtgtgttccggtc

SEQ ID NO: 2916 - DNA, 20 bp, Artificial
  CRISPR gRNA sequence
tgtgttccggtcccaatact

SEQ ID NO: 2917 - DNA, 20 bp, Artificial
  CRISPR gRNA sequence
cggtcccaatactccggccc

SEQ ID NO: 2918 - DNA, 20 bp, Artificial
  CRISPR gRNA sequence
cggcccctcctgctctatcc

SEQ ID NO: 2919 - DNA, 20 bp, Artificial
  CRISPR gRNA sequence
ctgctctatccacggcgccc

SEQ ID NO: 2920 - DNA, 20 bp, Artificial
  CRISPR gRNA sequence
ctctatccacggcgcccgcg

SEQ ID NO: 2921 - DNA, 20 bp, Artificial
  CRISPR gRNA sequence
tatccacggcgcccgcggct

SEQ ID NO: 2922 - DNA, 20 bp, Artificial
  CRISPR gRNA sequence
tccacggcgcccgcggctcc

SEQ ID NO: 2923 - DNA, 20 bp, Artificial
  CRISPR gRNA sequence
ctctctcggactcgcggcgt

SEQ ID NO: 2924 - DNA, 20 bp, Artificial
  CRISPR gRNA sequence
tctcggactcgcggcgtcgc

SEQ ID NO: 2925 - DNA, 20 bp, Artificial
  CRISPR gRNA sequence
tcggactcgcggcgtcgctg

SEQ ID NO: 2926 - DNA, 20 bp, Artificial
  CRISPR gRNA sequence
ggactcgcggcgtcgctgtc

SEQ ID NO: 2927 - DNA, 20 bp, Artificial
  CRISPR gRNA sequence
gcggcgtcgctgtcgaacct

SEQ ID NO: 2928 - DNA, 20 bp, Artificial
  CRISPR gRNA sequence
tcgaacctcacgaactgggt

SEQ ID NO: 2929 - DNA, 20 bp, Artificial
  CRISPR gRNA sequence
acgaactgggtgtcgtccac

SEQ ID NO: 2930 - DNA, 20 bp, Artificial
  CRISPR gRNA sequence
ggtgtcgtccacgtagccca

SEQ ID NO: 2931 - DNA, 20 bp, Artificial
  CRISPR gRNA sequence
agatgaagcggggctccccg

SEQ ID NO: 2932 - DNA, 20 bp, Artificial
  CRISPR gRNA sequence
cccgcggccgggccgggaca

SEQ ID NO: 2933 - DNA, 20 bp, Artificial
  CRISPR gRNA sequence
atggagtgggagcctggggg

SEQ ID NO: 2934 - DNA, 20 bp, Artificial
  CRISPR gRNA sequence
ggggtgaggaggggctgaga

SEQ ID NO: 2935 - DNA, 20 bp, Artificial
  CRISPR gRNA sequence
agacccgcccgaccctcctc

SEQ ID NO: 2936 - DNA, 20 bp, Artificial
  CRISPR gRNA sequence
ctcccggcgcggctcctcag

SEQ ID NO: 2937 - DNA, 20 bp, Artificial
  CRISPR gRNA sequence
ccggcgcggctcctcaggtc

SEQ ID NO: 2938 - DNA, 20 bp, Artificial
  CRISPR gRNA sequence
ctcaggtcctgcgcccccgc

SEQ ID NO: 2939 - DNA, 20 bp, Artificial
  CRISPR gRNA sequence
aggtcctgcgcccccgcctg

SEQ ID NO: 2940 - DNA, 20 bp, Artificial
  CRISPR gRNA sequence
cgcccccgcctgcggtcccc

SEQ ID NO: 2941 - DNA, 20 bp, Artificial
  CRISPR gRNA sequence
cggtcccctcgctcctcccg

SEQ ID NO: 2942 - DNA, 20 bp, Artificial
  CRISPR gRNA sequence
gctcctcccggcagaggcca

SEQ ID NO: 2943 - DNA, 20 bp, Artificial
  CRISPR gRNA sequence
ctcccggcagaggccatttc

SEQ ID NO: 2944 - DNA, 20 bp, Artificial
  CRISPR gRNA sequence
ccggcagaggccatttccct

SEQ ID NO: 2945 - DNA, 20 bp, Artificial
  CRISPR gRNA sequence
ccctcccgacccgcactcac

SEQ ID NO: 2946 - DNA, 20 bp, Artificial
  CRISPR gRNA sequence
cctcccgacccgcactcacc

SEQ ID NO: 2947 - DNA, 20 bp, Artificial
  CRISPR gRNA sequence
ccgacccgcactcaccggcc

SEQ ID NO: 2948 - DNA, 20 bp, Artificial
  CRISPR gRNA sequence
accggcccaggtctcggtca

SEQ ID NO: 2949 - DNA, 20 bp, Artificial
  CRISPR gRNA sequence
ggtcagggccagggccgccg

SEQ ID NO: 2950 - DNA, 20 bp, Artificial
  CRISPR gRNA sequence
ggggcgccatgaccagcatc

SEQ ID NO: 2951 - DNA, 20 bp, Artificial
  CRISPR gRNA sequence
ggcgtctgaggagactctga

SEQ ID NO: 2952 - DNA, 20 bp, Artificial
  CRISPR gRNA sequence
aggagactctgagtccgggt

SEQ ID NO: 2953 - DNA, 20 bp, Artificial
  CRISPR gRNA sequence
tgagtccgggtgggtgcgtg

SEQ ID NO: 2954 - DNA, 20 bp, Artificial
  CRISPR gRNA sequence
agtccgggtgggtgcgtggg

SEQ ID NO: 2955 - DNA, 20 bp, Artificial
  CRISPR gRNA sequence
tagaactgggaccgcggcga

SEQ ID NO: 2956 - DNA, 20 bp, Artificial
  CRISPR gRNA sequence
agaactgggaccgcggcgac

SEQ ID NO: 2957 - DNA, 20 bp, Artificial
  CRISPR gRNA sequence
gaactgggaccgcggcgacg

SEQ ID NO: 2958 - DNA, 20 bp, Artificial
  CRISPR gRNA sequence
ggaccgcggcgacgctgatt

SEQ ID NO: 2959 - DNA, 20 bp, Artificial
  CRISPR gRNA sequence
attggcttctctagatatcc

SEQ ID NO: 2960 - DNA, 20 bp, Artificial
  CRISPR gRNA sequence
gcttctctagatatccaata

SEQ ID NO: 2961 - DNA, 20 bp, Artificial
  CRISPR gRNA sequence
ctctagatatccaataccca

SEQ ID NO: 2962 - DNA, 20 bp, Artificial
  CRISPR gRNA sequence
gatatctagagaagccaatc

SEQ ID NO: 2963 - DNA, 20 bp, Artificial
  CRISPR gRNA sequence
gagaagccaatcagcgtcgc

SEQ ID NO: 2964 - DNA, 20 bp, Artificial
  CRISPR gRNA sequence
taaagtccccacgcacccac

SEQ ID NO: 2965 - DNA, 20 bp, Artificial
  CRISPR gRNA sequence
aagtccccacgcacccaccc

SEQ ID NO: 2966 - DNA, 20 bp, Artificial
  CRISPR gRNA sequence
agagtctcctcagacgccga

SEQ ID NO: 2967 - DNA, 20 bp, Artificial
  CRISPR gRNA sequence
ctcagacgccgagatgctgg

SEQ ID NO: 2968 - DNA, 20 bp, Artificial
  CRISPR gRNA sequence
agacgccgagatgctggtca

SEQ ID NO: 2969 - DNA, 20 bp, Artificial
  CRISPR gRNA sequence
gtcatggcgccccgaaccgt

SEQ ID NO: 2970 - DNA, 20 bp, Artificial
  CRISPR gRNA sequence
ctgctgctctcggcggccct

SEQ ID NO: 2971 - DNA, 20 bp, Artificial
  CRISPR gRNA sequence
ctgctctcggcggccctggc

SEQ ID NO: 2972 - DNA, 20 bp, Artificial
  CRISPR gRNA sequence
ctctcggcggccctggccct

SEQ ID NO: 2973 - DNA, 20 bp, Artificial
  CRISPR gRNA sequence
tcggcggccctggccctgac

SEQ ID NO: 2974 - DNA, 20 bp, Artificial
  CRISPR gRNA sequence
ggcggccctggccctgaccg

SEQ ID NO: 2975 - DNA, 20 bp, Artificial
  CRISPR gRNA sequence
gccctgaccgagacctgggc

SEQ ID NO: 2976 - DNA, 20 bp, Artificial
  CRISPR gRNA sequence
accgagacctgggccggtga

SEQ ID NO: 2977 - DNA, 20 bp, Artificial
  CRISPR gRNA sequence
ggccggtgagtgcgggtcgg

SEQ ID NO: 2978 - DNA, 20 bp, Artificial
  CRISPR gRNA sequence
tgccgggaggagcgagggga

SEQ ID NO: 2979 - DNA, 20 bp, Artificial
  CRISPR gRNA sequence
ccgggaggagcgaggggacc

SEQ ID NO: 2980 - DNA, 20 bp, Artificial
  CRISPR gRNA sequence
aggagccgcgccgggaggag

SEQ ID NO: 2981 - DNA, 20 bp, Artificial
  CRISPR gRNA sequence
agcccctcctcacccccagg

SEQ ID NO: 2982 - DNA, 20 bp, Artificial
  CRISPR gRNA sequence
ctcacccccaggctcccact

SEQ ID NO: 2983 - DNA, 20 bp, Artificial
  CRISPR gRNA sequence
acccccaggctcccactcca

SEQ ID NO: 2984 - DNA, 20 bp, Artificial
  CRISPR gRNA sequence
ccactccatgaggtatttct

SEQ ID NO: 2985 - DNA, 20 bp, Artificial
  CRISPR gRNA sequence
catgaggtatttctacacct

SEQ ID NO: 2986 - DNA, 20 bp, Artificial
  CRISPR gRNA sequence
ctacacctccgtgtcccggc

SEQ ID NO: 2987 - DNA, 20 bp, Artificial
  CRISPR gRNA sequence
tacacctccgtgtcccggcc

SEQ ID NO: 2988 - DNA, 20 bp, Artificial
  CRISPR gRNA sequence
cacctccgtgtcccggcccg

SEQ ID NO: 2989 - DNA, 20 bp, Artificial
  CRISPR gRNA sequence
cgtgtcccggcccggccgcg

SEQ ID NO: 2990 - DNA, 20 bp, Artificial
  CRISPR gRNA sequence
catctcagtgggctacgtgg

SEQ ID NO: 2991 - DNA, 20 bp, Artificial
  CRISPR gRNA sequence
atctcagtgggctacgtgga

SEQ ID NO: 2992 - DNA, 20 bp, Artificial
  CRISPR gRNA sequence
agtgggctacgtggacgaca

SEQ ID NO: 2993 - DNA, 20 bp, Artificial
  CRISPR gRNA sequence
cgtggacgacacccagttcg

SEQ ID NO: 2994 - DNA, 20 bp, Artificial
  CRISPR gRNA sequence
gtgaggttcgacagcgacgc

SEQ ID NO: 2995 - DNA, 20 bp, Artificial
  CRISPR gRNA sequence
gacagcgacgccgcgagtcc

SEQ ID NO: 2996 - DNA, 20 bp, Artificial
  CRISPR gRNA sequence
ggaccggaacacacagatct

SEQ ID NO: 2997 - DNA, 20 bp, Artificial
  CRISPR gRNA sequence
caaggcccaggcacagactg

SEQ ID NO: 2998 - DNA, 20 bp, Artificial
  CRISPR gRNA sequence
accgagagagcctgcggaac

SEQ ID NO: 2999 - DNA, 20 bp, Artificial
  CRISPR gRNA sequence
cggaacctgcgcggctacta

SEQ ID NO: 3000 - DNA, 20 bp, Artificial
  CRISPR gRNA sequence
cgcggctactacaaccagag

SEQ ID NO: 3001 - DNA, 20 bp, Artificial
  CRISPR gRNA sequence
ctacaaccagagcgaggccg

SEQ ID NO: 3002 - DNA, 20 bp, Artificial
  CRISPR gRNA sequence
caaccagagcgaggccggtg

SEQ ID NO: 3003 - DNA, 20 bp, Artificial
  CRISPR gRNA sequence
cccatcccccacgtacggcc

SEQ ID NO: 3004 - DNA, 20 bp, Artificial
  CRISPR gRNA sequence
cgggtccgagatccgcctcc

SEQ ID NO: 3005 - DNA, 20 bp, Artificial
  CRISPR gRNA sequence
cctgaggccgcgggacccgc

SEQ ID NO: 3006 - DNA, 20 bp, Artificial
  CRISPR gRNA sequence
aggccgcgggacccgcccag

SEQ ID NO: 3007 - DNA, 20 bp, Artificial
  CRISPR gRNA sequence
gaccggcgagagccccaggc

SEQ ID NO: 3008 - DNA, 20 bp, Artificial
  CRISPR gRNA sequence
acccggtttcattttcagtt

SEQ ID NO: 3009 - DNA, 20 bp, Artificial
  CRISPR gRNA sequence
cccggtttcattttcagttg

SEQ ID NO: 3010 - DNA, 20 bp, Artificial
  CRISPR gRNA sequence
cattttcagttgaggccaaa

SEQ ID NO: 3011 - DNA, 20 bp, Artificial
  CRISPR gRNA sequence
attttcagttgaggccaaaa

SEQ ID NO: 3012 - DNA, 20 bp, Artificial
  CRISPR gRNA sequence
tcagttgaggccaaaatccc

SEQ ID NO: 3013 - DNA, 20 bp, Artificial
  CRISPR gRNA sequence
cagttgaggccaaaatcccc

SEQ ID NO: 3014 - DNA, 20 bp, Artificial
  CRISPR gRNA sequence
agttgaggccaaaatccccg

SEQ ID NO: 3015 - DNA, 20 bp, Artificial
  CRISPR gRNA sequence
aggccaaaatccccgcgggt

SEQ ID NO: 3016 - DNA, 20 bp, Artificial
  CRISPR gRNA sequence
gtcggggcggggcggggctc

SEQ ID NO: 3017 - DNA, 20 bp, Artificial
  CRISPR gRNA sequence
gggggactgggctgaccgcg

SEQ ID NO: 3018 - DNA, 20 bp, Artificial
  CRISPR gRNA sequence
ggctgaccgcggggccgggg

SEQ ID NO: 3019 - DNA, 20 bp, Artificial
  CRISPR gRNA sequence
accgcggggccggggccagg

SEQ ID NO: 3020 - DNA, 20 bp, Artificial
  CRISPR gRNA sequence
acaccctccagagcatgtac

SEQ ID NO: 3021 - DNA, 20 bp, Artificial
  CRISPR gRNA sequence
cagagcatgtacggctgcga

SEQ ID NO: 3022 - DNA, 20 bp, Artificial
  CRISPR gRNA sequence
cgacgtggggccggacgggc

SEQ ID NO: 3023 - DNA, 20 bp, Artificial
  CRISPR gRNA sequence
ctccgcgggcatgaccagta

SEQ ID NO: 3024 - DNA, 20 bp, Artificial
  CRISPR gRNA sequence
cgcgggcatgaccagtacgc

SEQ ID NO: 3025 - DNA, 20 bp, Artificial
  CRISPR gRNA sequence
cgacggcaaggattacatcg

SEQ ID NO: 3026 - DNA, 20 bp, Artificial
  CRISPR gRNA sequence
catcgccctgaacgaggacc

SEQ ID NO: 3027 - DNA, 20 bp, Artificial
  CRISPR gRNA sequence
aacgaggacctgcgctcctg

SEQ ID NO: 3028 - DNA, 20 bp, Artificial
  CRISPR gRNA sequence
cgctcctggaccgccgcgga

SEQ ID NO: 3029 - DNA, 20 bp, Artificial
  CRISPR gRNA sequence
ctggaccgccgcggacacgg

SEQ ID NO: 3030 - DNA, 20 bp, Artificial
  CRISPR gRNA sequence
gaccgccgcggacacggcgg

SEQ ID NO: 3031 - DNA, 20 bp, Artificial
  CRISPR gRNA sequence
agatcacccagcgcaagtgg

SEQ ID NO: 3032 - DNA, 20 bp, Artificial
  CRISPR gRNA sequence
cctggagggcgagtgcgtgg

SEQ ID NO: 3033 - DNA, 20 bp, Artificial
  CRISPR gRNA sequence
gagggcgagtgcgtggagtg

SEQ ID NO: 3034 - DNA, 20 bp, Artificial
  CRISPR gRNA sequence
cgcagatacctggagaacgg

SEQ ID NO: 3035 - DNA, 20 bp, Artificial
  CRISPR gRNA sequence
gagaacgggaaggacaagct

SEQ ID NO: 3036 - DNA, 20 bp, Artificial
  CRISPR gRNA sequence
gagcgcgctggtaccagggg

SEQ ID NO: 3037 - DNA, 20 bp, Artificial
  CRISPR gRNA sequence
gtaccaggggcagtggggag

SEQ ID NO: 3038 - DNA, 20 bp, Artificial
  CRISPR gRNA sequence
ccccatctcctataggtcgc

SEQ ID NO: 3039 - DNA, 20 bp, Artificial
  CRISPR gRNA sequence
cccatctcctataggtcgcc

SEQ ID NO: 3040 - DNA, 20 bp, Artificial
  CRISPR gRNA sequence
ctataggtcgccggggatgg

SEQ ID NO: 3041 - DNA, 20 bp, Artificial
  CRISPR gRNA sequence
taggtcgccggggatggcct

SEQ ID NO: 3042 - DNA, 20 bp, Artificial
  CRISPR gRNA sequence
ccacgagaagaggaggaaaa

SEQ ID NO: 3043 - DNA, 20 bp, Artificial
  CRISPR gRNA sequence
gaatgtcgccctccgttgaa

SEQ ID NO: 3044 - DNA, 20 bp, Artificial
  CRISPR gRNA sequence
cgttgaatggagaatggcat

SEQ ID NO: 3045 - DNA, 20 bp, Artificial
  CRISPR gRNA sequence
aatggagaatggcatgagtt

SEQ ID NO: 3046 - DNA, 20 bp, Artificial
  CRISPR gRNA sequence
tcctgagtttcctctgaggg

SEQ ID NO: 3047 - DNA, 20 bp, Artificial
  CRISPR gRNA sequence
cctgagtttcctctgagggc

SEQ ID NO: 3048 - DNA, 20 bp, Artificial
  CRISPR gRNA sequence
ctgagtttcctctgagggcc

SEQ ID NO: 3049 - DNA, 20 bp, Artificial
  CRISPR gRNA sequence
agtttcctctgagggccccc

SEQ ID NO: 3050 - DNA, 20 bp, Artificial
  CRISPR gRNA sequence
cctctgagggccccctcttc

SEQ ID NO: 3051 - DNA, 20 bp, Artificial
  CRISPR gRNA sequence
ctctgagggccccctcttct

SEQ ID NO: 3052 - DNA, 20 bp, Artificial
  CRISPR gRNA sequence
tgagggccccctcttctctc

SEQ ID NO: 3053 - DNA, 20 bp, Artificial
  CRISPR gRNA sequence
agggccccctcttctctcta

SEQ ID NO: 3054 - DNA, 20 bp, Artificial
  CRISPR gRNA sequence
ttctctctagacaattaagg

SEQ ID NO: 3055 - DNA, 20 bp, Artificial
  CRISPR gRNA sequence
ctctctagacaattaaggaa

SEQ ID NO: 3056 - DNA, 20 bp, Artificial
  CRISPR gRNA sequence
tctctagacaattaaggaat

SEQ ID NO: 3057 - DNA, 20 bp, Artificial
  CRISPR gRNA sequence
tctagacaattaaggaatga

SEQ ID NO: 3058 - DNA, 20 bp, Artificial
  CRISPR gRNA sequence
tagacaattaaggaatgacg

SEQ ID NO: 3059 - DNA, 20 bp, Artificial
  CRISPR gRNA sequence
gacaattaaggaatgacgtc

SEQ ID NO: 3060 - DNA, 20 bp, Artificial
  CRISPR gRNA sequence
aggaatgacgtctctgagga

SEQ ID NO: 3061 - DNA, 20 bp, Artificial
  CRISPR gRNA sequence
tgaggaaatggaggggaaga

SEQ ID NO: 3062 - DNA, 20 bp, Artificial
  CRISPR gRNA sequence
aggaaatggaggggaagaca

SEQ ID NO: 3063 - DNA, 20 bp, Artificial
  CRISPR gRNA sequence
gaatactgatcaggggtccc

SEQ ID NO: 3064 - DNA, 20 bp, Artificial
  CRISPR gRNA sequence
atcaggggtcccctttgacc

SEQ ID NO: 3065 - DNA, 20 bp, Artificial
  CRISPR gRNA sequence
tgacccctgcagcagccttg

SEQ ID NO: 3066 - DNA, 20 bp, Artificial
  CRISPR gRNA sequence
gacccctgcagcagccttgg

SEQ ID NO: 3067 - DNA, 20 bp, Artificial
  CRISPR gRNA sequence
acccctgcagcagccttggg

SEQ ID NO: 3068 - DNA, 20 bp, Artificial
  CRISPR gRNA sequence
cagcagccttgggaaccgtg

SEQ ID NO: 3069 - DNA, 20 bp, Artificial
  CRISPR gRNA sequence
gggaaccgtgacttttcctc

SEQ ID NO: 3070 - DNA, 20 bp, Artificial
  CRISPR gRNA sequence
ggaaccgtgacttttcctct

SEQ ID NO: 3071 - DNA, 20 bp, Artificial
  CRISPR gRNA sequence
ttcctctcaggccttgttct

SEQ ID NO: 3072 - DNA, 20 bp, Artificial
  CRISPR gRNA sequence
tcctctcaggccttgttctc

SEQ ID NO: 3073 - DNA, 20 bp, Artificial
  CRISPR gRNA sequence
cctctcaggccttgttctct

SEQ ID NO: 3074 - DNA, 20 bp, Artificial
  CRISPR gRNA sequence
ctctcaggccttgttctctg

SEQ ID NO: 3075 - DNA, 20 bp, Artificial
  CRISPR gRNA sequence
tcaggccttgttctctgcct

SEQ ID NO: 3076 - DNA, 20 bp, Artificial
  CRISPR gRNA sequence
aggccttgttctctgcctca

SEQ ID NO: 3077 - DNA, 20 bp, Artificial
  CRISPR gRNA sequence
gttctctgcctcacactcag

SEQ ID NO: 3078 - DNA, 20 bp, Artificial
  CRISPR gRNA sequence
ttctctgcctcacactcagt

SEQ ID NO: 3079 - DNA, 20 bp, Artificial
  CRISPR gRNA sequence
tctgcctcacactcagtgtg

SEQ ID NO: 3080 - DNA, 20 bp, Artificial
  CRISPR gRNA sequence
tgcctcacactcagtgtgtt

SEQ ID NO: 3081 - DNA, 20 bp, Artificial
  CRISPR gRNA sequence
cctcacactcagtgtgtttg

SEQ ID NO: 3082 - DNA, 20 bp, Artificial
  CRISPR gRNA sequence
acactcagtgtgtttggggc

SEQ ID NO: 3083 - DNA, 20 bp, Artificial
  CRISPR gRNA sequence
agtgtgtttggggctctgat

SEQ ID NO: 3084 - DNA, 20 bp, Artificial
  CRISPR gRNA sequence
ggggctctgattccagcact

SEQ ID NO: 3085 - DNA, 20 bp, Artificial
  CRISPR gRNA sequence
gggctctgattccagcactt

SEQ ID NO: 3086 - DNA, 20 bp, Artificial
  CRISPR gRNA sequence
tgattccagcacttctgagt

SEQ ID NO: 3087 - DNA, 20 bp, Artificial
  CRISPR gRNA sequence
attccagcacttctgagtca

SEQ ID NO: 3088 - DNA, 20 bp, Artificial
  CRISPR gRNA sequence
cagcacttctgagtcacttt

SEQ ID NO: 3089 - DNA, 20 bp, Artificial
  CRISPR gRNA sequence
ctgagtcactttacctccac

SEQ ID NO: 3090 - DNA, 20 bp, Artificial
  CRISPR gRNA sequence
tgagtcactttacctccact

SEQ ID NO: 3091 - DNA, 20 bp, Artificial
  CRISPR gRNA sequence
agtcactttacctccactca

SEQ ID NO: 3092 - DNA, 20 bp, Artificial
  CRISPR gRNA sequence
tacctccactcagatcagga

SEQ ID NO: 3093 - DNA, 20 bp, Artificial
  CRISPR gRNA sequence
acctccactcagatcaggag

SEQ ID NO: 3094 - DNA, 20 bp, Artificial
  CRISPR gRNA sequence
cctccactcagatcaggagc

SEQ ID NO: 3095 - DNA, 20 bp, Artificial
  CRISPR gRNA sequence
cactcagatcaggagcagaa

SEQ ID NO: 3096 - DNA, 20 bp, Artificial
  CRISPR gRNA sequence
agatcaggagcagaagtccc

SEQ ID NO: 3097 - DNA, 20 bp, Artificial
  CRISPR gRNA sequence
ttccccgctcagagactcga

SEQ ID NO: 3098 - DNA, 20 bp, Artificial
  CRISPR gRNA sequence
cccgctcagagactcgaact

SEQ ID NO: 3099 - DNA, 20 bp, Artificial
  CRISPR gRNA sequence
agagactcgaactttccaat

SEQ ID NO: 3100 - DNA, 20 bp, Artificial
  CRISPR gRNA sequence
gaactttccaatgaatagga

SEQ ID NO: 3101 - DNA, 20 bp, Artificial
  CRISPR gRNA sequence
tccaatgaataggagattat

SEQ ID NO: 3102 - DNA, 20 bp, Artificial
  CRISPR gRNA sequence
ccaatgaataggagattatc

SEQ ID NO: 3103 - DNA, 20 bp, Artificial
  CRISPR gRNA sequence
caatgaataggagattatcc

SEQ ID NO: 3104 - DNA, 20 bp, Artificial
  CRISPR gRNA sequence
tcccaggtgcctgcgtccag

SEQ ID NO: 3105 - DNA, 20 bp, Artificial
  CRISPR gRNA sequence
cgtccaggctggtgtctggg

SEQ ID NO: 3106 - DNA, 20 bp, Artificial
  CRISPR gRNA sequence
gtgtctgggttctgtgcccc

SEQ ID NO: 3107 - DNA, 20 bp, Artificial
  CRISPR gRNA sequence
ggttctgtgccccttcccca

SEQ ID NO: 3108 - DNA, 20 bp, Artificial
  CRISPR gRNA sequence
tgtgccccttccccacccca

SEQ ID NO: 3109 - DNA, 20 bp, Artificial
  CRISPR gRNA sequence
tgccccttccccaccccagg

SEQ ID NO: 3110 - DNA, 20 bp, Artificial
  CRISPR gRNA sequence
ccccaccccaggtgtcctgt

SEQ ID NO: 3111 - DNA, 20 bp, Artificial
  CRISPR gRNA sequence
cccaccccaggtgtcctgtc

SEQ ID NO: 3112 - DNA, 20 bp, Artificial
  CRISPR gRNA sequence
tccattctcaggctggtcac

SEQ ID NO: 3113 - DNA, 20 bp, Artificial
  CRISPR gRNA sequence
tcaggctggtcacatgggtg

SEQ ID NO: 3114 - DNA, 20 bp, Artificial
  CRISPR gRNA sequence
aggctggtcacatgggtggt

SEQ ID NO: 3115 - DNA, 20 bp, Artificial
  CRISPR gRNA sequence
gtcacatgggtggtcctagg

SEQ ID NO: 3116 - DNA, 20 bp, Artificial
  CRISPR gRNA sequence
gggtgtcccatgaaagatgc

SEQ ID NO: 3117 - DNA, 20 bp, Artificial
  CRISPR gRNA sequence
aattttctgactcttcccat

SEQ ID NO: 3118 - DNA, 20 bp, Artificial
  CRISPR gRNA sequence
tctgactcttcccatcagac

SEQ ID NO: 3119 - DNA, 20 bp, Artificial
  CRISPR gRNA sequence
ctgactcttcccatcagacc

SEQ ID NO: 3120 - DNA, 20 bp, Artificial
  CRISPR gRNA sequence
tgactcttcccatcagaccc

SEQ ID NO: 3121 - DNA, 20 bp, Artificial
  CRISPR gRNA sequence
actcttcccatcagaccccc

SEQ ID NO: 3122 - DNA, 20 bp, Artificial
  CRISPR gRNA sequence
ttcccatcagaccccccaaa

SEQ ID NO: 3123 - DNA, 20 bp, Artificial
  CRISPR gRNA sequence
cccatcagaccccccaaaga

SEQ ID NO: 3124 - DNA, 20 bp, Artificial
  CRISPR gRNA sequence
ccatcagaccccccaaagac

SEQ ID NO: 3125 - DNA, 20 bp, Artificial
  CRISPR gRNA sequence
tgaccatgaggccaccctga

SEQ ID NO: 3126 - DNA, 20 bp, Artificial
  CRISPR gRNA sequence
accatgaggccaccctgagg

SEQ ID NO: 3127 - DNA, 20 bp, Artificial
  CRISPR gRNA sequence
aggtgctgggccctgggttt

SEQ ID NO: 3128 - DNA, 20 bp, Artificial
  CRISPR gRNA sequence
ggccctgggtttctaccctg

SEQ ID NO: 3129 - DNA, 20 bp, Artificial
  CRISPR gRNA sequence
ggtttctaccctgcggagat

SEQ ID NO: 3130 - DNA, 20 bp, Artificial
  CRISPR gRNA sequence
ctaccctgcggagatcacac

SEQ ID NO: 3131 - DNA, 20 bp, Artificial
  CRISPR gRNA sequence
taccctgcggagatcacact

SEQ ID NO: 3132 - DNA, 20 bp, Artificial
  CRISPR gRNA sequence
ccctgcggagatcacactga

SEQ ID NO: 3133 - DNA, 20 bp, Artificial
  CRISPR gRNA sequence
cggagatcacactgacctgg

SEQ ID NO: 3134 - DNA, 20 bp, Artificial
  CRISPR gRNA sequence
acctggcagcgggatggcga

SEQ ID NO: 3135 - DNA, 20 bp, Artificial
  CRISPR gRNA sequence
gcagcgggatggcgaggacc

SEQ ID NO: 3136 - DNA, 20 bp, Artificial
  CRISPR gRNA sequence
aggacactgagcttgtggag

SEQ ID NO: 3137 - DNA, 20 bp, Artificial
  CRISPR gRNA sequence
agcttgtggagaccagacca

SEQ ID NO: 3138 - DNA, 20 bp, Artificial
  CRISPR gRNA sequence
gtggagaccagaccagcagg

SEQ ID NO: 3139 - DNA, 20 bp, Artificial
  CRISPR gRNA sequence
tggagaccagaccagcagga

SEQ ID NO: 3140 - DNA, 20 bp, Artificial
  CRISPR gRNA sequence
ccagaagtgggcagctgtgg

SEQ ID NO: 3141 - DNA, 20 bp, Artificial
  CRISPR gRNA sequence
cagaagtgggcagctgtggt

SEQ ID NO: 3142 - DNA, 20 bp, Artificial
  CRISPR gRNA sequence
tggtggtgccttctggagaa

SEQ ID NO: 3143 - DNA, 20 bp, Artificial
  CRISPR gRNA sequence
ctggagaagagcagagatac

SEQ ID NO: 3144 - DNA, 20 bp, Artificial
  CRISPR gRNA sequence
tggagaagagcagagataca

SEQ ID NO: 3145 - DNA, 20 bp, Artificial
  CRISPR gRNA sequence
gagaagagcagagatacaca

SEQ ID NO: 3146 - DNA, 20 bp, Artificial
  CRISPR gRNA sequence
ccgaagcccctcaccctgag

SEQ ID NO: 3147 - DNA, 20 bp, Artificial
  CRISPR gRNA sequence
accctgagatggggtaagga

SEQ ID NO: 3148 - DNA, 20 bp, Artificial
  CRISPR gRNA sequence
agatggggtaaggaggggga

SEQ ID NO: 3149 - DNA, 20 bp, Artificial
  CRISPR gRNA sequence
ttctcagggaaagcaggagc

SEQ ID NO: 3150 - DNA, 20 bp, Artificial
  CRISPR gRNA sequence
ctcagggaaagcaggagccc

SEQ ID NO: 3151 - DNA, 20 bp, Artificial
  CRISPR gRNA sequence
tcagggaaagcaggagccct

SEQ ID NO: 3152 - DNA, 20 bp, Artificial
  CRISPR gRNA sequence
agggaaagcaggagcccttc

SEQ ID NO: 3153 - DNA, 20 bp, Artificial
  CRISPR gRNA sequence
cagcagggtcagggcccctc

SEQ ID NO: 3154 - DNA, 20 bp, Artificial
  CRISPR gRNA sequence
agcagggtcagggcccctca

SEQ ID NO: 3155 - DNA, 20 bp, Artificial
  CRISPR gRNA sequence
atcttcccctcctttcccag

SEQ ID NO: 3156 - DNA, 20 bp, Artificial
  CRISPR gRNA sequence
cccctcctttcccagagccg

SEQ ID NO: 3157 - DNA, 20 bp, Artificial
  CRISPR gRNA sequence
ccctcctttcccagagccgt

SEQ ID NO: 3158 - DNA, 20 bp, Artificial
  CRISPR gRNA sequence
ctttcccagagccgtcttcc

SEQ ID NO: 3159 - DNA, 20 bp, Artificial
  CRISPR gRNA sequence
tcccagagccgtcttcccag

SEQ ID NO: 3160 - DNA, 20 bp, Artificial
  CRISPR gRNA sequence
cccagagccgtcttcccagt

SEQ ID NO: 3161 - DNA, 20 bp, Artificial
  CRISPR gRNA sequence
ccagagccgtcttcccagtc

SEQ ID NO: 3162 - DNA, 20 bp, Artificial
  CRISPR gRNA sequence
cccagtccaccgtccccatc

SEQ ID NO: 3163 - DNA, 20 bp, Artificial
  CRISPR gRNA sequence
ccagtccaccgtccccatcg

SEQ ID NO: 3164 - DNA, 20 bp, Artificial
  CRISPR gRNA sequence
ttgctggcctggctgtccta

SEQ ID NO: 3165 - DNA, 20 bp, Artificial
  CRISPR gRNA sequence
ctggcctggctgtcctagca

SEQ ID NO: 3166 - DNA, 20 bp, Artificial
  CRISPR gRNA sequence
gcctggctgtcctagcagtt

SEQ ID NO: 3167 - DNA, 20 bp, Artificial
  CRISPR gRNA sequence
gctgtcctagcagttgtggt

SEQ ID NO: 3168 - DNA, 20 bp, Artificial
  CRISPR gRNA sequence
tcctagcagttgtggtcatc

SEQ ID NO: 3169 - DNA, 20 bp, Artificial
  CRISPR gRNA sequence
gcagttgtggtcatcggagc

SEQ ID NO: 3170 - DNA, 20 bp, Artificial
  CRISPR gRNA sequence
tggtcatcggagctgtggtc

SEQ ID NO: 3171 - DNA, 20 bp, Artificial
  CRISPR gRNA sequence
tggtcgctgctgtgatgtgt

SEQ ID NO: 3172 - DNA, 20 bp, Artificial
  CRISPR gRNA sequence
ctgtgatgtgtaggaggaag

SEQ ID NO: 3173 - DNA, 20 bp, Artificial
  CRISPR gRNA sequence
tgatgtgtaggaggaagagt

SEQ ID NO: 3174 - DNA, 20 bp, Artificial
  CRISPR gRNA sequence
aggtagggaaggggtgaggg

SEQ ID NO: 3175 - DNA, 20 bp, Artificial
  CRISPR gRNA sequence
ggttttcttgtcccactggg

SEQ ID NO: 3176 - DNA, 20 bp, Artificial
  CRISPR gRNA sequence
tcttgtcccactgggggttt

SEQ ID NO: 3177 - DNA, 20 bp, Artificial
  CRISPR gRNA sequence
cttgtcccactgggggtttc

SEQ ID NO: 3178 - DNA, 20 bp, Artificial
  CRISPR gRNA sequence
ttgtcccactgggggtttca

SEQ ID NO: 3179 - DNA, 20 bp, Artificial
  CRISPR gRNA sequence
gtcccactgggggtttcaag

SEQ ID NO: 3180 - DNA, 20 bp, Artificial
  CRISPR gRNA sequence
tcccactgggggtttcaagc

SEQ ID NO: 3181 - DNA, 20 bp, Artificial
  CRISPR gRNA sequence
ggggtttcaagccccaggta

SEQ ID NO: 3182 - DNA, 20 bp, Artificial
  CRISPR gRNA sequence
caagccccaggtagaagtgt

SEQ ID NO: 3183 - DNA, 20 bp, Artificial
  CRISPR gRNA sequence
aagccccaggtagaagtgtt

SEQ ID NO: 3184 - DNA, 20 bp, Artificial
  CRISPR gRNA sequence
cctgcctcattactgggaag

SEQ ID NO: 3185 - DNA, 20 bp, Artificial
  CRISPR gRNA sequence
cctcattactgggaagcagc

SEQ ID NO: 3186 - DNA, 20 bp, Artificial
  CRISPR gRNA sequence
attactgggaagcagcatgc

SEQ ID NO: 3187 - DNA, 20 bp, Artificial
  CRISPR gRNA sequence
ctgggaagcagcatgcacac

SEQ ID NO: 3188 - DNA, 20 bp, Artificial
  CRISPR gRNA sequence
ggaagcagcatgcacacagg

SEQ ID NO: 3189 - DNA, 20 bp, Artificial
  CRISPR gRNA sequence
acgcagcctgggaccctgtg

SEQ ID NO: 3190 - DNA, 20 bp, Artificial
  CRISPR gRNA sequence
ggaccctgtgtgccagcact

SEQ ID NO: 3191 - DNA, 20 bp, Artificial
  CRISPR gRNA sequence
tgtgccagcacttactcttt

SEQ ID NO: 3192 - DNA, 20 bp, Artificial
  CRISPR gRNA sequence
actcttttgtgcagcacatg

SEQ ID NO: 3193 - DNA, 20 bp, Artificial
  CRISPR gRNA sequence
ctcttttgtgcagcacatgt

SEQ ID NO: 3194 - DNA, 20 bp, Artificial
  CRISPR gRNA sequence
ttttgtgcagcacatgtgac

SEQ ID NO: 3195 - DNA, 20 bp, Artificial
  CRISPR gRNA sequence
ttgtgcagcacatgtgacaa

SEQ ID NO: 3196 - DNA, 20 bp, Artificial
  CRISPR gRNA sequence
tgtgcagcacatgtgacaat

SEQ ID NO: 3197 - DNA, 20 bp, Artificial
  CRISPR gRNA sequence
gtgcagcacatgtgacaatg

SEQ ID NO: 3198 - DNA, 20 bp, Artificial
  CRISPR gRNA sequence
tgcagcacatgtgacaatga

SEQ ID NO: 3199 - DNA, 20 bp, Artificial
  CRISPR gRNA sequence
gatggttgtggtgttggggt

SEQ ID NO: 3200 - DNA, 20 bp, Artificial
  CRISPR gRNA sequence
atggttgtggtgttggggtc

SEQ ID NO: 3201 - DNA, 20 bp, Artificial
  CRISPR gRNA sequence
tggtgttggggtcctgattc

SEQ ID NO: 3202 - DNA, 20 bp, Artificial
  CRISPR gRNA sequence
gggtcctgattccagcattc

SEQ ID NO: 3203 - DNA, 20 bp, Artificial
  CRISPR gRNA sequence
attccagcattcatgagtca

SEQ ID NO: 3204 - DNA, 20 bp, Artificial
  CRISPR gRNA sequence
cagcattcatgagtcagggg

SEQ ID NO: 3205 - DNA, 20 bp, Artificial
  CRISPR gRNA sequence
atgagtcaggggaaggtccc

SEQ ID NO: 3206 - DNA, 20 bp, Artificial
  CRISPR gRNA sequence
ctaaggacagaccttaggag

SEQ ID NO: 3207 - DNA, 20 bp, Artificial
  CRISPR gRNA sequence
aggacagaccttaggagggc

SEQ ID NO: 3208 - DNA, 20 bp, Artificial
  CRISPR gRNA sequence
aggagggcagttggtccagg

SEQ ID NO: 3209 - DNA, 20 bp, Artificial
  CRISPR gRNA sequence
ggagggcagttggtccagga

SEQ ID NO: 3210 - DNA, 20 bp, Artificial
  CRISPR gRNA sequence
gtccaggacccacacttgct

SEQ ID NO: 3211 - DNA, 20 bp, Artificial
  CRISPR gRNA sequence
gctttcctcgtgtttcctga

SEQ ID NO: 3212 - DNA, 20 bp, Artificial
  CRISPR gRNA sequence
ctttcctcgtgtttcctgat

SEQ ID NO: 3213 - DNA, 20 bp, Artificial
  CRISPR gRNA sequence
tcctcgtgtttcctgatcct

SEQ ID NO: 3214 - DNA, 20 bp, Artificial
  CRISPR gRNA sequence
cctcgtgtttcctgatcctg

SEQ ID NO: 3215 - DNA, 20 bp, Artificial
  CRISPR gRNA sequence
ctcgtgtttcctgatcctgc

SEQ ID NO: 3216 - DNA, 20 bp, Artificial
  CRISPR gRNA sequence
gtgtttcctgatcctgccct

SEQ ID NO: 3217 - DNA, 20 bp, Artificial
  CRISPR gRNA sequence
cctgatcctgccctgggtct

SEQ ID NO: 3218 - DNA, 20 bp, Artificial
  CRISPR gRNA sequence
ctgatcctgccctgggtctg

SEQ ID NO: 3219 - DNA, 20 bp, Artificial
  CRISPR gRNA sequence
atcctgccctgggtctgtag

SEQ ID NO: 3220 - DNA, 20 bp, Artificial
  CRISPR gRNA sequence
ccctgggtctgtagtcatac

SEQ ID NO: 3221 - DNA, 20 bp, Artificial
  CRISPR gRNA sequence
ggtctgtagtcatacttctg

SEQ ID NO: 3222 - DNA, 20 bp, Artificial
  CRISPR gRNA sequence
tagtcatacttctggaaatt

SEQ ID NO: 3223 - DNA, 20 bp, Artificial
  CRISPR gRNA sequence
ctggaaattccttttgggtc

SEQ ID NO: 3224 - DNA, 20 bp, Artificial
  CRISPR gRNA sequence
tggaaattccttttgggtcc

SEQ ID NO: 3225 - DNA, 20 bp, Artificial
  CRISPR gRNA sequence
gaaattccttttgggtccaa

SEQ ID NO: 3226 - DNA, 20 bp, Artificial
  CRISPR gRNA sequence
cttttgggtccaagactagg

SEQ ID NO: 3227 - DNA, 20 bp, Artificial
  CRISPR gRNA sequence
ttgggtccaagactaggagg

SEQ ID NO: 3228 - DNA, 20 bp, Artificial
  CRISPR gRNA sequence
tgggtccaagactaggaggt

SEQ ID NO: 3229 - DNA, 20 bp, Artificial
  CRISPR gRNA sequence
gggtccaagactaggaggtt

SEQ ID NO: 3230 - DNA, 20 bp, Artificial
  CRISPR gRNA sequence
ggtccaagactaggaggttc

SEQ ID NO: 3231 - DNA, 20 bp, Artificial
  CRISPR gRNA sequence
ggaggttcctctaagatctc

SEQ ID NO: 3232 - DNA, 20 bp, Artificial
  CRISPR gRNA sequence
ctctaagatctcatggccct

SEQ ID NO: 3233 - DNA, 20 bp, Artificial
  CRISPR gRNA sequence
taagatctcatggccctgct

SEQ ID NO: 3234 - DNA, 20 bp, Artificial
  CRISPR gRNA sequence
agatctcatggccctgcttc

SEQ ID NO: 3235 - DNA, 20 bp, Artificial
  CRISPR gRNA sequence
atggccctgcttcctcccag

SEQ ID NO: 3236 - DNA, 20 bp, Artificial
  CRISPR gRNA sequence
cttcctcccagtgccctcac

SEQ ID NO: 3237 - DNA, 20 bp, Artificial
  CRISPR gRNA sequence
cctcccagtgccctcacagg

SEQ ID NO: 3238 - DNA, 20 bp, Artificial
  CRISPR gRNA sequence
ctcccagtgccctcacagga

SEQ ID NO: 3239 - DNA, 20 bp, Artificial
  CRISPR gRNA sequence
ccagtgccctcacaggacat

SEQ ID NO: 3240 - DNA, 20 bp, Artificial
  CRISPR gRNA sequence
acaggacattttcttcccac

SEQ ID NO: 3241 - DNA, 20 bp, Artificial
  CRISPR gRNA sequence
tcttcccacaggtggaaaag

SEQ ID NO: 3242 - DNA, 20 bp, Artificial
  CRISPR gRNA sequence
cttcccacaggtggaaaagg

SEQ ID NO: 3243 - DNA, 20 bp, Artificial
  CRISPR gRNA sequence
ttcccacaggtggaaaagga

SEQ ID NO: 3244 - DNA, 20 bp, Artificial
  CRISPR gRNA sequence
cccacaggtggaaaaggagg

SEQ ID NO: 3245 - DNA, 20 bp, Artificial
  CRISPR gRNA sequence
ccacaggtggaaaaggaggg

SEQ ID NO: 3246 - DNA, 20 bp, Artificial
  CRISPR gRNA sequence
ctctcaggctgcgtgtaagt

SEQ ID NO: 3247 - DNA, 20 bp, Artificial
  CRISPR gRNA sequence
tcaggctgcgtgtaagtggt

SEQ ID NO: 3248 - DNA, 20 bp, Artificial
  CRISPR gRNA sequence
aggctgcgtgtaagtggtgg

SEQ ID NO: 3249 - DNA, 20 bp, Artificial
  CRISPR gRNA sequence
cgtgtaagtggtgggggtgg

SEQ ID NO: 3250 - DNA, 20 bp, Artificial
  CRISPR gRNA sequence
acccaccccataattcctcc

SEQ ID NO: 3251 - DNA, 20 bp, Artificial
  CRISPR gRNA sequence
ctcctgtcccacgtctcctg

SEQ ID NO: 3252 - DNA, 20 bp, Artificial
  CRISPR gRNA sequence
ctgtcccacgtctcctgcgg

SEQ ID NO: 3253 - DNA, 20 bp, Artificial
  CRISPR gRNA sequence
tcccacgtctcctgcgggct

SEQ ID NO: 3254 - DNA, 20 bp, Artificial
  CRISPR gRNA sequence
ctgcgggctctgaccaggtc

SEQ ID NO: 3255 - DNA, 20 bp, Artificial
  CRISPR gRNA sequence
cgggctctgaccaggtcctg

SEQ ID NO: 3256 - DNA, 20 bp, Artificial
  CRISPR gRNA sequence
tgaccaggtcctgtttttgt

SEQ ID NO: 3257 - DNA, 20 bp, Artificial
  CRISPR gRNA sequence
accaggtcctgtttttgttc

SEQ ID NO: 3258 - DNA, 20 bp, Artificial
  CRISPR gRNA sequence
tttttgttctactccaggca

SEQ ID NO: 3259 - DNA, 20 bp, Artificial
  CRISPR gRNA sequence
ttgttctactccaggcagcg

SEQ ID NO: 3260 - DNA, 20 bp, Artificial
  CRISPR gRNA sequence
tgttctactccaggcagcga

SEQ ID NO: 3261 - DNA, 20 bp, Artificial
  CRISPR gRNA sequence
gttctactccaggcagcgac

SEQ ID NO: 3262 - DNA, 20 bp, Artificial
  CRISPR gRNA sequence
ttctactccaggcagcgaca

SEQ ID NO: 3263 - DNA, 20 bp, Artificial
  CRISPR gRNA sequence
tactccaggcagcgacagtg

SEQ ID NO: 3264 - DNA, 20 bp, Artificial
  CRISPR gRNA sequence
ctccaggcagcgacagtgcc

SEQ ID NO: 3265 - DNA, 20 bp, Artificial
  CRISPR gRNA sequence
caggcagcgacagtgcccag

SEQ ID NO: 3266 - DNA, 20 bp, Artificial
  CRISPR gRNA sequence
tgatgtgtctctcacagctt

SEQ ID NO: 3267 - DNA, 20 bp, Artificial
  CRISPR gRNA sequence
atgtgtctctcacagcttga

SEQ ID NO: 3268 - DNA, 20 bp, Artificial
  CRISPR gRNA sequence
tcacagcttgaaaaggtgag

SEQ ID NO: 3269 - DNA, 20 bp, Artificial
  CRISPR gRNA sequence
acagcttgaaaaggtgagat

SEQ ID NO: 3270 - DNA, 20 bp, Artificial
  CRISPR gRNA sequence
gaaaaggtgagattcttggg

SEQ ID NO: 3271 - DNA, 20 bp, Artificial
  CRISPR gRNA sequence
aaaaggtgagattcttgggg

SEQ ID NO: 3272 - DNA, 20 bp, Artificial
  CRISPR gRNA sequence
ttggggtctagagtgggtgg

SEQ ID NO: 3273 - DNA, 20 bp, Artificial
  CRISPR gRNA sequence
ggggtctagagtgggtgggg

SEQ ID NO: 3274 - DNA, 20 bp, Artificial
  CRISPR gRNA sequence
gggtctagagtgggtggggt

SEQ ID NO: 3275 - DNA, 20 bp, Artificial
  CRISPR gRNA sequence
gagtgggtggggtggcgggt

SEQ ID NO: 3276 - DNA, 20 bp, Artificial
  CRISPR gRNA sequence
ggggtgggtggggcagaggg

SEQ ID NO: 3277 - DNA, 20 bp, Artificial
  CRISPR gRNA sequence
ggtaatggggattctttgat

SEQ ID NO: 3278 - DNA, 20 bp, Artificial
  CRISPR gRNA sequence
cactcgaaacgtcccaatca

SEQ ID NO: 3279 - DNA, 20 bp, Artificial
  CRISPR gRNA sequence
atcaaagaatccccattacc

SEQ ID NO: 3280 - DNA, 20 bp, Artificial
  CRISPR gRNA sequence
tcaaagaatccccattaccc

SEQ ID NO: 3281 - DNA, 20 bp, Artificial
  CRISPR gRNA sequence
tgccccacccccgaccactt

SEQ ID NO: 3282 - DNA, 20 bp, Artificial
  CRISPR gRNA sequence
ccccgaccacttcagctccc

SEQ ID NO: 3283 - DNA, 20 bp, Artificial
  CRISPR gRNA sequence
ccccagaatctcacctttac

SEQ ID NO: 3284 - DNA, 20 bp, Artificial
  CRISPR gRNA sequence
atctcacctttacaagtgat

SEQ ID NO: 3285 - DNA, 20 bp, Artificial
  CRISPR gRNA sequence
ctcacctttacaagtgatga

SEQ ID NO: 3286 - DNA, 20 bp, Artificial
  CRISPR gRNA sequence
acaagtgatgagagactcat

SEQ ID NO: 3287 - DNA, 20 bp, Artificial
  CRISPR gRNA sequence
aagtgatgagagactcatca

SEQ ID NO: 3288 - DNA, 20 bp, Artificial
  CRISPR gRNA sequence
tgagagactcatcagagccc

SEQ ID NO: 3289 - DNA, 20 bp, Artificial
  CRISPR gRNA sequence
gagagactcatcagagccct

SEQ ID NO: 3290 - DNA, 20 bp, Artificial
  CRISPR gRNA sequence
ccctgggcactgttgctgcc

SEQ ID NO: 3291 - DNA, 20 bp, Artificial
  CRISPR gRNA sequence
cctgggcactgttgctgcct

SEQ ID NO: 3292 - DNA, 20 bp, Artificial
  CRISPR gRNA sequence
ctgggcactgttgctgcctg

SEQ ID NO: 3293 - DNA, 20 bp, Artificial
  CRISPR gRNA sequence
ggcactgttgctgcctgggg

SEQ ID NO: 3294 - DNA, 20 bp, Artificial
  CRISPR gRNA sequence
cctggggtagaacaaaaaaa

SEQ ID NO: 3295 - DNA, 20 bp, Artificial
  CRISPR gRNA sequence
gtagaacaaaaaaaaagacc

SEQ ID NO: 3296 - DNA, 20 bp, Artificial
  CRISPR gRNA sequence
aacaaaaaaaaagacctggt

SEQ ID NO: 3297 - DNA, 20 bp, Artificial
  CRISPR gRNA sequence
caaaaaaaaagacctggtca

SEQ ID NO: 3298 - DNA, 20 bp, Artificial
  CRISPR gRNA sequence
aaagacctggtcagagcccg

SEQ ID NO: 3299 - DNA, 20 bp, Artificial
  CRISPR gRNA sequence
aagacctggtcagagcccgc

SEQ ID NO: 3300 - DNA, 20 bp, Artificial
  CRISPR gRNA sequence
gacctggtcagagcccgcag

SEQ ID NO: 3301 - DNA, 20 bp, Artificial
  CRISPR gRNA sequence
gtcagagcccgcaggagatg

SEQ ID NO: 3302 - DNA, 20 bp, Artificial
  CRISPR gRNA sequence
tcagagcccgcaggagatgt

SEQ ID NO: 3303 - DNA, 20 bp, Artificial
  CRISPR gRNA sequence
gcccgcaggagatgtgggac

SEQ ID NO: 3304 - DNA, 20 bp, Artificial
  CRISPR gRNA sequence
ccgcaggagatgtgggacaa

SEQ ID NO: 3305 - DNA, 20 bp, Artificial
  CRISPR gRNA sequence
cgcaggagatgtgggacaag

SEQ ID NO: 3306 - DNA, 20 bp, Artificial
  CRISPR gRNA sequence
atgtgggacaagaggaatta

SEQ ID NO: 3307 - DNA, 20 bp, Artificial
  CRISPR gRNA sequence
gtgggacaagaggaattatg

SEQ ID NO: 3308 - DNA, 20 bp, Artificial
  CRISPR gRNA sequence
ggacaagaggaattatggag

SEQ ID NO: 3309 - DNA, 20 bp, Artificial
  CRISPR gRNA sequence
gacaagaggaattatggagt

SEQ ID NO: 3310 - DNA, 20 bp, Artificial
  CRISPR gRNA sequence
agaggaattatggagtaggt

SEQ ID NO: 3311 - DNA, 20 bp, Artificial
  CRISPR gRNA sequence
ccgccgccatcacttacacg

SEQ ID NO: 3312 - DNA, 20 bp, Artificial
  CRISPR gRNA sequence
ccatcacttacacgcagcct

SEQ ID NO: 3313 - DNA, 20 bp, Artificial
  CRISPR gRNA sequence
atcacttacacgcagcctga

SEQ ID NO: 3314 - DNA, 20 bp, Artificial
  CRISPR gRNA sequence
acttacacgcagcctgagag

SEQ ID NO: 3315 - DNA, 20 bp, Artificial
  CRISPR gRNA sequence
gctccctccttttccacctg

SEQ ID NO: 3316 - DNA, 20 bp, Artificial
  CRISPR gRNA sequence
ctccctccttttccacctgt

SEQ ID NO: 3317 - DNA, 20 bp, Artificial
  CRISPR gRNA sequence
cctccttttccacctgtggg

SEQ ID NO: 3318 - DNA, 20 bp, Artificial
  CRISPR gRNA sequence
gtgggaagaaaatgccctat

SEQ ID NO: 3319 - DNA, 20 bp, Artificial
  CRISPR gRNA sequence
tgggaagaaaatgccctatg

SEQ ID NO: 3320 - DNA, 20 bp, Artificial
  CRISPR gRNA sequence
gggaagaaaatgccctatga

SEQ ID NO: 3321 - DNA, 20 bp, Artificial
  CRISPR gRNA sequence
ggaagaaaatgccctatgag

SEQ ID NO: 3322 - DNA, 20 bp, Artificial
  CRISPR gRNA sequence
aaaatgccctatgaggggac

SEQ ID NO: 3323 - DNA, 20 bp, Artificial
  CRISPR gRNA sequence
aaatgccctatgaggggact

SEQ ID NO: 3324 - DNA, 20 bp, Artificial
  CRISPR gRNA sequence
atgccctatgaggggactgg

SEQ ID NO: 3325 - DNA, 20 bp, Artificial
  CRISPR gRNA sequence
tgccctatgaggggactggg

SEQ ID NO: 3326 - DNA, 20 bp, Artificial
  CRISPR gRNA sequence
ccctatgaggggactgggag

SEQ ID NO: 3327 - DNA, 20 bp, Artificial
  CRISPR gRNA sequence
cctatgaggggactgggagg

SEQ ID NO: 3328 - DNA, 20 bp, Artificial
  CRISPR gRNA sequence
atgaggggactgggaggagg

SEQ ID NO: 3329 - DNA, 20 bp, Artificial
  CRISPR gRNA sequence
tgaggggactgggaggaggc

SEQ ID NO: 3330 - DNA, 20 bp, Artificial
  CRISPR gRNA sequence
gaggggactgggaggaggca

SEQ ID NO: 3331 - DNA, 20 bp, Artificial
  CRISPR gRNA sequence
gaggcagggccatgtgatct

SEQ ID NO: 3332 - DNA, 20 bp, Artificial
  CRISPR gRNA sequence
aggcagggccatgtgatctt

SEQ ID NO: 3333 - DNA, 20 bp, Artificial
  CRISPR gRNA sequence
ggcagggccatgtgatctta

SEQ ID NO: 3334 - DNA, 20 bp, Artificial
  CRISPR gRNA sequence
gcagggccatgtgatcttag

SEQ ID NO: 3335 - DNA, 20 bp, Artificial
  CRISPR gRNA sequence
gtgatcttaggggaacctcc

SEQ ID NO: 3336 - DNA, 20 bp, Artificial
  CRISPR gRNA sequence
ttaggggaacctcctagtct

SEQ ID NO: 3337 - DNA, 20 bp, Artificial
  CRISPR gRNA sequence
aacctcctagtcttggaccc

SEQ ID NO: 3338 - DNA, 20 bp, Artificial
  CRISPR gRNA sequence
cctcctagtcttggacccaa

SEQ ID NO: 3339 - DNA, 20 bp, Artificial
  CRISPR gRNA sequence
cctagtcttggacccaagag

SEQ ID NO: 3340 - DNA, 20 bp, Artificial
  CRISPR gRNA sequence
ttggacccaagagaagtttc

SEQ ID NO: 3341 - DNA, 20 bp, Artificial
  CRISPR gRNA sequence
agtttccagaactacgactg

SEQ ID NO: 3342 - DNA, 20 bp, Artificial
  CRISPR gRNA sequence
cagaactacgactgcagacc

SEQ ID NO: 3343 - DNA, 20 bp, Artificial
  CRISPR gRNA sequence
agaactacgactgcagaccc

SEQ ID NO: 3344 - DNA, 20 bp, Artificial
  CRISPR gRNA sequence
gaactacgactgcagaccca

SEQ ID NO: 3345 - DNA, 20 bp, Artificial
  CRISPR gRNA sequence
ctacgactgcagacccaggg

SEQ ID NO: 3346 - DNA, 20 bp, Artificial
  CRISPR gRNA sequence
tacgactgcagacccagggc

SEQ ID NO: 3347 - DNA, 20 bp, Artificial
  CRISPR gRNA sequence
ctgcagacccagggcaggat

SEQ ID NO: 3348 - DNA, 20 bp, Artificial
  CRISPR gRNA sequence
tgcagacccagggcaggatc

SEQ ID NO: 3349 - DNA, 20 bp, Artificial
  CRISPR gRNA sequence
cagggcaggatcaggaaaca

SEQ ID NO: 3350 - DNA, 20 bp, Artificial
  CRISPR gRNA sequence
agggcaggatcaggaaacat

SEQ ID NO: 3351 - DNA, 20 bp, Artificial
  CRISPR gRNA sequence
gggcaggatcaggaaacatg

SEQ ID NO: 3352 - DNA, 20 bp, Artificial
  CRISPR gRNA sequence
aggatcaggaaacatgggga

SEQ ID NO: 3353 - DNA, 20 bp, Artificial
  CRISPR gRNA sequence
atcaggaaacatggggaaag

SEQ ID NO: 3354 - DNA, 20 bp, Artificial
  CRISPR gRNA sequence
aaacatggggaaagcagttg

SEQ ID NO: 3355 - DNA, 20 bp, Artificial
  CRISPR gRNA sequence
aacatggggaaagcagttgt

SEQ ID NO: 3356 - DNA, 20 bp, Artificial
  CRISPR gRNA sequence
gggaaagcagttgtgggttc

SEQ ID NO: 3357 - DNA, 20 bp, Artificial
  CRISPR gRNA sequence
tctggaccaactgccctcct

SEQ ID NO: 3358 - DNA, 20 bp, Artificial
  CRISPR gRNA sequence
ctggaccaactgccctccta

SEQ ID NO: 3359 - DNA, 20 bp, Artificial
  CRISPR gRNA sequence
gccctcctaaggtctgtcct

SEQ ID NO: 3360 - DNA, 20 bp, Artificial
  CRISPR gRNA sequence
ctcctaaggtctgtccttag

SEQ ID NO: 3361 - DNA, 20 bp, Artificial
  CRISPR gRNA sequence
tcctaaggtctgtccttagc

SEQ ID NO: 3362 - DNA, 20 bp, Artificial
  CRISPR gRNA sequence
cctaaggtctgtccttagca

SEQ ID NO: 3363 - DNA, 20 bp, Artificial
  CRISPR gRNA sequence
ttcccctgactcatgaatgc

SEQ ID NO: 3364 - DNA, 20 bp, Artificial
  CRISPR gRNA sequence
tgactcatgaatgctggaat

SEQ ID NO: 3365 - DNA, 20 bp, Artificial
  CRISPR gRNA sequence
gactcatgaatgctggaatc

SEQ ID NO: 3366 - DNA, 20 bp, Artificial
  CRISPR gRNA sequence
accccaacaccataatcatc

SEQ ID NO: 3367 - DNA, 20 bp, Artificial
  CRISPR gRNA sequence
ccccaacaccataatcatca

SEQ ID NO: 3368 - DNA, 20 bp, Artificial
  CRISPR gRNA sequence
ttgtcacatgtgcttcacaa

SEQ ID NO: 3369 - DNA, 20 bp, Artificial
  CRISPR gRNA sequence
gtcacatgtgcttcacaaaa

SEQ ID NO: 3370 - DNA, 20 bp, Artificial
  CRISPR gRNA sequence
catgtgcttcacaaaagagt

SEQ ID NO: 3371 - DNA, 20 bp, Artificial
  CRISPR gRNA sequence
cttcacaaaagagtaagtgc

SEQ ID NO: 3372 - DNA, 20 bp, Artificial
  CRISPR gRNA sequence
aaagagtaagtgctggcaca

SEQ ID NO: 3373 - DNA, 20 bp, Artificial
  CRISPR gRNA sequence
aagagtaagtgctggcacac

SEQ ID NO: 3374 - DNA, 20 bp, Artificial
  CRISPR gRNA sequence
agagtaagtgctggcacaca

SEQ ID NO: 3375 - DNA, 20 bp, Artificial
  CRISPR gRNA sequence
agtgctggcacacagggtcc

SEQ ID NO: 3376 - DNA, 20 bp, Artificial
  CRISPR gRNA sequence
gtgctggcacacagggtccc

SEQ ID NO: 3377 - DNA, 20 bp, Artificial
  CRISPR gRNA sequence
tggcacacagggtcccaggc

SEQ ID NO: 3378 - DNA, 20 bp, Artificial
  CRISPR gRNA sequence
ggcacacagggtcccaggct

SEQ ID NO: 3379 - DNA, 20 bp, Artificial
  CRISPR gRNA sequence
cacagggtcccaggctggga

SEQ ID NO: 3380 - DNA, 20 bp, Artificial
  CRISPR gRNA sequence
aggctgggatggcccatgtg

SEQ ID NO: 3381 - DNA, 20 bp, Artificial
  CRISPR gRNA sequence
tgggatggcccatgtgtgga

SEQ ID NO: 3382 - DNA, 20 bp, Artificial
  CRISPR gRNA sequence
ccatgtgtggatggtgcttc

SEQ ID NO: 3383 - DNA, 20 bp, Artificial
  CRISPR gRNA sequence
tggatggtgcttccagtaac

SEQ ID NO: 3384 - DNA, 20 bp, Artificial
  CRISPR gRNA sequence
ggatggtgcttccagtaaca

SEQ ID NO: 3385 - DNA, 20 bp, Artificial
  CRISPR gRNA sequence
tggtgcttccagtaacaagg

SEQ ID NO: 3386 - DNA, 20 bp, Artificial
  CRISPR gRNA sequence
ggtgcttccagtaacaaggc

SEQ ID NO: 3387 - DNA, 20 bp, Artificial
  CRISPR gRNA sequence
gtgcttccagtaacaaggcg

SEQ ID NO: 3388 - DNA, 20 bp, Artificial
  CRISPR gRNA sequence
aggcggggcacacttctacc

SEQ ID NO: 3389 - DNA, 20 bp, Artificial
  CRISPR gRNA sequence
ggcggggcacacttctacct

SEQ ID NO: 3390 - DNA, 20 bp, Artificial
  CRISPR gRNA sequence
gcggggcacacttctacctg

SEQ ID NO: 3391 - DNA, 20 bp, Artificial
  CRISPR gRNA sequence
tacctggggcttgaaactcc

SEQ ID NO: 3392 - DNA, 20 bp, Artificial
  CRISPR gRNA sequence
ctggggcttgaaactcccag

SEQ ID NO: 3393 - DNA, 20 bp, Artificial
  CRISPR gRNA sequence
tggggcttgaaactcccagt

SEQ ID NO: 3394 - DNA, 20 bp, Artificial
  CRISPR gRNA sequence
cttgaaactcccagtgggac

SEQ ID NO: 3395 - DNA, 20 bp, Artificial
  CRISPR gRNA sequence
cccagtgggacaagaaaacc

SEQ ID NO: 3396 - DNA, 20 bp, Artificial
  CRISPR gRNA sequence
tcttcaccccttccctacct

SEQ ID NO: 3397 - DNA, 20 bp, Artificial
  CRISPR gRNA sequence
gctcttcctcctacacatca

SEQ ID NO: 3398 - DNA, 20 bp, Artificial
  CRISPR gRNA sequence
cttcctcctacacatcatag

SEQ ID NO: 3399 - DNA, 20 bp, Artificial
  CRISPR gRNA sequence
acacatcatagcggtgacca

SEQ ID NO: 3400 - DNA, 20 bp, Artificial
  CRISPR gRNA sequence
atagcggtgaccacagctcc

SEQ ID NO: 3401 - DNA, 20 bp, Artificial
  CRISPR gRNA sequence
tagcggtgaccacagctcca

SEQ ID NO: 3402 - DNA, 20 bp, Artificial
  CRISPR gRNA sequence
ggtgaccacagctccaagga

SEQ ID NO: 3403 - DNA, 20 bp, Artificial
  CRISPR gRNA sequence
accacagctccaaggacagc

SEQ ID NO: 3404 - DNA, 20 bp, Artificial
  CRISPR gRNA sequence
ccacagctccaaggacagct

SEQ ID NO: 3405 - DNA, 20 bp, Artificial
  CRISPR gRNA sequence
ccaaggacagctaggacaac

SEQ ID NO: 3406 - DNA, 20 bp, Artificial
  CRISPR gRNA sequence
caaggacagctaggacaacc

SEQ ID NO: 3407 - DNA, 20 bp, Artificial
  CRISPR gRNA sequence
gacagctaggacaaccagga

SEQ ID NO: 3408 - DNA, 20 bp, Artificial
  CRISPR gRNA sequence
gctaggacaaccaggacagc

SEQ ID NO: 3409 - DNA, 20 bp, Artificial
  CRISPR gRNA sequence
ctaggacaaccaggacagcc

SEQ ID NO: 3410 - DNA, 20 bp, Artificial
  CRISPR gRNA sequence
gacaaccaggacagccaggc

SEQ ID NO: 3411 - DNA, 20 bp, Artificial
  CRISPR gRNA sequence
gccagcaacgatgcccatga

SEQ ID NO: 3412 - DNA, 20 bp, Artificial
  CRISPR gRNA sequence
ccagcaacgatgcccatgat

SEQ ID NO: 3413 - DNA, 20 bp, Artificial
  CRISPR gRNA sequence
cagcaacgatgcccatgatg

SEQ ID NO: 3414 - DNA, 20 bp, Artificial
  CRISPR gRNA sequence
aacgatgcccatgatgggga

SEQ ID NO: 3415 - DNA, 20 bp, Artificial
  CRISPR gRNA sequence
gatgcccatgatggggatgg

SEQ ID NO: 3416 - DNA, 20 bp, Artificial
  CRISPR gRNA sequence
atgcccatgatggggatggt

SEQ ID NO: 3417 - DNA, 20 bp, Artificial
  CRISPR gRNA sequence
ccatgatggggatggtgggc

SEQ ID NO: 3418 - DNA, 20 bp, Artificial
  CRISPR gRNA sequence
catgatggggatggtgggct

SEQ ID NO: 3419 - DNA, 20 bp, Artificial
  CRISPR gRNA sequence
gatggggatggtgggctggg

SEQ ID NO: 3420 - DNA, 20 bp, Artificial
  CRISPR gRNA sequence
gggatggtgggctgggaaga

SEQ ID NO: 3421 - DNA, 20 bp, Artificial
  CRISPR gRNA sequence
gtgggctgggaagatggctc

SEQ ID NO: 3422 - DNA, 20 bp, Artificial
  CRISPR gRNA sequence
tgggctgggaagatggctct

SEQ ID NO: 3423 - DNA, 20 bp, Artificial
  CRISPR gRNA sequence
ctgggaagatggctctggga

SEQ ID NO: 3424 - DNA, 20 bp, Artificial
  CRISPR gRNA sequence
tgggaagatggctctgggaa

SEQ ID NO: 3425 - DNA, 20 bp, Artificial
  CRISPR gRNA sequence
ggaagatggctctgggaaag

SEQ ID NO: 3426 - DNA, 20 bp, Artificial
  CRISPR gRNA sequence
gaagatggctctgggaaagg

SEQ ID NO: 3427 - DNA, 20 bp, Artificial
  CRISPR gRNA sequence
agatggctctgggaaaggag

SEQ ID NO: 3428 - DNA, 20 bp, Artificial
  CRISPR gRNA sequence
tggctctgggaaaggaggag

SEQ ID NO: 3429 - DNA, 20 bp, Artificial
  CRISPR gRNA sequence
ggctctgggaaaggaggaga

SEQ ID NO: 3430 - DNA, 20 bp, Artificial
  CRISPR gRNA sequence
ctgggaaaggaggagaaggt

SEQ ID NO: 3431 - DNA, 20 bp, Artificial
  CRISPR gRNA sequence
tgggaaaggaggagaaggtg

SEQ ID NO: 3432 - DNA, 20 bp, Artificial
  CRISPR gRNA sequence
gggaaaggaggagaaggtga

SEQ ID NO: 3433 - DNA, 20 bp, Artificial
  CRISPR gRNA sequence
ggaaaggaggagaaggtgag

SEQ ID NO: 3434 - DNA, 20 bp, Artificial
  CRISPR gRNA sequence
ggtgaggggccctgaccccc

SEQ ID NO: 3435 - DNA, 20 bp, Artificial
  CRISPR gRNA sequence
gggccctgacccccaagcct

SEQ ID NO: 3436 - DNA, 20 bp, Artificial
  CRISPR gRNA sequence
cccaagcctcagccctgacc

SEQ ID NO: 3437 - DNA, 20 bp, Artificial
  CRISPR gRNA sequence
cctcagccctgacccggctg

SEQ ID NO: 3438 - DNA, 20 bp, Artificial
  CRISPR gRNA sequence
ctcagccctgacccggctga

SEQ ID NO: 3439 - DNA, 20 bp, Artificial
  CRISPR gRNA sequence
tcagccctgacccggctgaa

SEQ ID NO: 3440 - DNA, 20 bp, Artificial
  CRISPR gRNA sequence
ctgacccggctgaagggctc

SEQ ID NO: 3441 - DNA, 20 bp, Artificial
  CRISPR gRNA sequence
acccggctgaagggctccag

SEQ ID NO: 3442 - DNA, 20 bp, Artificial
  CRISPR gRNA sequence
cccggctgaagggctccaga

SEQ ID NO: 3443 - DNA, 20 bp, Artificial
  CRISPR gRNA sequence
ggacttctgctttctctgat

SEQ ID NO: 3444 - DNA, 20 bp, Artificial
  CRISPR gRNA sequence
acttctgctttctctgataa

SEQ ID NO: 3445 - DNA, 20 bp, Artificial
  CRISPR gRNA sequence
ccccattcccctccttaccc

SEQ ID NO: 3446 - DNA, 20 bp, Artificial
  CRISPR gRNA sequence
ttcccctccttaccccagct

SEQ ID NO: 3447 - DNA, 20 bp, Artificial
  CRISPR gRNA sequence
tcccctccttaccccagctc

SEQ ID NO: 3448 - DNA, 20 bp, Artificial
  CRISPR gRNA sequence
cccctccttaccccagctca

SEQ ID NO: 3449 - DNA, 20 bp, Artificial
  CRISPR gRNA sequence
tccttaccccagctcagggt

SEQ ID NO: 3450 - DNA, 20 bp, Artificial
  CRISPR gRNA sequence
ccttaccccagctcagggtg

SEQ ID NO: 3451 - DNA, 20 bp, Artificial
  CRISPR gRNA sequence
cttaccccagctcagggtga

SEQ ID NO: 3452 - DNA, 20 bp, Artificial
  CRISPR gRNA sequence
ttaccccagctcagggtgag

SEQ ID NO: 3453 - DNA, 20 bp, Artificial
  CRISPR gRNA sequence
ctcagggtgaggggctcttg

SEQ ID NO: 3454 - DNA, 20 bp, Artificial
  CRISPR gRNA sequence
gcagcccctcgtgctgcata

SEQ ID NO: 3455 - DNA, 20 bp, Artificial
  CRISPR gRNA sequence
cgtgtatctctgctcttgtc

SEQ ID NO: 3456 - DNA, 20 bp, Artificial
  CRISPR gRNA sequence
gtatctctgctcttgtccag

SEQ ID NO: 3457 - DNA, 20 bp, Artificial
  CRISPR gRNA sequence
tatctctgctcttgtccaga

SEQ ID NO: 3458 - DNA, 20 bp, Artificial
  CRISPR gRNA sequence
ttgtccagaaggcaccacca

SEQ ID NO: 3459 - DNA, 20 bp, Artificial
  CRISPR gRNA sequence
ccaccacagctgcccacttc

SEQ ID NO: 3460 - DNA, 20 bp, Artificial
  CRISPR gRNA sequence
ccacagctgcccacttctgg

SEQ ID NO: 3461 - DNA, 20 bp, Artificial
  CRISPR gRNA sequence
cacagctgcccacttctgga

SEQ ID NO: 3462 - DNA, 20 bp, Artificial
  CRISPR gRNA sequence
tggaaggttccatctcctgc

SEQ ID NO: 3463 - DNA, 20 bp, Artificial
  CRISPR gRNA sequence
ggttccatctcctgctggcc

SEQ ID NO: 3464 - DNA, 20 bp, Artificial
  CRISPR gRNA sequence
cctgctggcctggtctccac

SEQ ID NO: 3465 - DNA, 20 bp, Artificial
  CRISPR gRNA sequence
tggcctggtctccacaagct

SEQ ID NO: 3466 - DNA, 20 bp, Artificial
  CRISPR gRNA sequence
tctccacaagctcggtgtcc

SEQ ID NO: 3467 - DNA, 20 bp, Artificial
  CRISPR gRNA sequence
ctccacaagctcggtgtcct

SEQ ID NO: 3468 - DNA, 20 bp, Artificial
  CRISPR gRNA sequence
caagctcggtgtcctgggtc

SEQ ID NO: 3469 - DNA, 20 bp, Artificial
  CRISPR gRNA sequence
ggtcctccccatcccgctgc

SEQ ID NO: 3470 - DNA, 20 bp, Artificial
  CRISPR gRNA sequence
gtcctccccatcccgctgcc

SEQ ID NO: 3471 - DNA, 20 bp, Artificial
  CRISPR gRNA sequence
tccccatcccgctgccaggt

SEQ ID NO: 3472 - DNA, 20 bp, Artificial
  CRISPR gRNA sequence
ccaggtcagtgtgatctccg

SEQ ID NO: 3473 - DNA, 20 bp, Artificial
  CRISPR gRNA sequence
caggtcagtgtgatctccgc

SEQ ID NO: 3474 - DNA, 20 bp, Artificial
  CRISPR gRNA sequence
aggtcagtgtgatctccgca

SEQ ID NO: 3475 - DNA, 20 bp, Artificial
  CRISPR gRNA sequence
tcagtgtgatctccgcaggg

SEQ ID NO: 3476 - DNA, 20 bp, Artificial
  CRISPR gRNA sequence
gtgtgatctccgcagggtag

SEQ ID NO: 3477 - DNA, 20 bp, Artificial
  CRISPR gRNA sequence
atctccgcagggtagaagcc

SEQ ID NO: 3478 - DNA, 20 bp, Artificial
  CRISPR gRNA sequence
tctccgcagggtagaagccc

SEQ ID NO: 3479 - DNA, 20 bp, Artificial
  CRISPR gRNA sequence
ctccgcagggtagaagccca

SEQ ID NO: 3480 - DNA, 20 bp, Artificial
  CRISPR gRNA sequence
cagggtagaagcccagggcc

SEQ ID NO: 3481 - DNA, 20 bp, Artificial
  CRISPR gRNA sequence
aagcccagggcccagcacct

SEQ ID NO: 3482 - DNA, 20 bp, Artificial
  CRISPR gRNA sequence
agcccagggcccagcacctc

SEQ ID NO: 3483 - DNA, 20 bp, Artificial
  CRISPR gRNA sequence
gcccagggcccagcacctca

SEQ ID NO: 3484 - DNA, 20 bp, Artificial
  CRISPR gRNA sequence
cagggcccagcacctcaggg

SEQ ID NO: 3485 - DNA, 20 bp, Artificial
  CRISPR gRNA sequence
agcacctcagggtggcctca

SEQ ID NO: 3486 - DNA, 20 bp, Artificial
  CRISPR gRNA sequence
cctcagggtggcctcatggt

SEQ ID NO: 3487 - DNA, 20 bp, Artificial
  CRISPR gRNA sequence
tcagggtggcctcatggtca

SEQ ID NO: 3488 - DNA, 20 bp, Artificial
  CRISPR gRNA sequence
agggtggcctcatggtcaga

SEQ ID NO: 3489 - DNA, 20 bp, Artificial
  CRISPR gRNA sequence
gggtggcctcatggtcagag

SEQ ID NO: 3490 - DNA, 20 bp, Artificial
  CRISPR gRNA sequence
ggtggcctcatggtcagaga

SEQ ID NO: 3491 - DNA, 20 bp, Artificial
  CRISPR gRNA sequence
gtggcctcatggtcagagag

SEQ ID NO: 3492 - DNA, 20 bp, Artificial
  CRISPR gRNA sequence
tggcctcatggtcagagagg

SEQ ID NO: 3493 - DNA, 20 bp, Artificial
  CRISPR gRNA sequence
cctcatggtcagagaggggg

SEQ ID NO: 3494 - DNA, 20 bp, Artificial
  CRISPR gRNA sequence
catggtcagagagggggtgg

SEQ ID NO: 3495 - DNA, 20 bp, Artificial
  CRISPR gRNA sequence
atggtcagagagggggtggt

SEQ ID NO: 3496 - DNA, 20 bp, Artificial
  CRISPR gRNA sequence
tggtgggtcacgtgtgtctt

SEQ ID NO: 3497 - DNA, 20 bp, Artificial
  CRISPR gRNA sequence
ggtgggtcacgtgtgtcttt

SEQ ID NO: 3498 - DNA, 20 bp, Artificial
  CRISPR gRNA sequence
gtgggtcacgtgtgtctttg

SEQ ID NO: 3499 - DNA, 20 bp, Artificial
  CRISPR gRNA sequence
tgggtcacgtgtgtctttgg

SEQ ID NO: 3500 - DNA, 20 bp, Artificial
  CRISPR gRNA sequence
tgtgtctttgggggttctga

SEQ ID NO: 3501 - DNA, 20 bp, Artificial
  CRISPR gRNA sequence
gtgtctttgggggttctgac

SEQ ID NO: 3502 - DNA, 20 bp, Artificial
  CRISPR gRNA sequence
tctttgggggttctgacggg

SEQ ID NO: 3503 - DNA, 20 bp, Artificial
  CRISPR gRNA sequence
tttgggggttctgacgggaa

SEQ ID NO: 3504 - DNA, 20 bp, Artificial
  CRISPR gRNA sequence
ggggttctgacgggaagagt

SEQ ID NO: 3505 - DNA, 20 bp, Artificial
  CRISPR gRNA sequence
acgggaagagtcagaaaatt

SEQ ID NO: 3506 - DNA, 20 bp, Artificial
  CRISPR gRNA sequence
cagacactttgcatctctct

SEQ ID NO: 3507 - DNA, 20 bp, Artificial
  CRISPR gRNA sequence
agacactttgcatctctctt

SEQ ID NO: 3508 - DNA, 20 bp, Artificial
  CRISPR gRNA sequence
gcatctctcttgggacactc

SEQ ID NO: 3509 - DNA, 20 bp, Artificial
  CRISPR gRNA sequence
tctctcttgggacactccag

SEQ ID NO: 3510 - DNA, 20 bp, Artificial
  CRISPR gRNA sequence
agcgcccatgtgaccatcct

SEQ ID NO: 3511 - DNA, 20 bp, Artificial
  CRISPR gRNA sequence
ccatgtgaccatcctgagaa

SEQ ID NO: 3512 - DNA, 20 bp, Artificial
  CRISPR gRNA sequence
gtgaccatcctgagaatgga

SEQ ID NO: 3513 - DNA, 20 bp, Artificial
  CRISPR gRNA sequence
tgaccatcctgagaatggac

SEQ ID NO: 3514 - DNA, 20 bp, Artificial
  CRISPR gRNA sequence
ctgagaatggacaggacacc

SEQ ID NO: 3515 - DNA, 20 bp, Artificial
  CRISPR gRNA sequence
tgagaatggacaggacacct

SEQ ID NO: 3516 - DNA, 20 bp, Artificial
  CRISPR gRNA sequence
gagaatggacaggacacctg

SEQ ID NO: 3517 - DNA, 20 bp, Artificial
  CRISPR gRNA sequence
aatggacaggacacctgggg

SEQ ID NO: 3518 - DNA, 20 bp, Artificial
  CRISPR gRNA sequence
atggacaggacacctggggt

SEQ ID NO: 3519 - DNA, 20 bp, Artificial
  CRISPR gRNA sequence
tggacaggacacctggggtg

SEQ ID NO: 3520 - DNA, 20 bp, Artificial
  CRISPR gRNA sequence
acaggacacctggggtgggg

SEQ ID NO: 3521 - DNA, 20 bp, Artificial
  CRISPR gRNA sequence
caggacacctggggtgggga

SEQ ID NO: 3522 - DNA, 20 bp, Artificial
  CRISPR gRNA sequence
gacacctggggtggggaagg

SEQ ID NO: 3523 - DNA, 20 bp, Artificial
  CRISPR gRNA sequence
ctggggtggggaaggcggca

SEQ ID NO: 3524 - DNA, 20 bp, Artificial
  CRISPR gRNA sequence
ggggaaggcggcacagaacc

SEQ ID NO: 3525 - DNA, 20 bp, Artificial
  CRISPR gRNA sequence
gcggcacagaacccagacgc

SEQ ID NO: 3526 - DNA, 20 bp, Artificial
  CRISPR gRNA sequence
acagaacccagacgccagcc

SEQ ID NO: 3527 - DNA, 20 bp, Artificial
  CRISPR gRNA sequence
cccagacgccagcctggaca

SEQ ID NO: 3528 - DNA, 20 bp, Artificial
  CRISPR gRNA sequence
ccagacgccagcctggacac

SEQ ID NO: 3529 - DNA, 20 bp, Artificial
  CRISPR gRNA sequence
ccagcctggacacaggcacc

SEQ ID NO: 3530 - DNA, 20 bp, Artificial
  CRISPR gRNA sequence
cagcctggacacaggcacct

SEQ ID NO: 3531 - DNA, 20 bp, Artificial
  CRISPR gRNA sequence
tgggataatctcctattcat

SEQ ID NO: 3532 - DNA, 20 bp, Artificial
  CRISPR gRNA sequence
ataatctcctattcattgga

SEQ ID NO: 3533 - DNA, 20 bp, Artificial
  CRISPR gRNA sequence
tcctattcattggaaagttc

SEQ ID NO: 3534 - DNA, 20 bp, Artificial
  CRISPR gRNA sequence
attggaaagttctagtctct

SEQ ID NO: 3535 - DNA, 20 bp, Artificial
  CRISPR gRNA sequence
ttggaaagttctagtctctg

SEQ ID NO: 3536 - DNA, 20 bp, Artificial
  CRISPR gRNA sequence
tggaaagttctagtctctga

SEQ ID NO: 3537 - DNA, 20 bp, Artificial
  CRISPR gRNA sequence
gaaagttctagtctctgagg

SEQ ID NO: 3538 - DNA, 20 bp, Artificial
  CRISPR gRNA sequence
aaagttctagtctctgaggg

SEQ ID NO: 3539 - DNA, 20 bp, Artificial
  CRISPR gRNA sequence
tctagtctctgagggaggaa

SEQ ID NO: 3540 - DNA, 20 bp, Artificial
  CRISPR gRNA sequence
gagggaggaacagcgacttc

SEQ ID NO: 3541 - DNA, 20 bp, Artificial
  CRISPR gRNA sequence
gcgacttctggtcctgacct

SEQ ID NO: 3542 - DNA, 20 bp, Artificial
  CRISPR gRNA sequence
acttctggtcctgacctgag

SEQ ID NO: 3543 - DNA, 20 bp, Artificial
  CRISPR gRNA sequence
ttctggtcctgacctgagtg

SEQ ID NO: 3544 - DNA, 20 bp, Artificial
  CRISPR gRNA sequence
tctggtcctgacctgagtgg

SEQ ID NO: 3545 - DNA, 20 bp, Artificial
  CRISPR gRNA sequence
cctgacctgagtggaggctg

SEQ ID NO: 3546 - DNA, 20 bp, Artificial
  CRISPR gRNA sequence
ctgacctgagtggaggctgc

SEQ ID NO: 3547 - DNA, 20 bp, Artificial
  CRISPR gRNA sequence
tgagtggaggctgcaggact

SEQ ID NO: 3548 - DNA, 20 bp, Artificial
  CRISPR gRNA sequence
ggaggctgcaggactcagaa

SEQ ID NO: 3549 - DNA, 20 bp, Artificial
  CRISPR gRNA sequence
gctgcaggactcagaaaagc

SEQ ID NO: 3550 - DNA, 20 bp, Artificial
  CRISPR gRNA sequence
aaaagctggaatcaaacctt

SEQ ID NO: 3551 - DNA, 20 bp, Artificial
  CRISPR gRNA sequence
atcaaaccttcagacacatt

SEQ ID NO: 3552 - DNA, 20 bp, Artificial
  CRISPR gRNA sequence
ccttcagacacattgagtgt

SEQ ID NO: 3553 - DNA, 20 bp, Artificial
  CRISPR gRNA sequence
cttcagacacattgagtgtg

SEQ ID NO: 3554 - DNA, 20 bp, Artificial
  CRISPR gRNA sequence
cagacacattgagtgtgagg

SEQ ID NO: 3555 - DNA, 20 bp, Artificial
  CRISPR gRNA sequence
gacacattgagtgtgaggca

SEQ ID NO: 3556 - DNA, 20 bp, Artificial
  CRISPR gRNA sequence
ttgagtgtgaggcagagaac

SEQ ID NO: 3557 - DNA, 20 bp, Artificial
  CRISPR gRNA sequence
tgagtgtgaggcagagaaca

SEQ ID NO: 3558 - DNA, 20 bp, Artificial
  CRISPR gRNA sequence
tgaggcagagaacaaggcct

SEQ ID NO: 3559 - DNA, 20 bp, Artificial
  CRISPR gRNA sequence
aggcagagaacaaggcctga

SEQ ID NO: 3560 - DNA, 20 bp, Artificial
  CRISPR gRNA sequence
agagaacaaggcctgagaga

SEQ ID NO: 3561 - DNA, 20 bp, Artificial
  CRISPR gRNA sequence
gagaacaaggcctgagagaa

SEQ ID NO: 3562 - DNA, 20 bp, Artificial
  CRISPR gRNA sequence
acaaggcctgagagaaaggt

SEQ ID NO: 3563 - DNA, 20 bp, Artificial
  CRISPR gRNA sequence
aggcctgagagaaaggtcag

SEQ ID NO: 3564 - DNA, 20 bp, Artificial
  CRISPR gRNA sequence
aaaggtcagcagcctgacca

SEQ ID NO: 3565 - DNA, 20 bp, Artificial
  CRISPR gRNA sequence
cagcctgaccacagctgctg

SEQ ID NO: 3566 - DNA, 20 bp, Artificial
  CRISPR gRNA sequence
cctgaccacagctgctgcag

SEQ ID NO: 3567 - DNA, 20 bp, Artificial
  CRISPR gRNA sequence
cacagctgctgcagtggtca

SEQ ID NO: 3568 - DNA, 20 bp, Artificial
  CRISPR gRNA sequence
agctgctgcagtggtcaaag

SEQ ID NO: 3569 - DNA, 20 bp, Artificial
  CRISPR gRNA sequence
tgcagtggtcaaagtggtca

SEQ ID NO: 3570 - DNA, 20 bp, Artificial
  CRISPR gRNA sequence
gcagtggtcaaagtggtcaa

SEQ ID NO: 3571 - DNA, 20 bp, Artificial
  CRISPR gRNA sequence
agtggtcaaagtggtcaaag

SEQ ID NO: 3572 - DNA, 20 bp, Artificial
  CRISPR gRNA sequence
ggtcaaaggagacccctgat

SEQ ID NO: 3573 - DNA, 20 bp, Artificial
  CRISPR gRNA sequence
gagacccctgatcagtattc

SEQ ID NO: 3574 - DNA, 20 bp, Artificial
  CRISPR gRNA sequence
agacccctgatcagtattcc

SEQ ID NO: 3575 - DNA, 20 bp, Artificial
  CRISPR gRNA sequence
gacccctgatcagtattcca

SEQ ID NO: 3576 - DNA, 20 bp, Artificial
  CRISPR gRNA sequence
tgtcttcccctccatttcct

SEQ ID NO: 3577 - DNA, 20 bp, Artificial
  CRISPR gRNA sequence
tcttcccctccatttcctca

SEQ ID NO: 3578 - DNA, 20 bp, Artificial
  CRISPR gRNA sequence
acttcatcccttaattgtcc

SEQ ID NO: 3579 - DNA, 20 bp, Artificial
  CRISPR gRNA sequence
ttcatcccttaattgtccta

SEQ ID NO: 3580 - DNA, 20 bp, Artificial
  CRISPR gRNA sequence
catcccttaattgtcctaga

SEQ ID NO: 3581 - DNA, 20 bp, Artificial
  CRISPR gRNA sequence
cccttaattgtcctagagag

SEQ ID NO: 3582 - DNA, 20 bp, Artificial
  CRISPR gRNA sequence
cttaattgtcctagagagca

SEQ ID NO: 3583 - DNA, 20 bp, Artificial
  CRISPR gRNA sequence
ttaattgtcctagagagcag

SEQ ID NO: 3584 - DNA, 20 bp, Artificial
  CRISPR gRNA sequence
taattgtcctagagagcaga

SEQ ID NO: 3585 - DNA, 20 bp, Artificial
  CRISPR gRNA sequence
aattgtcctagagagcagag

SEQ ID NO: 3586 - DNA, 20 bp, Artificial
  CRISPR gRNA sequence
attgtcctagagagcagagg

SEQ ID NO: 3587 - DNA, 20 bp, Artificial
  CRISPR gRNA sequence
tagagagcagagggggccct

SEQ ID NO: 3588 - DNA, 20 bp, Artificial
  CRISPR gRNA sequence
gagagcagagggggccctca

SEQ ID NO: 3589 - DNA, 20 bp, Artificial
  CRISPR gRNA sequence
agagcagagggggccctcag

SEQ ID NO: 3590 - DNA, 20 bp, Artificial
  CRISPR gRNA sequence
gggggccctcagaggaaact

SEQ ID NO: 3591 - DNA, 20 bp, Artificial
  CRISPR gRNA sequence
ggggccctcagaggaaactc

SEQ ID NO: 3592 - DNA, 20 bp, Artificial
  CRISPR gRNA sequence
actcatgccattctccattc

SEQ ID NO: 3593 - DNA, 20 bp, Artificial
  CRISPR gRNA sequence
ctcatgccattctccattca

SEQ ID NO: 3594 - DNA, 20 bp, Artificial
  CRISPR gRNA sequence
tcatgccattctccattcaa

SEQ ID NO: 3595 - DNA, 20 bp, Artificial
  CRISPR gRNA sequence
atgccattctccattcaagg

SEQ ID NO: 3596 - DNA, 20 bp, Artificial
  CRISPR gRNA sequence
tgccattctccattcaaggg

SEQ ID NO: 3597 - DNA, 20 bp, Artificial
  CRISPR gRNA sequence
gccattctccattcaaggga

SEQ ID NO: 3598 - DNA, 20 bp, Artificial
  CRISPR gRNA sequence
ttcaagggagggcgatattc

SEQ ID NO: 3599 - DNA, 20 bp, Artificial
  CRISPR gRNA sequence
ccattttcctcccctcctcg

SEQ ID NO: 3600 - DNA, 20 bp, Artificial
  CRISPR gRNA sequence
cattttcctcccctcctcgt

SEQ ID NO: 3601 - DNA, 20 bp, Artificial
  CRISPR gRNA sequence
ttttcctcccctcctcgtgg

SEQ ID NO: 3602 - DNA, 20 bp, Artificial
  CRISPR gRNA sequence
tttcctcccctcctcgtggg

SEQ ID NO: 3603 - DNA, 20 bp, Artificial
  CRISPR gRNA sequence
ctcctcgtgggaggccatcc

SEQ ID NO: 3604 - DNA, 20 bp, Artificial
  CRISPR gRNA sequence
tcctcgtgggaggccatccc

SEQ ID NO: 3605 - DNA, 20 bp, Artificial
  CRISPR gRNA sequence
ctcgtgggaggccatcccgg

SEQ ID NO: 3606 - DNA, 20 bp, Artificial
  CRISPR gRNA sequence
aggccatcccgggagatcta

SEQ ID NO: 3607 - DNA, 20 bp, Artificial
  CRISPR gRNA sequence
ggccatcccgggagatctat

SEQ ID NO: 3608 - DNA, 20 bp, Artificial
  CRISPR gRNA sequence
ccatcccgggagatctatag

SEQ ID NO: 3609 - DNA, 20 bp, Artificial
  CRISPR gRNA sequence
cccgggagatctataggaga

SEQ ID NO: 3610 - DNA, 20 bp, Artificial
  CRISPR gRNA sequence
ccgggagatctataggagat

SEQ ID NO: 3611 - DNA, 20 bp, Artificial
  CRISPR gRNA sequence
cgggagatctataggagatg

SEQ ID NO: 3612 - DNA, 20 bp, Artificial
  CRISPR gRNA sequence
gagatctataggagatgggg

SEQ ID NO: 3613 - DNA, 20 bp, Artificial
  CRISPR gRNA sequence
agatctataggagatgggga

SEQ ID NO: 3614 - DNA, 20 bp, Artificial
  CRISPR gRNA sequence
ggaaggctccccactgcccc

SEQ ID NO: 3615 - DNA, 20 bp, Artificial
  CRISPR gRNA sequence
cccctggtacctgcgcgctg

SEQ ID NO: 3616 - DNA, 20 bp, Artificial
  CRISPR gRNA sequence
agcgtctccttcccgttctc

SEQ ID NO: 3617 - DNA, 20 bp, Artificial
  CRISPR gRNA sequence
gcgtctccttcccgttctcc

SEQ ID NO: 3618 - DNA, 20 bp, Artificial
  CRISPR gRNA sequence
tcccgttctccaggtatctg

SEQ ID NO: 3619 - DNA, 20 bp, Artificial
  CRISPR gRNA sequence
ccgttctccaggtatctgcg

SEQ ID NO: 3620 - DNA, 20 bp, Artificial
  CRISPR gRNA sequence
cactccacgcacgtgccctc

SEQ ID NO: 3621 - DNA, 20 bp, Artificial
  CRISPR gRNA sequence
actccacgcacgtgccctcc

SEQ ID NO: 3622 - DNA, 20 bp, Artificial
  CRISPR gRNA sequence
ccacgcacgtgccctccagg

SEQ ID NO: 3623 - DNA, 20 bp, Artificial
  CRISPR gRNA sequence
cacgcacgtgccctccaggt

SEQ ID NO: 3624 - DNA, 20 bp, Artificial
  CRISPR gRNA sequence
gtgccctccaggtaggctct

SEQ ID NO: 3625 - DNA, 20 bp, Artificial
  CRISPR gRNA sequence
ctctcagctgctccgccgca

SEQ ID NO: 3626 - DNA, 20 bp, Artificial
  CRISPR gRNA sequence
tctcagctgctccgccgcac

SEQ ID NO: 3627 - DNA, 20 bp, Artificial
  CRISPR gRNA sequence
gggccgcctccaacttgcgc

SEQ ID NO: 3628 - DNA, 20 bp, Artificial
  CRISPR gRNA sequence
ggccgcctccaacttgcgct

SEQ ID NO: 3629 - DNA, 20 bp, Artificial
  CRISPR gRNA sequence
caacttgcgctgggtgatct

SEQ ID NO: 3630 - DNA, 20 bp, Artificial
  CRISPR gRNA sequence
gcgctgggtgatctgagccg

SEQ ID NO: 3631 - DNA, 20 bp, Artificial
  CRISPR gRNA sequence
gatctgagccgcggtgtccg

SEQ ID NO: 3632 - DNA, 20 bp, Artificial
  CRISPR gRNA sequence
ctgagccgcggtgtccgcgg

SEQ ID NO: 3633 - DNA, 20 bp, Artificial
  CRISPR gRNA sequence
ccgcggtgtccgcggcggtc

SEQ ID NO: 3634 - DNA, 20 bp, Artificial
  CRISPR gRNA sequence
cgcggtgtccgcggcggtcc

SEQ ID NO: 3635 - DNA, 20 bp, Artificial
  CRISPR gRNA sequence
cggtgtccgcggcggtccag

SEQ ID NO: 3636 - DNA, 20 bp, Artificial
  CRISPR gRNA sequence
tccgcggcggtccaggagcg

SEQ ID NO: 3637 - DNA, 20 bp, Artificial
  CRISPR gRNA sequence
ccgcggcggtccaggagcgc

SEQ ID NO: 3638 - DNA, 20 bp, Artificial
  CRISPR gRNA sequence
caggagcgcaggtcctcgtt

SEQ ID NO: 3639 - DNA, 20 bp, Artificial
  CRISPR gRNA sequence
aggagcgcaggtcctcgttc

SEQ ID NO: 3640 - DNA, 20 bp, Artificial
  CRISPR gRNA sequence
ggagcgcaggtcctcgttca

SEQ ID NO: 3641 - DNA, 20 bp, Artificial
  CRISPR gRNA sequence
cgatgtaatccttgccgtcg

SEQ ID NO: 3642 - DNA, 20 bp, Artificial
  CRISPR gRNA sequence
gatgtaatccttgccgtcgt

SEQ ID NO: 3643 - DNA, 20 bp, Artificial
  CRISPR gRNA sequence
gtaatccttgccgtcgtagg

SEQ ID NO: 3644 - DNA, 20 bp, Artificial
  CRISPR gRNA sequence
ccttgccgtcgtaggcggac

SEQ ID NO: 3645 - DNA, 20 bp, Artificial
  CRISPR gRNA sequence
aggcggactggtcatacccg

SEQ ID NO: 3646 - DNA, 20 bp, Artificial
  CRISPR gRNA sequence
gcggactggtcatacccgcg

SEQ ID NO: 3647 - DNA, 20 bp, Artificial
  CRISPR gRNA sequence
cggactggtcatacccgcgg

SEQ ID NO: 3648 - DNA, 20 bp, Artificial
  CRISPR gRNA sequence
gactggtcatacccgcggag

SEQ ID NO: 3649 - DNA, 20 bp, Artificial
  CRISPR gRNA sequence
actggtcatacccgcggagg

SEQ ID NO: 3650 - DNA, 20 bp, Artificial
  CRISPR gRNA sequence
cccgcggaggaggcgcccgt

SEQ ID NO: 3651 - DNA, 20 bp, Artificial
  CRISPR gRNA sequence
ccgcggaggaggcgcccgtc

SEQ ID NO: 3652 - DNA, 20 bp, Artificial
  CRISPR gRNA sequence
aggaggcgcccgtcgggccc

SEQ ID NO: 3653 - DNA, 20 bp, Artificial
  CRISPR gRNA sequence
ggaggcgcccgtcgggcccc

SEQ ID NO: 3654 - DNA, 20 bp, Artificial
  CRISPR gRNA sequence
gcccgtcgggccccaggtcg

SEQ ID NO: 3655 - DNA, 20 bp, Artificial
  CRISPR gRNA sequence
ggtcgcagccatacatcctc

SEQ ID NO: 3656 - DNA, 20 bp, Artificial
  CRISPR gRNA sequence
tcgcagccatacatcctctg

SEQ ID NO: 3657 - DNA, 20 bp, Artificial
  CRISPR gRNA sequence
cgcagccatacatcctctgg

SEQ ID NO: 3658 - DNA, 20 bp, Artificial
  CRISPR gRNA sequence
gcagccatacatcctctgga

SEQ ID NO: 3659 - DNA, 20 bp, Artificial
  CRISPR gRNA sequence
atacatcctctggagggtgt

SEQ ID NO: 3660 - DNA, 20 bp, Artificial
  CRISPR gRNA sequence
ctctggagggtgtgagaccc

SEQ ID NO: 3661 - DNA, 20 bp, Artificial
  CRISPR gRNA sequence
agaccctggccccgcccccg

SEQ ID NO: 3662 - DNA, 20 bp, Artificial
  CRISPR gRNA sequence
cctggccccgcccccgcggt

SEQ ID NO: 3663 - DNA, 20 bp, Artificial
  CRISPR gRNA sequence
ccccgcccccgcggtcagcc

SEQ ID NO: 3664 - DNA, 20 bp, Artificial
  CRISPR gRNA sequence
cgcggtcagcccagtccccc

SEQ ID NO: 3665 - DNA, 20 bp, Artificial
  CRISPR gRNA sequence
gccccgccccgaccaacccg

SEQ ID NO: 3666 - DNA, 20 bp, Artificial
  CRISPR gRNA sequence
ccccgccccgaccaacccgc

SEQ ID NO: 3667 - DNA, 20 bp, Artificial
  CRISPR gRNA sequence
cccgccccgaccaacccgcg

SEQ ID NO: 3668 - DNA, 20 bp, Artificial
  CRISPR gRNA sequence
cgaccaacccgcggggattt

SEQ ID NO: 3669 - DNA, 20 bp, Artificial
  CRISPR gRNA sequence
gcctaaaccgaaaatgaaac

SEQ ID NO: 3670 - DNA, 20 bp, Artificial
  CRISPR gRNA sequence
cctaaaccgaaaatgaaacc

SEQ ID NO: 3671 - DNA, 20 bp, Artificial
  CRISPR gRNA sequence
accgaaaatgaaaccgggta

SEQ ID NO: 3672 - DNA, 20 bp, Artificial
  CRISPR gRNA sequence
ccgaaaatgaaaccgggtaa

SEQ ID NO: 3673 - DNA, 20 bp, Artificial
  CRISPR gRNA sequence
tgaaaccgggtaaaggcgac

SEQ ID NO: 3674 - DNA, 20 bp, Artificial
  CRISPR gRNA sequence
gaaaccgggtaaaggcgact

SEQ ID NO: 3675 - DNA, 20 bp, Artificial
  CRISPR gRNA sequence
aaaccgggtaaaggcgactg

SEQ ID NO: 3676 - DNA, 20 bp, Artificial
  CRISPR gRNA sequence
aaggcgactggggctctctc

SEQ ID NO: 3677 - DNA, 20 bp, Artificial
  CRISPR gRNA sequence
gactggggctctctccggtc

SEQ ID NO: 3678 - DNA, 20 bp, Artificial
  CRISPR gRNA sequence
actggggctctctccggtcg

SEQ ID NO: 3679 - DNA, 20 bp, Artificial
  CRISPR gRNA sequence
ctggggctctctccggtcga

SEQ ID NO: 3680 - DNA, 20 bp, Artificial
  CRISPR gRNA sequence
gctctctccggtcgagggtc

SEQ ID NO: 3681 - DNA, 20 bp, Artificial
  CRISPR gRNA sequence
ctctctccggtcgagggtct

SEQ ID NO: 3682 - DNA, 20 bp, Artificial
  CRISPR gRNA sequence
tctccggtcgagggtctggg

SEQ ID NO: 3683 - DNA, 20 bp, Artificial
  CRISPR gRNA sequence
ctccggtcgagggtctgggc

SEQ ID NO: 3684 - DNA, 20 bp, Artificial
  CRISPR gRNA sequence
gagggtctgggcgggttccg

SEQ ID NO: 3685 - DNA, 20 bp, Artificial
  CRISPR gRNA sequence
cgggttccgcagatccacct

SEQ ID NO: 3686 - DNA, 20 bp, Artificial
  CRISPR gRNA sequence
gggttccgcagatccacctt

SEQ ID NO: 3687 - DNA, 20 bp, Artificial
  CRISPR gRNA sequence
ggttccgcagatccaccttg

SEQ ID NO: 3688 - DNA, 20 bp, Artificial
  CRISPR gRNA sequence
tccgcagatccaccttgggg

SEQ ID NO: 3689 - DNA, 20 bp, Artificial
  CRISPR gRNA sequence
atccaccttggggtggatct

SEQ ID NO: 3690 - DNA, 20 bp, Artificial
  CRISPR gRNA sequence
accttggggtggatctcaga

SEQ ID NO: 3691 - DNA, 20 bp, Artificial
  CRISPR gRNA sequence
ccttggggtggatctcagac

SEQ ID NO: 3692 - DNA, 20 bp, Artificial
  CRISPR gRNA sequence
cttggggtggatctcagacg

SEQ ID NO: 3693 - DNA, 20 bp, Artificial
  CRISPR gRNA sequence
tggggtggatctcagacggg

SEQ ID NO: 3694 - DNA, 20 bp, Artificial
  CRISPR gRNA sequence
ggatctcagacggggagact

SEQ ID NO: 3695 - DNA, 20 bp, Artificial
  CRISPR gRNA sequence
gatctcagacggggagactc

SEQ ID NO: 3696 - DNA, 20 bp, Artificial
  CRISPR gRNA sequence
atctcagacggggagactcg

SEQ ID NO: 3697 - DNA, 20 bp, Artificial
  CRISPR gRNA sequence
cggggagactcggggcgacc

SEQ ID NO: 3698 - DNA, 20 bp, Artificial
  CRISPR gRNA sequence
ggggagactcggggcgaccc

SEQ ID NO: 3699 - DNA, 20 bp, Artificial
  CRISPR gRNA sequence
ggggcgacccgggccgtccg

SEQ ID NO: 3700 - DNA, 20 bp, Artificial
  CRISPR gRNA sequence
gggcgacccgggccgtccgt

SEQ ID NO: 3701 - DNA, 20 bp, Artificial
  CRISPR gRNA sequence
ggcgacccgggccgtccgtg

SEQ ID NO: 3702 - DNA, 20 bp, Artificial
  CRISPR gRNA sequence
gcgacccgggccgtccgtgg

SEQ ID NO: 3703 - DNA, 20 bp, Artificial
  CRISPR gRNA sequence
cccgggccgtccgtggggga

SEQ ID NO: 3704 - DNA, 20 bp, Artificial
  CRISPR gRNA sequence
ccgggccgtccgtgggggat

SEQ ID NO: 3705 - DNA, 20 bp, Artificial
  CRISPR gRNA sequence
cgggccgtccgtgggggatg

SEQ ID NO: 3706 - DNA, 20 bp, Artificial
  CRISPR gRNA sequence
ggccgtccgtgggggatggg

SEQ ID NO: 3707 - DNA, 20 bp, Artificial
  CRISPR gRNA sequence
gccgtccgtgggggatgggg

SEQ ID NO: 3708 - DNA, 20 bp, Artificial
  CRISPR gRNA sequence
ccgtccgtgggggatgggga

SEQ ID NO: 3709 - DNA, 20 bp, Artificial
  CRISPR gRNA sequence
cgtccgtgggggatggggag

SEQ ID NO: 3710 - DNA, 20 bp, Artificial
  CRISPR gRNA sequence
aggggtcgtgacctgcgccc

SEQ ID NO: 3711 - DNA, 20 bp, Artificial
  CRISPR gRNA sequence
ggggtcgtgacctgcgcccc

SEQ ID NO: 3712 - DNA, 20 bp, Artificial
  CRISPR gRNA sequence
tcgtgacctgcgccccgggc

SEQ ID NO: 3713 - DNA, 20 bp, Artificial
  CRISPR gRNA sequence
cgtgacctgcgccccgggcc

SEQ ID NO: 3714 - DNA, 20 bp, Artificial
  CRISPR gRNA sequence
gtgacctgcgccccgggccg

SEQ ID NO: 3715 - DNA, 20 bp, Artificial
  CRISPR gRNA sequence
gtcactcaccgtcctcgctc

SEQ ID NO: 3716 - DNA, 20 bp, Artificial
  CRISPR gRNA sequence
caccgtcctcgctctggttg

SEQ ID NO: 3717 - DNA, 20 bp, Artificial
  CRISPR gRNA sequence
cgtcctcgctctggttgtag

SEQ ID NO: 3718 - DNA, 20 bp, Artificial
  CRISPR gRNA sequence
ctctggttgtagtagccgcg

SEQ ID NO: 3719 - DNA, 20 bp, Artificial
  CRISPR gRNA sequence
tctggttgtagtagccgcgc

SEQ ID NO: 3720 - DNA, 20 bp, Artificial
  CRISPR gRNA sequence
tagtagccgcgcaggttccg

SEQ ID NO: 3721 - DNA, 20 bp, Artificial
  CRISPR gRNA sequence
agtagccgcgcaggttccgc

SEQ ID NO: 3722 - DNA, 20 bp, Artificial
  CRISPR gRNA sequence
gcaggttccgcaggctcact

SEQ ID NO: 3723 - DNA, 20 bp, Artificial
  CRISPR gRNA sequence
gttccgcaggctcactcggt

SEQ ID NO: 3724 - DNA, 20 bp, Artificial
  CRISPR gRNA sequence
tcactcggtcagcctgtgcc

SEQ ID NO: 3725 - DNA, 20 bp, Artificial
  CRISPR gRNA sequence
cagcctgtgcctggcgcttg

SEQ ID NO: 3726 - DNA, 20 bp, Artificial
  CRISPR gRNA sequence
gcttgtagttctgtgtctcc

SEQ ID NO: 3727 - DNA, 20 bp, Artificial
  CRISPR gRNA sequence
gtctcccggtcccaatactc

SEQ ID NO: 3728 - DNA, 20 bp, Artificial
  CRISPR gRNA sequence
ggcccctcctgctccaccca

SEQ ID NO: 3729 - DNA, 20 bp, Artificial
  CRISPR gRNA sequence
tgctccacccacggcgcccg

SEQ ID NO: 3730 - DNA, 20 bp, Artificial
  CRISPR gRNA sequence
ggcgcccgcggctcccctct

SEQ ID NO: 3731 - DNA, 20 bp, Artificial
  CRISPR gRNA sequence
cggctcccctctcggactcg

SEQ ID NO: 3732 - DNA, 20 bp, Artificial
  CRISPR gRNA sequence
cgaactgcgtgtcgtccacg

SEQ ID NO: 3733 - DNA, 20 bp, Artificial
  CRISPR gRNA sequence
tgtcgtccacgtagcccact

SEQ ID NO: 3734 - DNA, 20 bp, Artificial
  CRISPR gRNA sequence
ccacgtagcccactgagatg

SEQ ID NO: 3735 - DNA, 20 bp, Artificial
  CRISPR gRNA sequence
cgtagcccactgagatgaag

SEQ ID NO: 3736 - DNA, 20 bp, Artificial
  CRISPR gRNA sequence
gtagcccactgagatgaagc

SEQ ID NO: 3737 - DNA, 20 bp, Artificial
  CRISPR gRNA sequence
tagcccactgagatgaagcg

SEQ ID NO: 3738 - DNA, 20 bp, Artificial
  CRISPR gRNA sequence
agatgaagcggggctctccg

SEQ ID NO: 3739 - DNA, 20 bp, Artificial
  CRISPR gRNA sequence
gaagcggggctctccgcggc

SEQ ID NO: 3740 - DNA, 20 bp, Artificial
  CRISPR gRNA sequence
aagcggggctctccgcggcc

SEQ ID NO: 3741 - DNA, 20 bp, Artificial
  CRISPR gRNA sequence
ggggctctccgcggccgggc

SEQ ID NO: 3742 - DNA, 20 bp, Artificial
  CRISPR gRNA sequence
gggctctccgcggccgggcc

SEQ ID NO: 3743 - DNA, 20 bp, Artificial
  CRISPR gRNA sequence
tccgcggccgggccgggaca

SEQ ID NO: 3744 - DNA, 20 bp, Artificial
  CRISPR gRNA sequence
gcggccgggccgggacacgg

SEQ ID NO: 3745 - DNA, 20 bp, Artificial
  CRISPR gRNA sequence
ggcggtgtcgaaatacctca

SEQ ID NO: 3746 - DNA, 20 bp, Artificial
  CRISPR gRNA sequence
cggtgtcgaaatacctcatg

SEQ ID NO: 3747 - DNA, 20 bp, Artificial
  CRISPR gRNA sequence
tgtcgaaatacctcatggag

SEQ ID NO: 3748 - DNA, 20 bp, Artificial
  CRISPR gRNA sequence
gtcgaaatacctcatggagt

SEQ ID NO: 3749 - DNA, 20 bp, Artificial
  CRISPR gRNA sequence
cgaaatacctcatggagtgg

SEQ ID NO: 3750 - DNA, 20 bp, Artificial
  CRISPR gRNA sequence
tacctcatggagtgggagcc

SEQ ID NO: 3751 - DNA, 20 bp, Artificial
  CRISPR gRNA sequence
acctcatggagtgggagcct

SEQ ID NO: 3752 - DNA, 20 bp, Artificial
  CRISPR gRNA sequence
cctcatggagtgggagcctg

SEQ ID NO: 3753 - DNA, 20 bp, Artificial
  CRISPR gRNA sequence
ctcatggagtgggagcctgg

SEQ ID NO: 3754 - DNA, 20 bp, Artificial
  CRISPR gRNA sequence
tggagtgggagcctgggggc

SEQ ID NO: 3755 - DNA, 20 bp, Artificial
  CRISPR gRNA sequence
ggagtgggagcctgggggcg

SEQ ID NO: 3756 - DNA, 20 bp, Artificial
  CRISPR gRNA sequence
agtgggagcctgggggcgag

SEQ ID NO: 3757 - DNA, 20 bp, Artificial
  CRISPR gRNA sequence
gtgggagcctgggggcgagg

SEQ ID NO: 3758 - DNA, 20 bp, Artificial
  CRISPR gRNA sequence
tgggagcctgggggcgagga

SEQ ID NO: 3759 - DNA, 20 bp, Artificial
  CRISPR gRNA sequence
gggagcctgggggcgaggag

SEQ ID NO: 3760 - DNA, 20 bp, Artificial
  CRISPR gRNA sequence
cctgggggcgaggaggggct

SEQ ID NO: 3761 - DNA, 20 bp, Artificial
  CRISPR gRNA sequence
gcccgacccacctccctgcg

SEQ ID NO: 3762 - DNA, 20 bp, Artificial
  CRISPR gRNA sequence
cacctccctgcgcggctccc

SEQ ID NO: 3763 - DNA, 20 bp, Artificial
  CRISPR gRNA sequence
acctccctgcgcggctcccc

SEQ ID NO: 3764 - DNA, 20 bp, Artificial
  CRISPR gRNA sequence
cccgggtcctgcgccctcgc

SEQ ID NO: 3765 - DNA, 20 bp, Artificial
  CRISPR gRNA sequence
ccgggtcctgcgccctcgcc

SEQ ID NO: 3766 - DNA, 20 bp, Artificial
  CRISPR gRNA sequence
ggtcctgcgccctcgccggg

SEQ ID NO: 3767 - DNA, 20 bp, Artificial
  CRISPR gRNA sequence
gtcctgcgccctcgccgggc

SEQ ID NO: 3768 - DNA, 20 bp, Artificial
  CRISPR gRNA sequence
gggcccctcgctcctctccg

SEQ ID NO: 3769 - DNA, 20 bp, Artificial
  CRISPR gRNA sequence
gcccctcgctcctctccgca

SEQ ID NO: 3770 - DNA, 20 bp, Artificial
  CRISPR gRNA sequence
cccctcgctcctctccgcag

SEQ ID NO: 3771 - DNA, 20 bp, Artificial
  CRISPR gRNA sequence
ccctcccaaccccgcactca

SEQ ID NO: 3772 - DNA, 20 bp, Artificial
  CRISPR gRNA sequence
cctcccaaccccgcactcac

SEQ ID NO: 3773 - DNA, 20 bp, Artificial
  CRISPR gRNA sequence
caaccccgcactcacaggcc

SEQ ID NO: 3774 - DNA, 20 bp, Artificial
  CRISPR gRNA sequence
aaccccgcactcacaggccc

SEQ ID NO: 3775 - DNA, 20 bp, Artificial
  CRISPR gRNA sequence
gcactcacaggcccaggtct

SEQ ID NO: 3776 - DNA, 20 bp, Artificial
  CRISPR gRNA sequence
tcacaggcccaggtctcggt

SEQ ID NO: 3777 - DNA, 20 bp, Artificial
  CRISPR gRNA sequence
cacaggcccaggtctcggtc

SEQ ID NO: 3778 - DNA, 20 bp, Artificial
  CRISPR gRNA sequence
acaggcccaggtctcggtca

SEQ ID NO: 3779 - DNA, 20 bp, Artificial
  CRISPR gRNA sequence
gcccaggtctcggtcagggc

SEQ ID NO: 3780 - DNA, 20 bp, Artificial
  CRISPR gRNA sequence
cccaggtctcggtcagggcc

SEQ ID NO: 3781 - DNA, 20 bp, Artificial
  CRISPR gRNA sequence
cggtcagggccaggcctccc

SEQ ID NO: 3782 - DNA, 20 bp, Artificial
  CRISPR gRNA sequence
gtcagggccaggcctcccga

SEQ ID NO: 3783 - DNA, 20 bp, Artificial
  CRISPR gRNA sequence
agggccaggcctcccgagag

SEQ ID NO: 3784 - DNA, 20 bp, Artificial
  CRISPR gRNA sequence
gccaggcctcccgagagcag

SEQ ID NO: 3785 - DNA, 20 bp, Artificial
  CRISPR gRNA sequence
ccaggcctcccgagagcagc

SEQ ID NO: 3786 - DNA, 20 bp, Artificial
  CRISPR gRNA sequence
aggcctcccgagagcagcag

SEQ ID NO: 3787 - DNA, 20 bp, Artificial
  CRISPR gRNA sequence
ggcctcccgagagcagcagg

SEQ ID NO: 3788 - DNA, 20 bp, Artificial
  CRISPR gRNA sequence
cctcccgagagcagcaggag

SEQ ID NO: 3789 - DNA, 20 bp, Artificial
  CRISPR gRNA sequence
ctcccgagagcagcaggagg

SEQ ID NO: 3790 - DNA, 20 bp, Artificial
  CRISPR gRNA sequence
tcccgagagcagcaggagga

SEQ ID NO: 3791 - DNA, 20 bp, Artificial
  CRISPR gRNA sequence
agagcagcaggaggagggct

SEQ ID NO: 3792 - DNA, 20 bp, Artificial
  CRISPR gRNA sequence
gagcagcaggaggagggctc

SEQ ID NO: 3793 - DNA, 20 bp, Artificial
  CRISPR gRNA sequence
agcagcaggaggagggctcg

SEQ ID NO: 3794 - DNA, 20 bp, Artificial
  CRISPR gRNA sequence
gggcgccatgacccgcatct

SEQ ID NO: 3795 - DNA, 20 bp, Artificial
  CRISPR gRNA sequence
atgacccgcatctcggcctc

SEQ ID NO: 3796 - DNA, 20 bp, Artificial
  CRISPR gRNA sequence
tgacccgcatctcggcctct

SEQ ID NO: 3797 - DNA, 20 bp, Artificial
  CRISPR gRNA sequence
gacccgcatctcggcctctg

SEQ ID NO: 3798 - DNA, 20 bp, Artificial
  CRISPR gRNA sequence
cccgcatctcggcctctggg

SEQ ID NO: 3799 - DNA, 20 bp, Artificial
  CRISPR gRNA sequence
tcggcctctggggagaatgt

SEQ ID NO: 3800 - DNA, 20 bp, Artificial
  CRISPR gRNA sequence
ctctggggagaatgtgagtc

SEQ ID NO: 3801 - DNA, 20 bp, Artificial
  CRISPR gRNA sequence
tctggggagaatgtgagtcc

SEQ ID NO: 3802 - DNA, 20 bp, Artificial
  CRISPR gRNA sequence
ggggagaatgtgagtccggg

SEQ ID NO: 3803 - DNA, 20 bp, Artificial
  CRISPR gRNA sequence
gggagaatgtgagtccgggt

SEQ ID NO: 3804 - DNA, 20 bp, Artificial
  CRISPR gRNA sequence
tgtgagtccgggtgggtgac

SEQ ID NO: 3805 - DNA, 20 bp, Artificial
  CRISPR gRNA sequence
gtgagtccgggtgggtgact

SEQ ID NO: 3806 - DNA, 20 bp, Artificial
  CRISPR gRNA sequence
tgagtccgggtgggtgactg

SEQ ID NO: 3807 - DNA, 20 bp, Artificial
  CRISPR gRNA sequence
gggtgggtgactggggactt

SEQ ID NO: 3808 - DNA, 20 bp, Artificial
  CRISPR gRNA sequence
gtgactggggactttagaac

SEQ ID NO: 3809 - DNA, 20 bp, Artificial
  CRISPR gRNA sequence
tgactggggactttagaacc

SEQ ID NO: 3810 - DNA, 20 bp, Artificial
  CRISPR gRNA sequence
ggactttagaaccgggactg

SEQ ID NO: 3811 - DNA, 20 bp, Artificial
  CRISPR gRNA sequence
actttagaaccgggactgcg

SEQ ID NO: 3812 - DNA, 20 bp, Artificial
  CRISPR gRNA sequence
gggactgcggagacgctgat

SEQ ID NO: 3813 - DNA, 20 bp, Artificial
  CRISPR gRNA sequence
gagacgctgattggcttctc

SEQ ID NO: 3814 - DNA, 20 bp, Artificial
  CRISPR gRNA sequence
ttgggtgtcgggttctagag

SEQ ID NO: 3815 - DNA, 20 bp, Artificial
  CRISPR gRNA sequence
cgggttctagagaagccaat

SEQ ID NO: 3816 - DNA, 20 bp, Artificial
  CRISPR gRNA sequence
gaagccaatcagcgtctccg

SEQ ID NO: 3817 - DNA, 20 bp, Artificial
  CRISPR gRNA sequence
aatcagcgtctccgcagtcc

SEQ ID NO: 3818 - DNA, 20 bp, Artificial
  CRISPR gRNA sequence
tctccgcagtcccggttcta

SEQ ID NO: 3819 - DNA, 20 bp, Artificial
  CRISPR gRNA sequence
agtcccggttctaaagtccc

SEQ ID NO: 3820 - DNA, 20 bp, Artificial
  CRISPR gRNA sequence
aaagtccccagtcacccacc

SEQ ID NO: 3821 - DNA, 20 bp, Artificial
  CRISPR gRNA sequence
acccggactcacattctccc

SEQ ID NO: 3822 - DNA, 20 bp, Artificial
  CRISPR gRNA sequence
ccggactcacattctcccca

SEQ ID NO: 3823 - DNA, 20 bp, Artificial
  CRISPR gRNA sequence
cggactcacattctccccag

SEQ ID NO: 3824 - DNA, 20 bp, Artificial
  CRISPR gRNA sequence
tcacattctccccagaggcc

SEQ ID NO: 3825 - DNA, 20 bp, Artificial
  CRISPR gRNA sequence
tctccccagaggccgagatg

SEQ ID NO: 3826 - DNA, 20 bp, Artificial
  CRISPR gRNA sequence
ctccccagaggccgagatgc

SEQ ID NO: 3827 - DNA, 20 bp, Artificial
  CRISPR gRNA sequence
agaggccgagatgcgggtca

SEQ ID NO: 3828 - DNA, 20 bp, Artificial
  CRISPR gRNA sequence
gatgcgggtcatggcgcccc

SEQ ID NO: 3829 - DNA, 20 bp, Artificial
  CRISPR gRNA sequence
agccctcctcctgctgctct

SEQ ID NO: 3830 - DNA, 20 bp, Artificial
  CRISPR gRNA sequence
gccctcctcctgctgctctc

SEQ ID NO: 3831 - DNA, 20 bp, Artificial
  CRISPR gRNA sequence
cctcctcctgctgctctcgg

SEQ ID NO: 3832 - DNA, 20 bp, Artificial
  CRISPR gRNA sequence
ctcctcctgctgctctcggg

SEQ ID NO: 3833 - DNA, 20 bp, Artificial
  CRISPR gRNA sequence
cctgctgctctcgggaggcc

SEQ ID NO: 3834 - DNA, 20 bp, Artificial
  CRISPR gRNA sequence
cgggaggcctggccctgacc

SEQ ID NO: 3835 - DNA, 20 bp, Artificial
  CRISPR gRNA sequence
gcctggccctgaccgagacc

SEQ ID NO: 3836 - DNA, 20 bp, Artificial
  CRISPR gRNA sequence
cctggccctgaccgagacct

SEQ ID NO: 3837 - DNA, 20 bp, Artificial
  CRISPR gRNA sequence
tgaccgagacctgggcctgt

SEQ ID NO: 3838 - DNA, 20 bp, Artificial
  CRISPR gRNA sequence
gagacctgggcctgtgagtg

SEQ ID NO: 3839 - DNA, 20 bp, Artificial
  CRISPR gRNA sequence
agacctgggcctgtgagtgc

SEQ ID NO: 3840 - DNA, 20 bp, Artificial
  CRISPR gRNA sequence
gacctgggcctgtgagtgcg

SEQ ID NO: 3841 - DNA, 20 bp, Artificial
  CRISPR gRNA sequence
tgggcctgtgagtgcggggt

SEQ ID NO: 3842 - DNA, 20 bp, Artificial
  CRISPR gRNA sequence
gggcctgtgagtgcggggtt

SEQ ID NO: 3843 - DNA, 20 bp, Artificial
  CRISPR gRNA sequence
gcctgtgagtgcggggttgg

SEQ ID NO: 3844 - DNA, 20 bp, Artificial
  CRISPR gRNA sequence
cctgtgagtgcggggttggg

SEQ ID NO: 3845 - DNA, 20 bp, Artificial
  CRISPR gRNA sequence
ctgtgagtgcggggttggga

SEQ ID NO: 3846 - DNA, 20 bp, Artificial
  CRISPR gRNA sequence
tgagtgcggggttgggaggg

SEQ ID NO: 3847 - DNA, 20 bp, Artificial
  CRISPR gRNA sequence
gtgcggggttgggagggaag

SEQ ID NO: 3848 - DNA, 20 bp, Artificial
  CRISPR gRNA sequence
tgggagggaagcggcctctg

SEQ ID NO: 3849 - DNA, 20 bp, Artificial
  CRISPR gRNA sequence
ggagggaagcggcctctgcg

SEQ ID NO: 3850 - DNA, 20 bp, Artificial
  CRISPR gRNA sequence
agggaagcggcctctgcgga

SEQ ID NO: 3851 - DNA, 20 bp, Artificial
  CRISPR gRNA sequence
gggaagcggcctctgcggag

SEQ ID NO: 3852 - DNA, 20 bp, Artificial
  CRISPR gRNA sequence
gaagcggcctctgcggagag

SEQ ID NO: 3853 - DNA, 20 bp, Artificial
  CRISPR gRNA sequence
cggcctctgcggagaggagc

SEQ ID NO: 3854 - DNA, 20 bp, Artificial
  CRISPR gRNA sequence
ggcctctgcggagaggagcg

SEQ ID NO: 3855 - DNA, 20 bp, Artificial
  CRISPR gRNA sequence
gcctctgcggagaggagcga

SEQ ID NO: 3856 - DNA, 20 bp, Artificial
  CRISPR gRNA sequence
cctctgcggagaggagcgag

SEQ ID NO: 3857 - DNA, 20 bp, Artificial
  CRISPR gRNA sequence
agaggagcgaggggcccgcc

SEQ ID NO: 3858 - DNA, 20 bp, Artificial
  CRISPR gRNA sequence
gagcgaggggcccgcccggc

SEQ ID NO: 3859 - DNA, 20 bp, Artificial
  CRISPR gRNA sequence
agcgaggggcccgcccggcg

SEQ ID NO: 3860 - DNA, 20 bp, Artificial
  CRISPR gRNA sequence
gcgaggggcccgcccggcga

SEQ ID NO: 3861 - DNA, 20 bp, Artificial
  CRISPR gRNA sequence
gggcccgcccggcgagggcg

SEQ ID NO: 3862 - DNA, 20 bp, Artificial
  CRISPR gRNA sequence
ggcccgcccggcgagggcgc

SEQ ID NO: 3863 - DNA, 20 bp, Artificial
  CRISPR gRNA sequence
cccggcgagggcgcaggacc

SEQ ID NO: 3864 - DNA, 20 bp, Artificial
  CRISPR gRNA sequence
ccggcgagggcgcaggaccc

SEQ ID NO: 3865 - DNA, 20 bp, Artificial
  CRISPR gRNA sequence
cggcgagggcgcaggacccg

SEQ ID NO: 3866 - DNA, 20 bp, Artificial
  CRISPR gRNA sequence
gcgagggcgcaggacccggg

SEQ ID NO: 3867 - DNA, 20 bp, Artificial
  CRISPR gRNA sequence
gcaggacccggggagccgcg

SEQ ID NO: 3868 - DNA, 20 bp, Artificial
  CRISPR gRNA sequence
caggacccggggagccgcgc

SEQ ID NO: 3869 - DNA, 20 bp, Artificial
  CRISPR gRNA sequence
aggacccggggagccgcgca

SEQ ID NO: 3870 - DNA, 20 bp, Artificial
  CRISPR gRNA sequence
gacccggggagccgcgcagg

SEQ ID NO: 3871 - DNA, 20 bp, Artificial
  CRISPR gRNA sequence
acccggggagccgcgcaggg

SEQ ID NO: 3872 - DNA, 20 bp, Artificial
  CRISPR gRNA sequence
cggggagccgcgcagggagg

SEQ ID NO: 3873 - DNA, 20 bp, Artificial
  CRISPR gRNA sequence
ggggagccgcgcagggaggt

SEQ ID NO: 3874 - DNA, 20 bp, Artificial
  CRISPR gRNA sequence
agccgcgcagggaggtgggt

SEQ ID NO: 3875 - DNA, 20 bp, Artificial
  CRISPR gRNA sequence
gccgcgcagggaggtgggtc

SEQ ID NO: 3876 - DNA, 20 bp, Artificial
  CRISPR gRNA sequence
gcgcagggaggtgggtcggg

SEQ ID NO: 3877 - DNA, 20 bp, Artificial
  CRISPR gRNA sequence
cgcagggaggtgggtcgggc

SEQ ID NO: 3878 - DNA, 20 bp, Artificial
  CRISPR gRNA sequence
gaggtgggtcgggcgggtct

SEQ ID NO: 3879 - DNA, 20 bp, Artificial
  CRISPR gRNA sequence
tctcagcccctcctcgcccc

SEQ ID NO: 3880 - DNA, 20 bp, Artificial
  CRISPR gRNA sequence
ctcagcccctcctcgccccc

SEQ ID NO: 3881 - DNA, 20 bp, Artificial
  CRISPR gRNA sequence
cccccaggctcccactccat

SEQ ID NO: 3882 - DNA, 20 bp, Artificial
  CRISPR gRNA sequence
ccccaggctcccactccatg

SEQ ID NO: 3883 - DNA, 20 bp, Artificial
  CRISPR gRNA sequence
atttcgacaccgccgtgtcc

SEQ ID NO: 3884 - DNA, 20 bp, Artificial
  CRISPR gRNA sequence
gacaccgccgtgtcccggcc

SEQ ID NO: 3885 - DNA, 20 bp, Artificial
  CRISPR gRNA sequence
gccgtgtcccggcccggccg

SEQ ID NO: 3886 - DNA, 20 bp, Artificial
  CRISPR gRNA sequence
cgtgtcccggcccggccgcg

SEQ ID NO: 3887 - DNA, 20 bp, Artificial
  CRISPR gRNA sequence
tgtcccggcccggccgcgga

SEQ ID NO: 3888 - DNA, 20 bp, Artificial
  CRISPR gRNA sequence
cggagagccccgcttcatct

SEQ ID NO: 3889 - DNA, 20 bp, Artificial
  CRISPR gRNA sequence
agagccccgcttcatctcag

SEQ ID NO: 3890 - DNA, 20 bp, Artificial
  CRISPR gRNA sequence
gagccccgcttcatctcagt

SEQ ID NO: 3891 - DNA, 20 bp, Artificial
  CRISPR gRNA sequence
cttcatctcagtgggctacg

SEQ ID NO: 3892 - DNA, 20 bp, Artificial
  CRISPR gRNA sequence
tgggctacgtggacgacacg

SEQ ID NO: 3893 - DNA, 20 bp, Artificial
  CRISPR gRNA sequence
tggacgacacgcagttcgtg

SEQ ID NO: 3894 - DNA, 20 bp, Artificial
  CRISPR gRNA sequence
acgcagttcgtgcggttcga

SEQ ID NO: 3895 - DNA, 20 bp, Artificial
  CRISPR gRNA sequence
cggttcgacagcgacgccgc

SEQ ID NO: 3896 - DNA, 20 bp, Artificial
  CRISPR gRNA sequence
gacagcgacgccgcgagtcc

SEQ ID NO: 3897 - DNA, 20 bp, Artificial
  CRISPR gRNA sequence
cagcgacgccgcgagtccga

SEQ ID NO: 3898 - DNA, 20 bp, Artificial
  CRISPR gRNA sequence
agcgacgccgcgagtccgag

SEQ ID NO: 3899 - DNA, 20 bp, Artificial
  CRISPR gRNA sequence
gcgacgccgcgagtccgaga

SEQ ID NO: 3900 - DNA, 20 bp, Artificial
  CRISPR gRNA sequence
cgacgccgcgagtccgagag

SEQ ID NO: 3901 - DNA, 20 bp, Artificial
  CRISPR gRNA sequence
acgccgcgagtccgagaggg

SEQ ID NO: 3902 - DNA, 20 bp, Artificial
  CRISPR gRNA sequence
cgagtccgagaggggagccg

SEQ ID NO: 3903 - DNA, 20 bp, Artificial
  CRISPR gRNA sequence
gagtccgagaggggagccgc

SEQ ID NO: 3904 - DNA, 20 bp, Artificial
  CRISPR gRNA sequence
gaggggagccgcgggcgccg

SEQ ID NO: 3905 - DNA, 20 bp, Artificial
  CRISPR gRNA sequence
aggggagccgcgggcgccgt

SEQ ID NO: 3906 - DNA, 20 bp, Artificial
  CRISPR gRNA sequence
ggagccgcgggcgccgtggg

SEQ ID NO: 3907 - DNA, 20 bp, Artificial
  CRISPR gRNA sequence
agccgcgggcgccgtgggtg

SEQ ID NO: 3908 - DNA, 20 bp, Artificial
  CRISPR gRNA sequence
cgcgggcgccgtgggtggag

SEQ ID NO: 3909 - DNA, 20 bp, Artificial
  CRISPR gRNA sequence
gcgggcgccgtgggtggagc

SEQ ID NO: 3910 - DNA, 20 bp, Artificial
  CRISPR gRNA sequence
gggcgccgtgggtggagcag

SEQ ID NO: 3911 - DNA, 20 bp, Artificial
  CRISPR gRNA sequence
ggcgccgtgggtggagcagg

SEQ ID NO: 3912 - DNA, 20 bp, Artificial
  CRISPR gRNA sequence
gcgccgtgggtggagcagga

SEQ ID NO: 3913 - DNA, 20 bp, Artificial
  CRISPR gRNA sequence
cgccgtgggtggagcaggag

SEQ ID NO: 3914 - DNA, 20 bp, Artificial
  CRISPR gRNA sequence
gtgggtggagcaggaggggc

SEQ ID NO: 3915 - DNA, 20 bp, Artificial
  CRISPR gRNA sequence
gggtggagcaggaggggccg

SEQ ID NO: 3916 - DNA, 20 bp, Artificial
  CRISPR gRNA sequence
agcaggaggggccggagtat

SEQ ID NO: 3917 - DNA, 20 bp, Artificial
  CRISPR gRNA sequence
gcaggaggggccggagtatt

SEQ ID NO: 3918 - DNA, 20 bp, Artificial
  CRISPR gRNA sequence
aggggccggagtattgggac

SEQ ID NO: 3919 - DNA, 20 bp, Artificial
  CRISPR gRNA sequence
ggggccggagtattgggacc

SEQ ID NO: 3920 - DNA, 20 bp, Artificial
  CRISPR gRNA sequence
ggccggagtattgggaccgg

SEQ ID NO: 3921 - DNA, 20 bp, Artificial
  CRISPR gRNA sequence
agtattgggaccgggagaca

SEQ ID NO: 3922 - DNA, 20 bp, Artificial
  CRISPR gRNA sequence
accgggagacacagaactac

SEQ ID NO: 3923 - DNA, 20 bp, Artificial
  CRISPR gRNA sequence
agacacagaactacaagcgc

SEQ ID NO: 3924 - DNA, 20 bp, Artificial
  CRISPR gRNA sequence
gacacagaactacaagcgcc

SEQ ID NO: 3925 - DNA, 20 bp, Artificial
  CRISPR gRNA sequence
agaactacaagcgccaggca

SEQ ID NO: 3926 - DNA, 20 bp, Artificial
  CRISPR gRNA sequence
gaactacaagcgccaggcac

SEQ ID NO: 3927 - DNA, 20 bp, Artificial
  CRISPR gRNA sequence
gcgccaggcacaggctgacc

SEQ ID NO: 3928 - DNA, 20 bp, Artificial
  CRISPR gRNA sequence
caggcacaggctgaccgagt

SEQ ID NO: 3929 - DNA, 20 bp, Artificial
  CRISPR gRNA sequence
aggctgaccgagtgagcctg

SEQ ID NO: 3930 - DNA, 20 bp, Artificial
  CRISPR gRNA sequence
gtgagcctgcggaacctgcg

SEQ ID NO: 3931 - DNA, 20 bp, Artificial
  CRISPR gRNA sequence
acctgcgcggctactacaac

SEQ ID NO: 3932 - DNA, 20 bp, Artificial
  CRISPR gRNA sequence
ctgcgcggctactacaacca

SEQ ID NO: 3933 - DNA, 20 bp, Artificial
  CRISPR gRNA sequence
gcggctactacaaccagagc

SEQ ID NO: 3934 - DNA, 20 bp, Artificial
  CRISPR gRNA sequence
cggctactacaaccagagcg

SEQ ID NO: 3935 - DNA, 20 bp, Artificial
  CRISPR gRNA sequence
tactacaaccagagcgagga

SEQ ID NO: 3936 - DNA, 20 bp, Artificial
  CRISPR gRNA sequence
acaaccagagcgaggacggt

SEQ ID NO: 3937 - DNA, 20 bp, Artificial
  CRISPR gRNA sequence
gcgaggacggtgagtgaccc

SEQ ID NO: 3938 - DNA, 20 bp, Artificial
  CRISPR gRNA sequence
gacggtgagtgaccccggcc

SEQ ID NO: 3939 - DNA, 20 bp, Artificial
  CRISPR gRNA sequence
acggtgagtgaccccggccc

SEQ ID NO: 3940 - DNA, 20 bp, Artificial
  CRISPR gRNA sequence
cggtgagtgaccccggcccg

SEQ ID NO: 3941 - DNA, 20 bp, Artificial
  CRISPR gRNA sequence
agtgaccccggcccggggcg

SEQ ID NO: 3942 - DNA, 20 bp, Artificial
  CRISPR gRNA sequence
gtgaccccggcccggggcgc

SEQ ID NO: 3943 - DNA, 20 bp, Artificial
  CRISPR gRNA sequence
cgacccctccccatccccca

SEQ ID NO: 3944 - DNA, 20 bp, Artificial
  CRISPR gRNA sequence
ccctccccatcccccacgga

SEQ ID NO: 3945 - DNA, 20 bp, Artificial
  CRISPR gRNA sequence
cccatcccccacggacggcc

SEQ ID NO: 3946 - DNA, 20 bp, Artificial
  CRISPR gRNA sequence
ccatcccccacggacggccc

SEQ ID NO: 3947 - DNA, 20 bp, Artificial
  CRISPR gRNA sequence
cggacggcccgggtcgcccc

SEQ ID NO: 3948 - DNA, 20 bp, Artificial
  CRISPR gRNA sequence
cgccccgagtctccccgtct

SEQ ID NO: 3949 - DNA, 20 bp, Artificial
  CRISPR gRNA sequence
ccccgtctgagatccacccc

SEQ ID NO: 3950 - DNA, 20 bp, Artificial
  CRISPR gRNA sequence
cccgtctgagatccacccca

SEQ ID NO: 3951 - DNA, 20 bp, Artificial
  CRISPR gRNA sequence
gtctgagatccaccccaagg

SEQ ID NO: 3952 - DNA, 20 bp, Artificial
  CRISPR gRNA sequence
tccaccccaaggtggatctg

SEQ ID NO: 3953 - DNA, 20 bp, Artificial
  CRISPR gRNA sequence
gtggatctgcggaacccgcc

SEQ ID NO: 3954 - DNA, 20 bp, Artificial
  CRISPR gRNA sequence
aacccgcccagaccctcgac

SEQ ID NO: 3955 - DNA, 20 bp, Artificial
  CRISPR gRNA sequence
cccgcccagaccctcgaccg

SEQ ID NO: 3956 - DNA, 20 bp, Artificial
  CRISPR gRNA sequence
cgcccagaccctcgaccgga

SEQ ID NO: 3957 - DNA, 20 bp, Artificial
  CRISPR gRNA sequence
cccagaccctcgaccggaga

SEQ ID NO: 3958 - DNA, 20 bp, Artificial
  CRISPR gRNA sequence
ccctcgaccggagagagccc

SEQ ID NO: 3959 - DNA, 20 bp, Artificial
  CRISPR gRNA sequence
gagccccagtcgcctttacc

SEQ ID NO: 3960 - DNA, 20 bp, Artificial
  CRISPR gRNA sequence
cctttacccggtttcatttt

SEQ ID NO: 3961 - DNA, 20 bp, Artificial
  CRISPR gRNA sequence
acccggtttcattttcggtt

SEQ ID NO: 3962 - DNA, 20 bp, Artificial
  CRISPR gRNA sequence
cccggtttcattttcggttt

SEQ ID NO: 3963 - DNA, 20 bp, Artificial
  CRISPR gRNA sequence
ggtttaggccaaaatccccg

SEQ ID NO: 3964 - DNA, 20 bp, Artificial
  CRISPR gRNA sequence
gtttaggccaaaatccccgc

SEQ ID NO: 3965 - DNA, 20 bp, Artificial
  CRISPR gRNA sequence
aggccaaaatccccgcgggt

SEQ ID NO: 3966 - DNA, 20 bp, Artificial
  CRISPR gRNA sequence
caaaatccccgcgggttggt

SEQ ID NO: 3967 - DNA, 20 bp, Artificial
  CRISPR gRNA sequence
aaaatccccgcgggttggtc

SEQ ID NO: 3968 - DNA, 20 bp, Artificial
  CRISPR gRNA sequence
aaatccccgcgggttggtcg

SEQ ID NO: 3969 - DNA, 20 bp, Artificial
  CRISPR gRNA sequence
tccccgcgggttggtcgggg

SEQ ID NO: 3970 - DNA, 20 bp, Artificial
  CRISPR gRNA sequence
ccccgcgggttggtcggggc

SEQ ID NO: 3971 - DNA, 20 bp, Artificial
  CRISPR gRNA sequence
cccgcgggttggtcggggcg

SEQ ID NO: 3972 - DNA, 20 bp, Artificial
  CRISPR gRNA sequence
gcgggttggtcggggcgggg

SEQ ID NO: 3973 - DNA, 20 bp, Artificial
  CRISPR gRNA sequence
cgggttggtcggggcggggc

SEQ ID NO: 3974 - DNA, 20 bp, Artificial
  CRISPR gRNA sequence
gggttggtcggggcggggcg

SEQ ID NO: 3975 - DNA, 20 bp, Artificial
  CRISPR gRNA sequence
ggtcggggcggggcggggct

SEQ ID NO: 3976 - DNA, 20 bp, Artificial
  CRISPR gRNA sequence
gtcggggcggggcggggctc

SEQ ID NO: 3977 - DNA, 20 bp, Artificial
  CRISPR gRNA sequence
tcggggcggggcggggctcg

SEQ ID NO: 3978 - DNA, 20 bp, Artificial
  CRISPR gRNA sequence
cggggcggggcggggctcgg

SEQ ID NO: 3979 - DNA, 20 bp, Artificial
  CRISPR gRNA sequence
cggggcggggctcgggggac

SEQ ID NO: 3980 - DNA, 20 bp, Artificial
  CRISPR gRNA sequence
ggggcggggctcgggggact

SEQ ID NO: 3981 - DNA, 20 bp, Artificial
  CRISPR gRNA sequence
tcgggggactgggctgaccg

SEQ ID NO: 3982 - DNA, 20 bp, Artificial
  CRISPR gRNA sequence
cgggggactgggctgaccgc

SEQ ID NO: 3983 - DNA, 20 bp, Artificial
  CRISPR gRNA sequence
gggggactgggctgaccgcg

SEQ ID NO: 3984 - DNA, 20 bp, Artificial
  CRISPR gRNA sequence
ggggactgggctgaccgcgg

SEQ ID NO: 3985 - DNA, 20 bp, Artificial
  CRISPR gRNA sequence
gactgggctgaccgcggggg

SEQ ID NO: 3986 - DNA, 20 bp, Artificial
  CRISPR gRNA sequence
actgggctgaccgcgggggc

SEQ ID NO: 3987 - DNA, 20 bp, Artificial
  CRISPR gRNA sequence
ctgggctgaccgcgggggcg

SEQ ID NO: 3988 - DNA, 20 bp, Artificial
  CRISPR gRNA sequence
gctgaccgcgggggcggggc

SEQ ID NO: 3989 - DNA, 20 bp, Artificial
  CRISPR gRNA sequence
ctgaccgcgggggcggggcc

SEQ ID NO: 3990 - DNA, 20 bp, Artificial
  CRISPR gRNA sequence
tgaccgcgggggcggggcca

SEQ ID NO: 3991 - DNA, 20 bp, Artificial
  CRISPR gRNA sequence
ggccagggtctcacaccctc

SEQ ID NO: 3992 - DNA, 20 bp, Artificial
  CRISPR gRNA sequence
ccagggtctcacaccctcca

SEQ ID NO: 3993 - DNA, 20 bp, Artificial
  CRISPR gRNA sequence
cagggtctcacaccctccag

SEQ ID NO: 3994 - DNA, 20 bp, Artificial
  CRISPR gRNA sequence
cacaccctccagaggatgta

SEQ ID NO: 3995 - DNA, 20 bp, Artificial
  CRISPR gRNA sequence
gaggatgtatggctgcgacc

SEQ ID NO: 3996 - DNA, 20 bp, Artificial
  CRISPR gRNA sequence
aggatgtatggctgcgacct

SEQ ID NO: 3997 - DNA, 20 bp, Artificial
  CRISPR gRNA sequence
ggatgtatggctgcgacctg

SEQ ID NO: 3998 - DNA, 20 bp, Artificial
  CRISPR gRNA sequence
ggctgcgacctggggcccga

SEQ ID NO: 3999 - DNA, 20 bp, Artificial
  CRISPR gRNA sequence
gctgcgacctggggcccgac

SEQ ID NO: 4000 - DNA, 20 bp, Artificial
  CRISPR gRNA sequence
cccgacgggcgcctcctccg

SEQ ID NO: 4001 - DNA, 20 bp, Artificial
  CRISPR gRNA sequence
ccgacgggcgcctcctccgc

SEQ ID NO: 4002 - DNA, 20 bp, Artificial
  CRISPR gRNA sequence
gcctcctccgcgggtatgac

SEQ ID NO: 4003 - DNA, 20 bp, Artificial
  CRISPR gRNA sequence
tatgaccagtccgcctacga

SEQ ID NO: 4004 - DNA, 20 bp, Artificial
  CRISPR gRNA sequence
accagtccgcctacgacggc

SEQ ID NO: 4005 - DNA, 20 bp, Artificial
  CRISPR gRNA sequence
ccagtccgcctacgacggca

SEQ ID NO: 4006 - DNA, 20 bp, Artificial
  CRISPR gRNA sequence
aggattacatcgccctgaac

SEQ ID NO: 4007 - DNA, 20 bp, Artificial
  CRISPR gRNA sequence
ggattacatcgccctgaacg

SEQ ID NO: 4008 - DNA, 20 bp, Artificial
  CRISPR gRNA sequence
tgaacgaggacctgcgctcc

SEQ ID NO: 4009 - DNA, 20 bp, Artificial
  CRISPR gRNA sequence
cctgcgctcctggaccgccg

SEQ ID NO: 4010 - DNA, 20 bp, Artificial
  CRISPR gRNA sequence
ctggaccgccgcggacaccg

SEQ ID NO: 4011 - DNA, 20 bp, Artificial
  CRISPR gRNA sequence
ccgccgcggacaccgcggct

SEQ ID NO: 4012 - DNA, 20 bp, Artificial
  CRISPR gRNA sequence
acaccgcggctcagatcacc

SEQ ID NO: 4013 - DNA, 20 bp, Artificial
  CRISPR gRNA sequence
cggctcagatcacccagcgc

SEQ ID NO: 4014 - DNA, 20 bp, Artificial
  CRISPR gRNA sequence
tcagatcacccagcgcaagt

SEQ ID NO: 4015 - DNA, 20 bp, Artificial
  CRISPR gRNA sequence
agatcacccagcgcaagttg

SEQ ID NO: 4016 - DNA, 20 bp, Artificial
  CRISPR gRNA sequence
gatcacccagcgcaagttgg

SEQ ID NO: 4017 - DNA, 20 bp, Artificial
  CRISPR gRNA sequence
cacccagcgcaagttggagg

SEQ ID NO: 4018 - DNA, 20 bp, Artificial
  CRISPR gRNA sequence
caagttggaggcggcccgtg

SEQ ID NO: 4019 - DNA, 20 bp, Artificial
  CRISPR gRNA sequence
gttggaggcggcccgtgcgg

SEQ ID NO: 4020 - DNA, 20 bp, Artificial
  CRISPR gRNA sequence
tggaggcggcccgtgcggcg

SEQ ID NO: 4021 - DNA, 20 bp, Artificial
  CRISPR gRNA sequence
aggcggcccgtgcggcggag

SEQ ID NO: 4022 - DNA, 20 bp, Artificial
  CRISPR gRNA sequence
gcccgtgcggcggagcagct

SEQ ID NO: 4023 - DNA, 20 bp, Artificial
  CRISPR gRNA sequence
ccgtgcggcggagcagctga

SEQ ID NO: 4024 - DNA, 20 bp, Artificial
  CRISPR gRNA sequence
ggagcagctgagagcctacc

SEQ ID NO: 4025 - DNA, 20 bp, Artificial
  CRISPR gRNA sequence
agcagctgagagcctacctg

SEQ ID NO: 4026 - DNA, 20 bp, Artificial
  CRISPR gRNA sequence
gcagctgagagcctacctgg

SEQ ID NO: 4027 - DNA, 20 bp, Artificial
  CRISPR gRNA sequence
cagctgagagcctacctgga

SEQ ID NO: 4028 - DNA, 20 bp, Artificial
  CRISPR gRNA sequence
ctacctggagggcacgtgcg

SEQ ID NO: 4029 - DNA, 20 bp, Artificial
  CRISPR gRNA sequence
acctggagggcacgtgcgtg

SEQ ID NO: 4030 - DNA, 20 bp, Artificial
  CRISPR gRNA sequence
tggagggcacgtgcgtggag

SEQ ID NO: 4031 - DNA, 20 bp, Artificial
  CRISPR gRNA sequence
acgtgcgtggagtggctccg

SEQ ID NO: 4032 - DNA, 20 bp, Artificial
  CRISPR gRNA sequence
ggagtggctccgcagatacc

SEQ ID NO: 4033 - DNA, 20 bp, Artificial
  CRISPR gRNA sequence
agtggctccgcagatacctg

SEQ ID NO: 4034 - DNA, 20 bp, Artificial
  CRISPR gRNA sequence
ctccgcagatacctggagaa

SEQ ID NO: 4035 - DNA, 20 bp, Artificial
  CRISPR gRNA sequence
tccgcagatacctggagaac

SEQ ID NO: 4036 - DNA, 20 bp, Artificial
  CRISPR gRNA sequence
gcagatacctggagaacggg

SEQ ID NO: 4037 - DNA, 20 bp, Artificial
  CRISPR gRNA sequence
cagatacctggagaacggga

SEQ ID NO: 4038 - DNA, 20 bp, Artificial
  CRISPR gRNA sequence
gatacctggagaacgggaag

SEQ ID NO: 4039 - DNA, 20 bp, Artificial
  CRISPR gRNA sequence
agaacgggaaggagacgctg

SEQ ID NO: 4040 - DNA, 20 bp, Artificial
  CRISPR gRNA sequence
gaaggagacgctgcagcgcg

SEQ ID NO: 4041 - DNA, 20 bp, Artificial
  CRISPR gRNA sequence
aaggagacgctgcagcgcgc

SEQ ID NO: 4042 - DNA, 20 bp, Artificial
  CRISPR gRNA sequence
acgctgcagcgcgcaggtac

SEQ ID NO: 4043 - DNA, 20 bp, Artificial
  CRISPR gRNA sequence
cgctgcagcgcgcaggtacc

SEQ ID NO: 4044 - DNA, 20 bp, Artificial
  CRISPR gRNA sequence
gctgcagcgcgcaggtacca

SEQ ID NO: 4045 - DNA, 20 bp, Artificial
  CRISPR gRNA sequence
ctgcagcgcgcaggtaccag

SEQ ID NO: 4046 - DNA, 20 bp, Artificial
  CRISPR gRNA sequence
cagcgcgcaggtaccagggg

SEQ ID NO: 4047 - DNA, 20 bp, Artificial
  CRISPR gRNA sequence
cgcgcaggtaccaggggcag

SEQ ID NO: 4048 - DNA, 20 bp, Artificial
  CRISPR gRNA sequence
gcgcaggtaccaggggcagt

SEQ ID NO: 4049 - DNA, 20 bp, Artificial
  CRISPR gRNA sequence
cgcaggtaccaggggcagtg

SEQ ID NO: 4050 - DNA, 20 bp, Artificial
  CRISPR gRNA sequence
caggtaccaggggcagtggg

SEQ ID NO: 4051 - DNA, 20 bp, Artificial
  CRISPR gRNA sequence
ggagccttccccatctccta

SEQ ID NO: 4052 - DNA, 20 bp, Artificial
  CRISPR gRNA sequence
cccatctcctatagatctcc

SEQ ID NO: 4053 - DNA, 20 bp, Artificial
  CRISPR gRNA sequence
ccatctcctatagatctccc

SEQ ID NO: 4054 - DNA, 20 bp, Artificial
  CRISPR gRNA sequence
ctcctatagatctcccggga

SEQ ID NO: 4055 - DNA, 20 bp, Artificial
  CRISPR gRNA sequence
ctcccgggatggcctcccac

SEQ ID NO: 4056 - DNA, 20 bp, Artificial
  CRISPR gRNA sequence
tcccgggatggcctcccacg

SEQ ID NO: 4057 - DNA, 20 bp, Artificial
  CRISPR gRNA sequence
ccgggatggcctcccacgag

SEQ ID NO: 4058 - DNA, 20 bp, Artificial
  CRISPR gRNA sequence
cgggatggcctcccacgagg

SEQ ID NO: 4059 - DNA, 20 bp, Artificial
  CRISPR gRNA sequence
gggatggcctcccacgagga

SEQ ID NO: 4060 - DNA, 20 bp, Artificial
  CRISPR gRNA sequence
ggatggcctcccacgaggag

SEQ ID NO: 4061 - DNA, 20 bp, Artificial
  CRISPR gRNA sequence
atggcctcccacgaggaggg

SEQ ID NO: 4062 - DNA, 20 bp, Artificial
  CRISPR gRNA sequence
tggcctcccacgaggagggg

SEQ ID NO: 4063 - DNA, 20 bp, Artificial
  CRISPR gRNA sequence
ccacgaggaggggaggaaaa

SEQ ID NO: 4064 - DNA, 20 bp, Artificial
  CRISPR gRNA sequence
cacgaggaggggaggaaaat

SEQ ID NO: 4065 - DNA, 20 bp, Artificial
  CRISPR gRNA sequence
ggaggggaggaaaatgggat

SEQ ID NO: 4066 - DNA, 20 bp, Artificial
  CRISPR gRNA sequence
gaggaaaatgggatcagcac

SEQ ID NO: 4067 - DNA, 20 bp, Artificial
  CRISPR gRNA sequence
gaatatcgccctcccttgaa

SEQ ID NO: 4068 - DNA, 20 bp, Artificial
  CRISPR gRNA sequence
atatcgccctcccttgaatg

SEQ ID NO: 4069 - DNA, 20 bp, Artificial
  CRISPR gRNA sequence
gccctcccttgaatggagaa

SEQ ID NO: 4070 - DNA, 20 bp, Artificial
  CRISPR gRNA sequence
ccttgaatggagaatggcat

SEQ ID NO: 4071 - DNA, 20 bp, Artificial
  CRISPR gRNA sequence
agaatggcatgagttttcct

SEQ ID NO: 4072 - DNA, 20 bp, Artificial
  CRISPR gRNA sequence
agttttcctgagtttcctct

SEQ ID NO: 4073 - DNA, 20 bp, Artificial
  CRISPR gRNA sequence
gttttcctgagtttcctctg

SEQ ID NO: 4074 - DNA, 20 bp, Artificial
  CRISPR gRNA sequence
ttttcctgagtttcctctga

SEQ ID NO: 4075 - DNA, 20 bp, Artificial
  CRISPR gRNA sequence
tgagggccccctctgctctc

SEQ ID NO: 4076 - DNA, 20 bp, Artificial
  CRISPR gRNA sequence
gagggccccctctgctctct

SEQ ID NO: 4077 - DNA, 20 bp, Artificial
  CRISPR gRNA sequence
ctctgctctctaggacaatt

SEQ ID NO: 4078 - DNA, 20 bp, Artificial
  CRISPR gRNA sequence
tctgctctctaggacaatta

SEQ ID NO: 4079 - DNA, 20 bp, Artificial
  CRISPR gRNA sequence
ctgctctctaggacaattaa

SEQ ID NO: 4080 - DNA, 20 bp, Artificial
  CRISPR gRNA sequence
tctaggacaattaagggatg

SEQ ID NO: 4081 - DNA, 20 bp, Artificial
  CRISPR gRNA sequence
aattaagggatgaagtctct

SEQ ID NO: 4082 - DNA, 20 bp, Artificial
  CRISPR gRNA sequence
attaagggatgaagtctctg

SEQ ID NO: 4083 - DNA, 20 bp, Artificial
  CRISPR gRNA sequence
ggatgaagtctctgaggaaa

SEQ ID NO: 4084 - DNA, 20 bp, Artificial
  CRISPR gRNA sequence
atgaagtctctgaggaaatg

SEQ ID NO: 4085 - DNA, 20 bp, Artificial
  CRISPR gRNA sequence
tgaagtctctgaggaaatgg

SEQ ID NO: 4086 - DNA, 20 bp, Artificial
  CRISPR gRNA sequence
gaagtctctgaggaaatgga

SEQ ID NO: 4087 - DNA, 20 bp, Artificial
  CRISPR gRNA sequence
aagtctctgaggaaatggag

SEQ ID NO: 4088 - DNA, 20 bp, Artificial
  CRISPR gRNA sequence
tctctgaggaaatggagggg

SEQ ID NO: 4089 - DNA, 20 bp, Artificial
  CRISPR gRNA sequence
tgaggaaatggaggggaaga

SEQ ID NO: 4090 - DNA, 20 bp, Artificial
  CRISPR gRNA sequence
atggaggggaagacagtccc

SEQ ID NO: 4091 - DNA, 20 bp, Artificial
  CRISPR gRNA sequence
acagtccctggaatactgat

SEQ ID NO: 4092 - DNA, 20 bp, Artificial
  CRISPR gRNA sequence
cagtccctggaatactgatc

SEQ ID NO: 4093 - DNA, 20 bp, Artificial
  CRISPR gRNA sequence
agtccctggaatactgatca

SEQ ID NO: 4094 - DNA, 20 bp, Artificial
  CRISPR gRNA sequence
gtccctggaatactgatcag

SEQ ID NO: 4095 - DNA, 20 bp, Artificial
  CRISPR gRNA sequence
tttgaccactttgaccactg

SEQ ID NO: 4096 - DNA, 20 bp, Artificial
  CRISPR gRNA sequence
gaccactttgaccactgcag

SEQ ID NO: 4097 - DNA, 20 bp, Artificial
  CRISPR gRNA sequence
tttgaccactgcagcagctg

SEQ ID NO: 4098 - DNA, 20 bp, Artificial
  CRISPR gRNA sequence
accactgcagcagctgtggt

SEQ ID NO: 4099 - DNA, 20 bp, Artificial
  CRISPR gRNA sequence
ccactgcagcagctgtggtc

SEQ ID NO: 4100 - DNA, 20 bp, Artificial
  CRISPR gRNA sequence
caggctgctgacctttctct

SEQ ID NO: 4101 - DNA, 20 bp, Artificial
  CRISPR gRNA sequence
aggctgctgacctttctctc

SEQ ID NO: 4102 - DNA, 20 bp, Artificial
  CRISPR gRNA sequence
cctcacactcaatgtgtctg

SEQ ID NO: 4103 - DNA, 20 bp, Artificial
  CRISPR gRNA sequence
ctcacactcaatgtgtctga

SEQ ID NO: 4104 - DNA, 20 bp, Artificial
  CRISPR gRNA sequence
tgtgtctgaaggtttgattc

SEQ ID NO: 4105 - DNA, 20 bp, Artificial
  CRISPR gRNA sequence
ggtttgattccagcttttct

SEQ ID NO: 4106 - DNA, 20 bp, Artificial
  CRISPR gRNA sequence
tccagcttttctgagtcctg

SEQ ID NO: 4107 - DNA, 20 bp, Artificial
  CRISPR gRNA sequence
tgagtcctgcagcctccact

SEQ ID NO: 4108 - DNA, 20 bp, Artificial
  CRISPR gRNA sequence
gagtcctgcagcctccactc

SEQ ID NO: 4109 - DNA, 20 bp, Artificial
  CRISPR gRNA sequence
cctgcagcctccactcaggt

SEQ ID NO: 4110 - DNA, 20 bp, Artificial
  CRISPR gRNA sequence
ctgcagcctccactcaggtc

SEQ ID NO: 4111 - DNA, 20 bp, Artificial
  CRISPR gRNA sequence
gcctccactcaggtcaggac

SEQ ID NO: 4112 - DNA, 20 bp, Artificial
  CRISPR gRNA sequence
tccactcaggtcaggaccag

SEQ ID NO: 4113 - DNA, 20 bp, Artificial
  CRISPR gRNA sequence
agaagtcgctgttcctccct

SEQ ID NO: 4114 - DNA, 20 bp, Artificial
  CRISPR gRNA sequence
aagtcgctgttcctccctca

SEQ ID NO: 4115 - DNA, 20 bp, Artificial
  CRISPR gRNA sequence
gctgttcctccctcagagac

SEQ ID NO: 4116 - DNA, 20 bp, Artificial
  CRISPR gRNA sequence
gactagaactttccaatgaa

SEQ ID NO: 4117 - DNA, 20 bp, Artificial
  CRISPR gRNA sequence
actagaactttccaatgaat

SEQ ID NO: 4118 - DNA, 20 bp, Artificial
  CRISPR gRNA sequence
tagaactttccaatgaatag

SEQ ID NO: 4119 - DNA, 20 bp, Artificial
  CRISPR gRNA sequence
caatgaataggagattatcc

SEQ ID NO: 4120 - DNA, 20 bp, Artificial
  CRISPR gRNA sequence
aatgaataggagattatccc

SEQ ID NO: 4121 - DNA, 20 bp, Artificial
  CRISPR gRNA sequence
ttatcccaggtgcctgtgtc

SEQ ID NO: 4122 - DNA, 20 bp, Artificial
  CRISPR gRNA sequence
tatcccaggtgcctgtgtcc

SEQ ID NO: 4123 - DNA, 20 bp, Artificial
  CRISPR gRNA sequence
ccaggtgcctgtgtccaggc

SEQ ID NO: 4124 - DNA, 20 bp, Artificial
  CRISPR gRNA sequence
cctgtgtccaggctggcgtc

SEQ ID NO: 4125 - DNA, 20 bp, Artificial
  CRISPR gRNA sequence
ctgtgtccaggctggcgtct

SEQ ID NO: 4126 - DNA, 20 bp, Artificial
  CRISPR gRNA sequence
ctgtgccgccttccccaccc

SEQ ID NO: 4127 - DNA, 20 bp, Artificial
  CRISPR gRNA sequence
tgtgccgccttccccacccc

SEQ ID NO: 4128 - DNA, 20 bp, Artificial
  CRISPR gRNA sequence
ccaggtgtcctgtccattct

SEQ ID NO: 4129 - DNA, 20 bp, Artificial
  CRISPR gRNA sequence
caggtgtcctgtccattctc

SEQ ID NO: 4130 - DNA, 20 bp, Artificial
  CRISPR gRNA sequence
tgtcctgtccattctcagga

SEQ ID NO: 4131 - DNA, 20 bp, Artificial
  CRISPR gRNA sequence
ccattctcaggatggtcaca

SEQ ID NO: 4132 - DNA, 20 bp, Artificial
  CRISPR gRNA sequence
cattctcaggatggtcacat

SEQ ID NO: 4133 - DNA, 20 bp, Artificial
  CRISPR gRNA sequence
gatggtcacatgggcgctgc

SEQ ID NO: 4134 - DNA, 20 bp, Artificial
  CRISPR gRNA sequence
tggtcacatgggcgctgctg

SEQ ID NO: 4135 - DNA, 20 bp, Artificial
  CRISPR gRNA sequence
gggcgctgctggagtgtccc

SEQ ID NO: 4136 - DNA, 20 bp, Artificial
  CRISPR gRNA sequence
gcgctgctggagtgtcccaa

SEQ ID NO: 4137 - DNA, 20 bp, Artificial
  CRISPR gRNA sequence
gctgctggagtgtcccaaga

SEQ ID NO: 4138 - DNA, 20 bp, Artificial
  CRISPR gRNA sequence
agtgtcccaagagagatgca

SEQ ID NO: 4139 - DNA, 20 bp, Artificial
  CRISPR gRNA sequence
aattttctgactcttcccgt

SEQ ID NO: 4140 - DNA, 20 bp, Artificial
  CRISPR gRNA sequence
tcttcccgtcagaaccccca

SEQ ID NO: 4141 - DNA, 20 bp, Artificial
  CRISPR gRNA sequence
accaccccctctctgaccat

SEQ ID NO: 4142 - DNA, 20 bp, Artificial
  CRISPR gRNA sequence
ccaccccctctctgaccatg

SEQ ID NO: 4143 - DNA, 20 bp, Artificial
  CRISPR gRNA sequence
tctgaccatgaggccaccct

SEQ ID NO: 4144 - DNA, 20 bp, Artificial
  CRISPR gRNA sequence
ctgaccatgaggccaccctg

SEQ ID NO: 4145 - DNA, 20 bp, Artificial
  CRISPR gRNA sequence
atgaggccaccctgaggtgc

SEQ ID NO: 4146 - DNA, 20 bp, Artificial
  CRISPR gRNA sequence
tgaggccaccctgaggtgct

SEQ ID NO: 4147 - DNA, 20 bp, Artificial
  CRISPR gRNA sequence
caccctgaggtgctgggccc

SEQ ID NO: 4148 - DNA, 20 bp, Artificial
  CRISPR gRNA sequence
accctgaggtgctgggccct

SEQ ID NO: 4149 - DNA, 20 bp, Artificial
  CRISPR gRNA sequence
ggccctgggcttctaccctg

SEQ ID NO: 4150 - DNA, 20 bp, Artificial
  CRISPR gRNA sequence
ccctgggcttctaccctgcg

SEQ ID NO: 4151 - DNA, 20 bp, Artificial
  CRISPR gRNA sequence
ctgcggagatcacactgacc

SEQ ID NO: 4152 - DNA, 20 bp, Artificial
  CRISPR gRNA sequence
cggagatcacactgacctgg

SEQ ID NO: 4153 - DNA, 20 bp, Artificial
  CRISPR gRNA sequence
agatcacactgacctggcag

SEQ ID NO: 4154 - DNA, 20 bp, Artificial
  CRISPR gRNA sequence
gatcacactgacctggcagc

SEQ ID NO: 4155 - DNA, 20 bp, Artificial
  CRISPR gRNA sequence
acactgacctggcagcggga

SEQ ID NO: 4156 - DNA, 20 bp, Artificial
  CRISPR gRNA sequence
cactgacctggcagcgggat

SEQ ID NO: 4157 - DNA, 20 bp, Artificial
  CRISPR gRNA sequence
actgacctggcagcgggatg

SEQ ID NO: 4158 - DNA, 20 bp, Artificial
  CRISPR gRNA sequence
tgacctggcagcgggatggg

SEQ ID NO: 4159 - DNA, 20 bp, Artificial
  CRISPR gRNA sequence
gacctggcagcgggatgggg

SEQ ID NO: 4160 - DNA, 20 bp, Artificial
  CRISPR gRNA sequence
ggcagcgggatggggaggac

SEQ ID NO: 4161 - DNA, 20 bp, Artificial
  CRISPR gRNA sequence
gggatggggaggaccagacc

SEQ ID NO: 4162 - DNA, 20 bp, Artificial
  CRISPR gRNA sequence
ggatggggaggaccagaccc

SEQ ID NO: 4163 - DNA, 20 bp, Artificial
  CRISPR gRNA sequence
aggaccagacccaggacacc

SEQ ID NO: 4164 - DNA, 20 bp, Artificial
  CRISPR gRNA sequence
gacccaggacaccgagcttg

SEQ ID NO: 4165 - DNA, 20 bp, Artificial
  CRISPR gRNA sequence
cccaggacaccgagcttgtg

SEQ ID NO: 4166 - DNA, 20 bp, Artificial
  CRISPR gRNA sequence
gacaccgagcttgtggagac

SEQ ID NO: 4167 - DNA, 20 bp, Artificial
  CRISPR gRNA sequence
acaccgagcttgtggagacc

SEQ ID NO: 4168 - DNA, 20 bp, Artificial
  CRISPR gRNA sequence
cgagcttgtggagaccaggc

SEQ ID NO: 4169 - DNA, 20 bp, Artificial
  CRISPR gRNA sequence
gcttgtggagaccaggccag

SEQ ID NO: 4170 - DNA, 20 bp, Artificial
  CRISPR gRNA sequence
cttgtggagaccaggccagc

SEQ ID NO: 4171 - DNA, 20 bp, Artificial
  CRISPR gRNA sequence
tgtggagaccaggccagcag

SEQ ID NO: 4172 - DNA, 20 bp, Artificial
  CRISPR gRNA sequence
gagaccaggccagcaggaga

SEQ ID NO: 4173 - DNA, 20 bp, Artificial
  CRISPR gRNA sequence
cagcaggagatggaaccttc

SEQ ID NO: 4174 - DNA, 20 bp, Artificial
  CRISPR gRNA sequence
caggagatggaaccttccag

SEQ ID NO: 4175 - DNA, 20 bp, Artificial
  CRISPR gRNA sequence
gagatggaaccttccagaag

SEQ ID NO: 4176 - DNA, 20 bp, Artificial
  CRISPR gRNA sequence
agatggaaccttccagaagt

SEQ ID NO: 4177 - DNA, 20 bp, Artificial
  CRISPR gRNA sequence
tggaaccttccagaagtggg

SEQ ID NO: 4178 - DNA, 20 bp, Artificial
  CRISPR gRNA sequence
cttccagaagtgggcagctg

SEQ ID NO: 4179 - DNA, 20 bp, Artificial
  CRISPR gRNA sequence
ccagaagtgggcagctgtgg

SEQ ID NO: 4180 - DNA, 20 bp, Artificial
  CRISPR gRNA sequence
gcagctgtggtggtgccttc

SEQ ID NO: 4181 - DNA, 20 bp, Artificial
  CRISPR gRNA sequence
tgtggtggtgccttctggac

SEQ ID NO: 4182 - DNA, 20 bp, Artificial
  CRISPR gRNA sequence
tggtggtgccttctggacaa

SEQ ID NO: 4183 - DNA, 20 bp, Artificial
  CRISPR gRNA sequence
tggtgccttctggacaagag

SEQ ID NO: 4184 - DNA, 20 bp, Artificial
  CRISPR gRNA sequence
gtgccttctggacaagagca

SEQ ID NO: 4185 - DNA, 20 bp, Artificial
  CRISPR gRNA sequence
agagatacacgtgccatatg

SEQ ID NO: 4186 - DNA, 20 bp, Artificial
  CRISPR gRNA sequence
acacgtgccatatgcagcac

SEQ ID NO: 4187 - DNA, 20 bp, Artificial
  CRISPR gRNA sequence
cacgtgccatatgcagcacg

SEQ ID NO: 4188 - DNA, 20 bp, Artificial
  CRISPR gRNA sequence
acgtgccatatgcagcacga

SEQ ID NO: 4189 - DNA, 20 bp, Artificial
  CRISPR gRNA sequence
cgtgccatatgcagcacgag

SEQ ID NO: 4190 - DNA, 20 bp, Artificial
  CRISPR gRNA sequence
tatgcagcacgaggggctgc

SEQ ID NO: 4191 - DNA, 20 bp, Artificial
  CRISPR gRNA sequence
tgcagcacgaggggctgcaa

SEQ ID NO: 4192 - DNA, 20 bp, Artificial
  CRISPR gRNA sequence
ctgcaagagcccctcaccct

SEQ ID NO: 4193 - DNA, 20 bp, Artificial
  CRISPR gRNA sequence
aagagcccctcaccctgagc

SEQ ID NO: 4194 - DNA, 20 bp, Artificial
  CRISPR gRNA sequence
agagcccctcaccctgagct

SEQ ID NO: 4195 - DNA, 20 bp, Artificial
  CRISPR gRNA sequence
gagcccctcaccctgagctg

SEQ ID NO: 4196 - DNA, 20 bp, Artificial
  CRISPR gRNA sequence
ccctcaccctgagctggggt

SEQ ID NO: 4197 - DNA, 20 bp, Artificial
  CRISPR gRNA sequence
cctcaccctgagctggggta

SEQ ID NO: 4198 - DNA, 20 bp, Artificial
  CRISPR gRNA sequence
tcaccctgagctggggtaag

SEQ ID NO: 4199 - DNA, 20 bp, Artificial
  CRISPR gRNA sequence
caccctgagctggggtaagg

SEQ ID NO: 4200 - DNA, 20 bp, Artificial
  CRISPR gRNA sequence
accctgagctggggtaagga

SEQ ID NO: 4201 - DNA, 20 bp, Artificial
  CRISPR gRNA sequence
ccctgagctggggtaaggag

SEQ ID NO: 4202 - DNA, 20 bp, Artificial
  CRISPR gRNA sequence
agctggggtaaggaggggaa

SEQ ID NO: 4203 - DNA, 20 bp, Artificial
  CRISPR gRNA sequence
gctggggtaaggaggggaat

SEQ ID NO: 4204 - DNA, 20 bp, Artificial
  CRISPR gRNA sequence
ctggggtaaggaggggaatg

SEQ ID NO: 4205 - DNA, 20 bp, Artificial
  CRISPR gRNA sequence
tggggtaaggaggggaatgg

SEQ ID NO: 4206 - DNA, 20 bp, Artificial
  CRISPR gRNA sequence
ggggtaaggaggggaatggg

SEQ ID NO: 4207 - DNA, 20 bp, Artificial
  CRISPR gRNA sequence
tggggggtcacatctcttat

SEQ ID NO: 4208 - DNA, 20 bp, Artificial
  CRISPR gRNA sequence
gggggtcacatctcttatca

SEQ ID NO: 4209 - DNA, 20 bp, Artificial
  CRISPR gRNA sequence
gtcacatctcttatcagaga

SEQ ID NO: 4210 - DNA, 20 bp, Artificial
  CRISPR gRNA sequence
acatctcttatcagagaaag

SEQ ID NO: 4211 - DNA, 20 bp, Artificial
  CRISPR gRNA sequence
tctcttatcagagaaagcag

SEQ ID NO: 4212 - DNA, 20 bp, Artificial
  CRISPR gRNA sequence
agagaaagcagaagtccttc

SEQ ID NO: 4213 - DNA, 20 bp, Artificial
  CRISPR gRNA sequence
agaaagcagaagtccttctg

SEQ ID NO: 4214 - DNA, 20 bp, Artificial
  CRISPR gRNA sequence
gaagtccttctggagccctt

SEQ ID NO: 4215 - DNA, 20 bp, Artificial
  CRISPR gRNA sequence
tccttctggagcccttcagc

SEQ ID NO: 4216 - DNA, 20 bp, Artificial
  CRISPR gRNA sequence
ccttctggagcccttcagcc

SEQ ID NO: 4217 - DNA, 20 bp, Artificial
  CRISPR gRNA sequence
ctggagcccttcagccgggt

SEQ ID NO: 4218 - DNA, 20 bp, Artificial
  CRISPR gRNA sequence
tggagcccttcagccgggtc

SEQ ID NO: 4219 - DNA, 20 bp, Artificial
  CRISPR gRNA sequence
ggagcccttcagccgggtca

SEQ ID NO: 4220 - DNA, 20 bp, Artificial
  CRISPR gRNA sequence
ccttcagccgggtcagggct

SEQ ID NO: 4221 - DNA, 20 bp, Artificial
  CRISPR gRNA sequence
cttcagccgggtcagggctg

SEQ ID NO: 4222 - DNA, 20 bp, Artificial
  CRISPR gRNA sequence
gccgggtcagggctgaggct

SEQ ID NO: 4223 - DNA, 20 bp, Artificial
  CRISPR gRNA sequence
ccgggtcagggctgaggctt

SEQ ID NO: 4224 - DNA, 20 bp, Artificial
  CRISPR gRNA sequence
cgggtcagggctgaggcttg

SEQ ID NO: 4225 - DNA, 20 bp, Artificial
  CRISPR gRNA sequence
gggtcagggctgaggcttgg

SEQ ID NO: 4226 - DNA, 20 bp, Artificial
  CRISPR gRNA sequence
cagggctgaggcttgggggt

SEQ ID NO: 4227 - DNA, 20 bp, Artificial
  CRISPR gRNA sequence
agggctgaggcttgggggtc

SEQ ID NO: 4228 - DNA, 20 bp, Artificial
  CRISPR gRNA sequence
gggctgaggcttgggggtca

SEQ ID NO: 4229 - DNA, 20 bp, Artificial
  CRISPR gRNA sequence
ctcaccttctcctcctttcc

SEQ ID NO: 4230 - DNA, 20 bp, Artificial
  CRISPR gRNA sequence
caccttctcctcctttccca

SEQ ID NO: 4231 - DNA, 20 bp, Artificial
  CRISPR gRNA sequence
ctttcccagagccatcttcc

SEQ ID NO: 4232 - DNA, 20 bp, Artificial
  CRISPR gRNA sequence
ccagcccaccatccccatca

SEQ ID NO: 4233 - DNA, 20 bp, Artificial
  CRISPR gRNA sequence
cagcccaccatccccatcat

SEQ ID NO: 4234 - DNA, 20 bp, Artificial
  CRISPR gRNA sequence
cccatcatgggcatcgttgc

SEQ ID NO: 4235 - DNA, 20 bp, Artificial
  CRISPR gRNA sequence
catgggcatcgttgctggcc

SEQ ID NO: 4236 - DNA, 20 bp, Artificial
  CRISPR gRNA sequence
cgttgctggcctggctgtcc

SEQ ID NO: 4237 - DNA, 20 bp, Artificial
  CRISPR gRNA sequence
cctggctgtcctggttgtcc

SEQ ID NO: 4238 - DNA, 20 bp, Artificial
  CRISPR gRNA sequence
ctggttgtcctagctgtcct

SEQ ID NO: 4239 - DNA, 20 bp, Artificial
  CRISPR gRNA sequence
ggttgtcctagctgtccttg

SEQ ID NO: 4240 - DNA, 20 bp, Artificial
  CRISPR gRNA sequence
cctagctgtccttggagctg

SEQ ID NO: 4241 - DNA, 20 bp, Artificial
  CRISPR gRNA sequence
gtggtcaccgctatgatgtg

SEQ ID NO: 4242 - DNA, 20 bp, Artificial
  CRISPR gRNA sequence
tggtcaccgctatgatgtgt

SEQ ID NO: 4243 - DNA, 20 bp, Artificial
  CRISPR gRNA sequence
gtcaccgctatgatgtgtag

SEQ ID NO: 4244 - DNA, 20 bp, Artificial
  CRISPR gRNA sequence
tcaccgctatgatgtgtagg

SEQ ID NO: 4245 - DNA, 20 bp, Artificial
  CRISPR gRNA sequence
ccgctatgatgtgtaggagg

SEQ ID NO: 4246 - DNA, 20 bp, Artificial
  CRISPR gRNA sequence
gctatgatgtgtaggaggaa

SEQ ID NO: 4247 - DNA, 20 bp, Artificial
  CRISPR gRNA sequence
gatgtgtaggaggaagagct

SEQ ID NO: 4248 - DNA, 20 bp, Artificial
  CRISPR gRNA sequence
atgtgtaggaggaagagctc

SEQ ID NO: 4249 - DNA, 20 bp, Artificial
  CRISPR gRNA sequence
tgtaggaggaagagctcagg

SEQ ID NO: 4250 - DNA, 20 bp, Artificial
  CRISPR gRNA sequence
gtaggaggaagagctcaggt

SEQ ID NO: 4251 - DNA, 20 bp, Artificial
  CRISPR gRNA sequence
taggaggaagagctcaggta

SEQ ID NO: 4252 - DNA, 20 bp, Artificial
  CRISPR gRNA sequence
gaggaagagctcaggtaggg

SEQ ID NO: 4253 - DNA, 20 bp, Artificial
  CRISPR gRNA sequence
aggaagagctcaggtaggga

SEQ ID NO: 4254 - DNA, 20 bp, Artificial
  CRISPR gRNA sequence
ggaagagctcaggtagggaa

SEQ ID NO: 4255 - DNA, 20 bp, Artificial
  CRISPR gRNA sequence
gaagagctcaggtagggaag

SEQ ID NO: 4256 - DNA, 20 bp, Artificial
  CRISPR gRNA sequence
gctcaggtagggaaggggtg

SEQ ID NO: 4257 - DNA, 20 bp, Artificial
  CRISPR gRNA sequence
tcaggtagggaaggggtgaa

SEQ ID NO: 4258 - DNA, 20 bp, Artificial
  CRISPR gRNA sequence
ggtagggaaggggtgaagag

SEQ ID NO: 4259 - DNA, 20 bp, Artificial
  CRISPR gRNA sequence
gtagggaaggggtgaagagc

SEQ ID NO: 4260 - DNA, 20 bp, Artificial
  CRISPR gRNA sequence
tagggaaggggtgaagagcg

SEQ ID NO: 4261 - DNA, 20 bp, Artificial
  CRISPR gRNA sequence
aaggggtgaagagcggggtc

SEQ ID NO: 4262 - DNA, 20 bp, Artificial
  CRISPR gRNA sequence
aggggtgaagagcggggtct

SEQ ID NO: 4263 - DNA, 20 bp, Artificial
  CRISPR gRNA sequence
tctgggttttcttgtcccac

SEQ ID NO: 4264 - DNA, 20 bp, Artificial
  CRISPR gRNA sequence
ctgggttttcttgtcccact

SEQ ID NO: 4265 - DNA, 20 bp, Artificial
  CRISPR gRNA sequence
gggttttcttgtcccactgg

SEQ ID NO: 4266 - DNA, 20 bp, Artificial
  CRISPR gRNA sequence
cttgtcccactgggagtttc

SEQ ID NO: 4267 - DNA, 20 bp, Artificial
  CRISPR gRNA sequence
ccactgggagtttcaagccc

SEQ ID NO: 4268 - DNA, 20 bp, Artificial
  CRISPR gRNA sequence
cactgggagtttcaagcccc

SEQ ID NO: 4269 - DNA, 20 bp, Artificial
  CRISPR gRNA sequence
tgggagtttcaagccccagg

SEQ ID NO: 4270 - DNA, 20 bp, Artificial
  CRISPR gRNA sequence
gagtttcaagccccaggtag

SEQ ID NO: 4271 - DNA, 20 bp, Artificial
  CRISPR gRNA sequence
agtgtgccccgccttgttac

SEQ ID NO: 4272 - DNA, 20 bp, Artificial
  CRISPR gRNA sequence
gtgccccgccttgttactgg

SEQ ID NO: 4273 - DNA, 20 bp, Artificial
  CRISPR gRNA sequence
ctggaagcaccatccacaca

SEQ ID NO: 4274 - DNA, 20 bp, Artificial
  CRISPR gRNA sequence
tggaagcaccatccacacat

SEQ ID NO: 4275 - DNA, 20 bp, Artificial
  CRISPR gRNA sequence
catccacacatgggccatcc

SEQ ID NO: 4276 - DNA, 20 bp, Artificial
  CRISPR gRNA sequence
acacatgggccatcccagcc

SEQ ID NO: 4277 - DNA, 20 bp, Artificial
  CRISPR gRNA sequence
cacatgggccatcccagcct

SEQ ID NO: 4278 - DNA, 20 bp, Artificial
  CRISPR gRNA sequence
cagcctgggaccctgtgtgc

SEQ ID NO: 4279 - DNA, 20 bp, Artificial
  CRISPR gRNA sequence
ccagcacttactcttttgtg

SEQ ID NO: 4280 - DNA, 20 bp, Artificial
  CRISPR gRNA sequence
gtgaagcacatgtgacaatg

SEQ ID NO: 4281 - DNA, 20 bp, Artificial
  CRISPR gRNA sequence
tgaagcacatgtgacaatga

SEQ ID NO: 4282 - DNA, 20 bp, Artificial
  CRISPR gRNA sequence
gcacatgtgacaatgaagga

SEQ ID NO: 4283 - DNA, 20 bp, Artificial
  CRISPR gRNA sequence
atgtatcaccttgatgatta

SEQ ID NO: 4284 - DNA, 20 bp, Artificial
  CRISPR gRNA sequence
caccttgatgattatggtgt

SEQ ID NO: 4285 - DNA, 20 bp, Artificial
  CRISPR gRNA sequence
accttgatgattatggtgtt

SEQ ID NO: 4286 - DNA, 20 bp, Artificial
  CRISPR gRNA sequence
ccttgatgattatggtgttg

SEQ ID NO: 4287 - DNA, 20 bp, Artificial
  CRISPR gRNA sequence
tggtgttggggtcctgattc

SEQ ID NO: 4288 - DNA, 20 bp, Artificial
  CRISPR gRNA sequence
gtcctgattccagcattcat

SEQ ID NO: 4289 - DNA, 20 bp, Artificial
  CRISPR gRNA sequence
tgattccagcattcatgagt

SEQ ID NO: 4290 - DNA, 20 bp, Artificial
  CRISPR gRNA sequence
gattccagcattcatgagtc

SEQ ID NO: 4291 - DNA, 20 bp, Artificial
  CRISPR gRNA sequence
attccagcattcatgagtca

SEQ ID NO: 4292 - DNA, 20 bp, Artificial
  CRISPR gRNA sequence
ttccagcattcatgagtcag

SEQ ID NO: 4293 - DNA, 20 bp, Artificial
  CRISPR gRNA sequence
cagcattcatgagtcagggg

SEQ ID NO: 4294 - DNA, 20 bp, Artificial
  CRISPR gRNA sequence
agcattcatgagtcagggga

SEQ ID NO: 4295 - DNA, 20 bp, Artificial
  CRISPR gRNA sequence
gtcaggggaaggtccctgct

SEQ ID NO: 4296 - DNA, 20 bp, Artificial
  CRISPR gRNA sequence
tcaggggaaggtccctgcta

SEQ ID NO: 4297 - DNA, 20 bp, Artificial
  CRISPR gRNA sequence
gggaaggtccctgctaagga

SEQ ID NO: 4298 - DNA, 20 bp, Artificial
  CRISPR gRNA sequence
tccctgctaaggacagacct

SEQ ID NO: 4299 - DNA, 20 bp, Artificial
  CRISPR gRNA sequence
ccctgctaaggacagacctt

SEQ ID NO: 4300 - DNA, 20 bp, Artificial
  CRISPR gRNA sequence
ctgctaaggacagaccttag

SEQ ID NO: 4301 - DNA, 20 bp, Artificial
  CRISPR gRNA sequence
tgctaaggacagaccttagg

SEQ ID NO: 4302 - DNA, 20 bp, Artificial
  CRISPR gRNA sequence
gctaaggacagaccttagga

SEQ ID NO: 4303 - DNA, 20 bp, Artificial
  CRISPR gRNA sequence
aaggacagaccttaggaggg

SEQ ID NO: 4304 - DNA, 20 bp, Artificial
  CRISPR gRNA sequence
acagaccttaggagggcagt

SEQ ID NO: 4305 - DNA, 20 bp, Artificial
  CRISPR gRNA sequence
ccttaggagggcagttggtc

SEQ ID NO: 4306 - DNA, 20 bp, Artificial
  CRISPR gRNA sequence
catgtttcctgatcctgccc

SEQ ID NO: 4307 - DNA, 20 bp, Artificial
  CRISPR gRNA sequence
atgtttcctgatcctgccct

SEQ ID NO: 4308 - DNA, 20 bp, Artificial
  CRISPR gRNA sequence
ctgatcctgccctgggtctg

SEQ ID NO: 4309 - DNA, 20 bp, Artificial
  CRISPR gRNA sequence
ctgccctgggtctgcagtcg

SEQ ID NO: 4310 - DNA, 20 bp, Artificial
  CRISPR gRNA sequence
tgggtctgcagtcgtagttc

SEQ ID NO: 4311 - DNA, 20 bp, Artificial
  CRISPR gRNA sequence
gtagttctggaaacttctct

SEQ ID NO: 4312 - DNA, 20 bp, Artificial
  CRISPR gRNA sequence
tagttctggaaacttctctt

SEQ ID NO: 4313 - DNA, 20 bp, Artificial
  CRISPR gRNA sequence
tggaaacttctcttgggtcc

SEQ ID NO: 4314 - DNA, 20 bp, Artificial
  CRISPR gRNA sequence
acttctcttgggtccaagac

SEQ ID NO: 4315 - DNA, 20 bp, Artificial
  CRISPR gRNA sequence
cttctcttgggtccaagact

SEQ ID NO: 4316 - DNA, 20 bp, Artificial
  CRISPR gRNA sequence
tctcttgggtccaagactag

SEQ ID NO: 4317 - DNA, 20 bp, Artificial
  CRISPR gRNA sequence
ctcttgggtccaagactagg

SEQ ID NO: 4318 - DNA, 20 bp, Artificial
  CRISPR gRNA sequence
caagactaggaggttcccct

SEQ ID NO: 4319 - DNA, 20 bp, Artificial
  CRISPR gRNA sequence
gaggttcccctaagatcaca

SEQ ID NO: 4320 - DNA, 20 bp, Artificial
  CRISPR gRNA sequence
cacatggccctgcctcctcc

SEQ ID NO: 4321 - DNA, 20 bp, Artificial
  CRISPR gRNA sequence
gcctcctcccagtcccctca

SEQ ID NO: 4322 - DNA, 20 bp, Artificial
  CRISPR gRNA sequence
cctcctcccagtcccctcat

SEQ ID NO: 4323 - DNA, 20 bp, Artificial
  CRISPR gRNA sequence
ctcctcccagtcccctcata

SEQ ID NO: 4324 - DNA, 20 bp, Artificial
  CRISPR gRNA sequence
catagggcattttcttccca

SEQ ID NO: 4325 - DNA, 20 bp, Artificial
  CRISPR gRNA sequence
atagggcattttcttcccac

SEQ ID NO: 4326 - DNA, 20 bp, Artificial
  CRISPR gRNA sequence
gggcattttcttcccacagg

SEQ ID NO: 4327 - DNA, 20 bp, Artificial
  CRISPR gRNA sequence
ttttcttcccacaggtggaa

SEQ ID NO: 4328 - DNA, 20 bp, Artificial
  CRISPR gRNA sequence
tttcttcccacaggtggaaa

SEQ ID NO: 4329 - DNA, 20 bp, Artificial
  CRISPR gRNA sequence
tcttcccacaggtggaaaag

SEQ ID NO: 4330 - DNA, 20 bp, Artificial
  CRISPR gRNA sequence
cttcccacaggtggaaaagg

SEQ ID NO: 4331 - DNA, 20 bp, Artificial
  CRISPR gRNA sequence
ttcccacaggtggaaaagga

SEQ ID NO: 4332 - DNA, 20 bp, Artificial
  CRISPR gRNA sequence
cccacaggtggaaaaggagg

SEQ ID NO: 4333 - DNA, 20 bp, Artificial
  CRISPR gRNA sequence
gaaaaggagggagctgctct

SEQ ID NO: 4334 - DNA, 20 bp, Artificial
  CRISPR gRNA sequence
aaaaggagggagctgctctc

SEQ ID NO: 4335 - DNA, 20 bp, Artificial
  CRISPR gRNA sequence
gctgctctcaggctgcgtgt

SEQ ID NO: 4336 - DNA, 20 bp, Artificial
  CRISPR gRNA sequence
ctcaggctgcgtgtaagtga

SEQ ID NO: 4337 - DNA, 20 bp, Artificial
  CRISPR gRNA sequence
aggctgcgtgtaagtgatgg

SEQ ID NO: 4338 - DNA, 20 bp, Artificial
  CRISPR gRNA sequence
ctgcgtgtaagtgatggcgg

SEQ ID NO: 4339 - DNA, 20 bp, Artificial
  CRISPR gRNA sequence
tgcgtgtaagtgatggcggc

SEQ ID NO: 4340 - DNA, 20 bp, Artificial
  CRISPR gRNA sequence
aagtgatggcggcgggcgtg

SEQ ID NO: 4341 - DNA, 20 bp, Artificial
  CRISPR gRNA sequence
gtgatggcggcgggcgtgtg

SEQ ID NO: 4342 - DNA, 20 bp, Artificial
  CRISPR gRNA sequence
tgatggcggcgggcgtgtgg

SEQ ID NO: 4343 - DNA, 20 bp, Artificial
  CRISPR gRNA sequence
atggcggcgggcgtgtggag

SEQ ID NO: 4344 - DNA, 20 bp, Artificial
  CRISPR gRNA sequence
ctcttgtcccacatctcctg

SEQ ID NO: 4345 - DNA, 20 bp, Artificial
  CRISPR gRNA sequence
tcttgtcccacatctcctgc

SEQ ID NO: 4346 - DNA, 20 bp, Artificial
  CRISPR gRNA sequence
catctcctgcgggctctgac

SEQ ID NO: 4347 - DNA, 20 bp, Artificial
  CRISPR gRNA sequence
atctcctgcgggctctgacc

SEQ ID NO: 4348 - DNA, 20 bp, Artificial
  CRISPR gRNA sequence
tctttttttttgttctaccc

SEQ ID NO: 4349 - DNA, 20 bp, Artificial
  CRISPR gRNA sequence
ctttttttttgttctacccc

SEQ ID NO: 4350 - DNA, 20 bp, Artificial
  CRISPR gRNA sequence
tttttttgttctaccccagg

SEQ ID NO: 4351 - DNA, 20 bp, Artificial
  CRISPR gRNA sequence
tgttctaccccaggcagcaa

SEQ ID NO: 4352 - DNA, 20 bp, Artificial
  CRISPR gRNA sequence
ccccaggcagcaacagtgcc

SEQ ID NO: 4353 - DNA, 20 bp, Artificial
  CRISPR gRNA sequence
cccaggcagcaacagtgccc

SEQ ID NO: 4354 - DNA, 20 bp, Artificial
  CRISPR gRNA sequence
ccaggcagcaacagtgccca

SEQ ID NO: 4355 - DNA, 20 bp, Artificial
  CRISPR gRNA sequence
acagtgcccagggctctgat

SEQ ID NO: 4356 - DNA, 20 bp, Artificial
  CRISPR gRNA sequence
tgagtctctcatcacttgta

SEQ ID NO: 4357 - DNA, 20 bp, Artificial
  CRISPR gRNA sequence
gagtctctcatcacttgtaa

SEQ ID NO: 4358 - DNA, 20 bp, Artificial
  CRISPR gRNA sequence
ctctcatcacttgtaaaggt

SEQ ID NO: 4359 - DNA, 20 bp, Artificial
  CRISPR gRNA sequence
cacttgtaaaggtgagattc

SEQ ID NO: 4360 - DNA, 20 bp, Artificial
  CRISPR gRNA sequence
acttgtaaaggtgagattct

SEQ ID NO: 4361 - DNA, 20 bp, Artificial
  CRISPR gRNA sequence
cttgtaaaggtgagattctg

SEQ ID NO: 4362 - DNA, 20 bp, Artificial
  CRISPR gRNA sequence
tgtaaaggtgagattctggg

SEQ ID NO: 4363 - DNA, 20 bp, Artificial
  CRISPR gRNA sequence
ggtgagattctggggagctg

SEQ ID NO: 4364 - DNA, 20 bp, Artificial
  CRISPR gRNA sequence
gagattctggggagctgaag

SEQ ID NO: 4365 - DNA, 20 bp, Artificial
  CRISPR gRNA sequence
ttctggggagctgaagtggt

SEQ ID NO: 4366 - DNA, 20 bp, Artificial
  CRISPR gRNA sequence
tctggggagctgaagtggtc

SEQ ID NO: 4367 - DNA, 20 bp, Artificial
  CRISPR gRNA sequence
ctggggagctgaagtggtcg

SEQ ID NO: 4368 - DNA, 20 bp, Artificial
  CRISPR gRNA sequence
tggggagctgaagtggtcgg

SEQ ID NO: 4369 - DNA, 20 bp, Artificial
  CRISPR gRNA sequence
ggagctgaagtggtcggggg

SEQ ID NO: 4370 - DNA, 20 bp, Artificial
  CRISPR gRNA sequence
gagctgaagtggtcgggggt

SEQ ID NO: 4371 - DNA, 20 bp, Artificial
  CRISPR gRNA sequence
agctgaagtggtcgggggtg

SEQ ID NO: 4372 - DNA, 20 bp, Artificial
  CRISPR gRNA sequence
tgaagtggtcgggggtgggg

SEQ ID NO: 4373 - DNA, 20 bp, Artificial
  CRISPR gRNA sequence
aagtggtcgggggtggggca

SEQ ID NO: 4374 - DNA, 20 bp, Artificial
  CRISPR gRNA sequence
agtggtcgggggtggggcag

SEQ ID NO: 4375 - DNA, 20 bp, Artificial
  CRISPR gRNA sequence
gtggtcgggggtggggcaga

SEQ ID NO: 4376 - DNA, 20 bp, Artificial
  CRISPR gRNA sequence
cgggggtggggcagagggaa

SEQ ID NO: 4377 - DNA, 20 bp, Artificial
  CRISPR gRNA sequence
gggggtggggcagagggaaa

SEQ ID NO: 4378 - DNA, 20 bp, Artificial
  CRISPR gRNA sequence
tggggcagagggaaaaggcc

SEQ ID NO: 4379 - DNA, 20 bp, Artificial
  CRISPR gRNA sequence
ggggcagagggaaaaggcct

SEQ ID NO: 4380 - DNA, 20 bp, Artificial
  CRISPR gRNA sequence
gagggaaaaggcctgggtaa

SEQ ID NO: 4381 - DNA, 20 bp, Artificial
  CRISPR gRNA sequence
agggaaaaggcctgggtaat

SEQ ID NO: 4382 - DNA, 20 bp, Artificial
  CRISPR gRNA sequence
gggaaaaggcctgggtaatg

SEQ ID NO: 4383 - DNA, 20 bp, Artificial
  CRISPR gRNA sequence
ggtaatggggattctttgat

SEQ ID NO: 4384 - DNA, 20 bp, Artificial
  CRISPR gRNA sequence
gtaatggggattctttgatt

SEQ ID NO: 4385 - DNA, 20 bp, Artificial
  CRISPR gRNA sequence
ttctttgattgggacgtttc

SEQ ID NO: 4386 - DNA, 20 bp, Artificial
  CRISPR gRNA sequence
attgggacgtttcgagtgtg

SEQ ID NO: 4387 - DNA, 20 bp, Artificial
  CRISPR gRNA sequence
gggacgtttcgagtgtgtgg

SEQ ID NO: 4388 - DNA, 20 bp, Artificial
  CRISPR gRNA sequence
ggacgtttcgagtgtgtggt

SEQ ID NO: 4389 - DNA, 20 bp, Artificial
  CRISPR gRNA sequence
cactcgaaacgtcccaatca

SEQ ID NO: 4390 - DNA, 20 bp, Artificial
  CRISPR gRNA sequence
ccccgaccacttcagctccc

SEQ ID NO: 4391 - DNA, 20 bp, Artificial
  CRISPR gRNA sequence
ccctgggcactgttgctgcc

SEQ ID NO: 4392 - DNA, 20 bp, Artificial
  CRISPR gRNA sequence
cgcaggagatgtgggacaag

SEQ ID NO: 4393 - DNA, 20 bp, Artificial
  CRISPR gRNA sequence
atgtgggacaagaggaatta

SEQ ID NO: 4394 - DNA, 20 bp, Artificial
  CRISPR gRNA sequence
ctacgactgcagacccaggg

SEQ ID NO: 4395 - DNA, 20 bp, Artificial
  CRISPR gRNA sequence
gaaacatggggaaagcagtt

SEQ ID NO: 4396 - DNA, 20 bp, Artificial
  CRISPR gRNA sequence
cagggaccttcccctgactc

SEQ ID NO: 4397 - DNA, 20 bp, Artificial
  CRISPR gRNA sequence
ttcccctgactcatgaatgc

SEQ ID NO: 4398 - DNA, 20 bp, Artificial
  CRISPR gRNA sequence
ttgtcacatgtgcttcacaa

SEQ ID NO: 4399 - DNA, 20 bp, Artificial
  CRISPR gRNA sequence
aaagagtaagtgctggcaca

SEQ ID NO: 4400 - DNA, 20 bp, Artificial
  CRISPR gRNA sequence
tggcacacagggtcccaggc

SEQ ID NO: 4401 - DNA, 20 bp, Artificial
  CRISPR gRNA sequence
caggctgggatggcccatgt

SEQ ID NO: 4402 - DNA, 20 bp, Artificial
  CRISPR gRNA sequence
ccagcaacgatgcccatgat

SEQ ID NO: 4403 - DNA, 20 bp, Artificial
  CRISPR gRNA sequence
ttcccctccttaccccagct

SEQ ID NO: 4404 - DNA, 20 bp, Artificial
  CRISPR gRNA sequence
gtctccacaagctcggtgtc

SEQ ID NO: 4405 - DNA, 20 bp, Artificial
  CRISPR gRNA sequence
ccaggtcagtgtgatctccg

SEQ ID NO: 4406 - DNA, 20 bp, Artificial
  CRISPR gRNA sequence
aagcccagggcccagcacct

SEQ ID NO: 4407 - DNA, 20 bp, Artificial
  CRISPR gRNA sequence
ggtggcctcatggtcagaga

SEQ ID NO: 4408 - DNA, 20 bp, Artificial
  CRISPR gRNA sequence
tcatggtcagagagggggtg

SEQ ID NO: 4409 - DNA, 20 bp, Artificial
  CRISPR gRNA sequence
ggtgggtcacgtgtgtcttt

SEQ ID NO: 4410 - DNA, 20 bp, Artificial
  CRISPR gRNA sequence
tctttgggggttctgacggg

SEQ ID NO: 4411 - DNA, 20 bp, Artificial
  CRISPR gRNA sequence
agcgcccatgtgaccatcct

SEQ ID NO: 4412 - DNA, 20 bp, Artificial
  CRISPR gRNA sequence
ctgagaatggacaggacacc

SEQ ID NO: 4413 - DNA, 20 bp, Artificial
  CRISPR gRNA sequence
ccagcctggacacaggcacc

SEQ ID NO: 4414 - DNA, 20 bp, Artificial
  CRISPR gRNA sequence
cagcgacttctggtcctgac

SEQ ID NO: 4415 - DNA, 20 bp, Artificial
  CRISPR gRNA sequence
gctgcaggactcagaaaagc

SEQ ID NO: 4416 - DNA, 20 bp, Artificial
  CRISPR gRNA sequence
gaatcaaaccttcagacaca

SEQ ID NO: 4417 - DNA, 20 bp, Artificial
  CRISPR gRNA sequence
cgggccgcctccaacttgcg

SEQ ID NO: 4418 - DNA, 20 bp, Artificial
  CRISPR gRNA sequence
tcgcagccatacatcctctg

SEQ ID NO: 4419 - DNA, 20 bp, Artificial
  CRISPR gRNA sequence
ccccgccccgaccaacccgc

SEQ ID NO: 4420 - DNA, 20 bp, Artificial
  CRISPR gRNA sequence
ggcctaaaccgaaaatgaaa

SEQ ID NO: 4421 - DNA, 20 bp, Artificial
  CRISPR gRNA sequence
gactggggctctctccggtc

SEQ ID NO: 4422 - DNA, 20 bp, Artificial
  CRISPR gRNA sequence
ctctccggtcgagggtctgg

SEQ ID NO: 4423 - DNA, 20 bp, Artificial
  CRISPR gRNA sequence
cgggttccgcagatccacct

SEQ ID NO: 4424 - DNA, 20 bp, Artificial
  CRISPR gRNA sequence
ttccgcagatccaccttggg

SEQ ID NO: 4425 - DNA, 20 bp, Artificial
  CRISPR gRNA sequence
ggcgacccgggccgtccgtg

SEQ ID NO: 4426 - DNA, 20 bp, Artificial
  CRISPR gRNA sequence
gccgtccgtgggggatgggg

SEQ ID NO: 4427 - DNA, 20 bp, Artificial
  CRISPR gRNA sequence
tcgtgacctgcgccccgggc

SEQ ID NO: 4428 - DNA, 20 bp, Artificial
  CRISPR gRNA sequence
ggcggtgtcgaaatacctca

SEQ ID NO: 4429 - DNA, 20 bp, Artificial
  CRISPR gRNA sequence
ccacctccctgcgcggctcc

SEQ ID NO: 4430 - DNA, 20 bp, Artificial
  CRISPR gRNA sequence
cccgcatctcggcctctggg

SEQ ID NO: 4431 - DNA, 20 bp, Artificial
  CRISPR gRNA sequence
tctcggcctctggggagaat

SEQ ID NO: 4432 - DNA, 20 bp, Artificial
  CRISPR gRNA sequence
cctctggggagaatgtgagt

SEQ ID NO: 4433 - DNA, 20 bp, Artificial
  CRISPR gRNA sequence
tggggagaatgtgagtccgg

SEQ ID NO: 4434 - DNA, 20 bp, Artificial
  CRISPR gRNA sequence
ttctccccagaggccgagat

SEQ ID NO: 4435 - DNA, 20 bp, Artificial
  CRISPR gRNA sequence
cctgaccgagacctgggcct

SEQ ID NO: 4436 - DNA, 20 bp, Artificial
  CRISPR gRNA sequence
gagacctgggcctgtgagtg

SEQ ID NO: 4437 - DNA, 20 bp, Artificial
  CRISPR gRNA sequence
ccggggagccgcgcagggag

SEQ ID NO: 4438 - DNA, 20 bp, Artificial
  CRISPR gRNA sequence
cgcgcagggaggtgggtcgg

SEQ ID NO: 4439 - DNA, 20 bp, Artificial
  CRISPR gRNA sequence
tgcggttcgacagcgacgcc

SEQ ID NO: 4440 - DNA, 20 bp, Artificial
  CRISPR gRNA sequence
agaggggagccgcgggcgcc

SEQ ID NO: 4441 - DNA, 20 bp, Artificial
  CRISPR gRNA sequence
gtgggtggagcaggaggggc

SEQ ID NO: 4442 - DNA, 20 bp, Artificial
  CRISPR gRNA sequence
aagcgccaggcacaggctga

SEQ ID NO: 4443 - DNA, 20 bp, Artificial
  CRISPR gRNA sequence
ctacaaccagagcgaggacg

SEQ ID NO: 4444 - DNA, 20 bp, Artificial
  CRISPR gRNA sequence
ccccatcccccacggacggc

SEQ ID NO: 4445 - DNA, 20 bp, Artificial
  CRISPR gRNA sequence
cacggacggcccgggtcgcc

SEQ ID NO: 4446 - DNA, 20 bp, Artificial
  CRISPR gRNA sequence
cgtctgagatccaccccaag

SEQ ID NO: 4447 - DNA, 20 bp, Artificial
  CRISPR gRNA sequence
cggtttaggccaaaatcccc

SEQ ID NO: 4448 - DNA, 20 bp, Artificial
  CRISPR gRNA sequence
gctgaccgcgggggcggggc

SEQ ID NO: 4449 - DNA, 20 bp, Artificial
  CRISPR gRNA sequence
ccagggtctcacaccctcca

SEQ ID NO: 4450 - DNA, 20 bp, Artificial
  CRISPR gRNA sequence
gcccgacgggcgcctcctcc

SEQ ID NO: 4451 - DNA, 20 bp, Artificial
  CRISPR gRNA sequence
accagtccgcctacgacggc

SEQ ID NO: 4452 - DNA, 20 bp, Artificial
  CRISPR gRNA sequence
ctacctggagggcacgtgcg

SEQ ID NO: 4453 - DNA, 20 bp, Artificial
  CRISPR gRNA sequence
cccatctcctatagatctcc

SEQ ID NO: 4454 - DNA, 20 bp, Artificial
  CRISPR gRNA sequence
ccacgaggaggggaggaaaa

SEQ ID NO: 4455 - DNA, 20 bp, Artificial
  CRISPR gRNA sequence
gaggaaaatgggatcagcac

SEQ ID NO: 4456 - DNA, 20 bp, Artificial
  CRISPR gRNA sequence
cactggaatatcgccctccc

SEQ ID NO: 4457 - DNA, 20 bp, Artificial
  CRISPR gRNA sequence
atatcgccctcccttgaatg

SEQ ID NO: 4458 - DNA, 20 bp, Artificial
  CRISPR gRNA sequence
tcccttgaatggagaatggc

SEQ ID NO: 4459 - DNA, 20 bp, Artificial
  CRISPR gRNA sequence
ggagaatggcatgagttttc

SEQ ID NO: 4460 - DNA, 20 bp, Artificial
  CRISPR gRNA sequence
tctgctctctaggacaatta

SEQ ID NO: 4461 - DNA, 20 bp, Artificial
  CRISPR gRNA sequence
atggaggggaagacagtccc

SEQ ID NO: 4462 - DNA, 20 bp, Artificial
  CRISPR gRNA sequence
cagtccctggaatactgatc

SEQ ID NO: 4463 - DNA, 20 bp, Artificial
  CRISPR gRNA sequence
aaggtttgattccagctttt

SEQ ID NO: 4464 - DNA, 20 bp, Artificial
  CRISPR gRNA sequence
tcagagactagaactttcca

SEQ ID NO: 4465 - DNA, 20 bp, Artificial
  CRISPR gRNA sequence
gcctgtgtccaggctggcgt

SEQ ID NO: 4466 - DNA, 20 bp, Artificial
  CRISPR gRNA sequence
ccaggtgtcctgtccattct

SEQ ID NO: 4467 - DNA, 20 bp, Artificial
  CRISPR gRNA sequence
gatggtcacatgggcgctgc

SEQ ID NO: 4468 - DNA, 20 bp, Artificial
  CRISPR gRNA sequence
ccaagagagatgcaaagtgt

SEQ ID NO: 4469 - DNA, 20 bp, Artificial
  CRISPR gRNA sequence
agatcacactgacctggcag

SEQ ID NO: 4470 - DNA, 20 bp, Artificial
  CRISPR gRNA sequence
aagagcccctcaccctgagc

SEQ ID NO: 4471 - DNA, 20 bp, Artificial
  CRISPR gRNA sequence
ccctgagctggggtaaggag

SEQ ID NO: 4472 - DNA, 20 bp, Artificial
  CRISPR gRNA sequence
ctggggtaaggaggggaatg

SEQ ID NO: 4473 - DNA, 20 bp, Artificial
  CRISPR gRNA sequence
gtccttctggagcccttcag

SEQ ID NO: 4474 - DNA, 20 bp, Artificial
  CRISPR gRNA sequence
ccgggtcagggctgaggctt

SEQ ID NO: 4475 - DNA, 20 bp, Artificial
  CRISPR gRNA sequence
aggaagagctcaggtaggga

SEQ ID NO: 4476 - DNA, 20 bp, Artificial
  CRISPR gRNA sequence
ggtagggaaggggtgaagag

SEQ ID NO: 4477 - DNA, 20 bp, Artificial
  CRISPR gRNA sequence
gaaggggtgaagagcggggt

SEQ ID NO: 4478 - DNA, 20 bp, Artificial
  CRISPR gRNA sequence
ctgggttttcttgtcccact

SEQ ID NO: 4479 - DNA, 20 bp, Artificial
  CRISPR gRNA sequence
agcacatgtgacaatgaagg

SEQ ID NO: 4480 - DNA, 20 bp, Artificial
  CRISPR gRNA sequence
caccttgatgattatggtgt

SEQ ID NO: 4481 - DNA, 20 bp, Artificial
  CRISPR gRNA sequence
gggtcctgattccagcattc

SEQ ID NO: 4482 - DNA, 20 bp, Artificial
  CRISPR gRNA sequence
ccatgtttcctgatcctgcc

SEQ ID NO: 4483 - DNA, 20 bp, Artificial
  CRISPR gRNA sequence
cgtagttctggaaacttctc

SEQ ID NO: 4484 - DNA, 20 bp, Artificial
  CRISPR gRNA sequence
caacagtgcccagggctctg

SEQ ID NO: 4485 - DNA, 20 bp, Artificial
  CRISPR gRNA sequence
tctggggagctgaagtggtc

SEQ ID NO: 4486 - DNA, 20 bp, Artificial
  CRISPR gRNA sequence
gtggggcagagggaaaaggc

SEQ ID NO: 4487 - DNA, 20 bp, Artificial
  CRISPR gRNA sequence
agggaaaaggcctgggtaat

SEQ ID NO: 4488 - DNA, 20 bp, Artificial
  CRISPR gRNA sequence
gattctttgattgggacgtt

SEQ ID NO: 4489 - DNA, 20 bp, Artificial
  CRISPR gRNA sequence
ctcctagtcttggacccaag

SEQ ID NO: 4490 - DNA, 20 bp, Artificial
  CRISPR gRNA sequence
catccgtccttcattgtcac

SEQ ID NO: 4491 - DNA, 20 bp, Artificial
  CRISPR gRNA sequence
tgggatggcccatgtgtgga

SEQ ID NO: 4492 - DNA, 20 bp, Artificial
  CRISPR gRNA sequence
aggcggggcacacttctacc

SEQ ID NO: 4493 - DNA, 20 bp, Artificial
  CRISPR gRNA sequence
ctgaagggctccagaaggac

SEQ ID NO: 4494 - DNA, 20 bp, Artificial
  CRISPR gRNA sequence
gccccgccccgaccaacccg

SEQ ID NO: 4495 - DNA, 20 bp, Artificial
  CRISPR gRNA sequence
tcactcggtcagcctgtgcc

SEQ ID NO: 4496 - DNA, 20 bp, Artificial
  CRISPR gRNA sequence
ccctcgctcctctccgcaga

SEQ ID NO: 4497 - DNA, 20 bp, Artificial
  CRISPR gRNA sequence
tagaaccgggactgcggaga

SEQ ID NO: 4498 - DNA, 20 bp, Artificial
  CRISPR gRNA sequence
ccgggactgcggagacgctg

SEQ ID NO: 4499 - DNA, 20 bp, Artificial
  CRISPR gRNA sequence
cccggcccggccgcggagag

SEQ ID NO: 4500 - DNA, 20 bp, Artificial
  CRISPR gRNA sequence
gagagccccagtcgccttta

SEQ ID NO: 4501 - DNA, 20 bp, Artificial
  CRISPR gRNA sequence
cgcctttacccggtttcatt

SEQ ID NO: 4502 - DNA, 20 bp, Artificial
  CRISPR gRNA sequence
gaccagtccgcctacgacgg

SEQ ID NO: 4503 - DNA, 20 bp, Artificial
  CRISPR gRNA sequence
tcccttgaatggagaatggc

SEQ ID NO: 4504 - DNA, 20 bp, Artificial
  CRISPR gRNA sequence
ggagaatggcatgagttttc

SEQ ID NO: 4505 - DNA, 20 bp, Artificial
  CRISPR gRNA sequence
gcctcacactcaatgtgtct

SEQ ID NO: 4506 - DNA, 20 bp, Artificial
  CRISPR gRNA sequence
cacactcaatgtgtctgaag

SEQ ID NO: 4507 - DNA, 20 bp, Artificial
  CRISPR gRNA sequence
aatgtgtctgaaggtttgat

SEQ ID NO: 4508 - DNA, 20 bp, Artificial
  CRISPR gRNA sequence
actagaactttccaatgaat

SEQ ID NO: 4509 - DNA, 20 bp, Artificial
  CRISPR gRNA sequence
ccaccctgaggtgctgggcc

SEQ ID NO: 4510 - DNA, 20 bp, Artificial
  CRISPR gRNA sequence
ggaggaccagacccaggaca

SEQ ID NO: 4511 - DNA, 20 bp, Artificial
  CRISPR gRNA sequence
cccttcagccgggtcagggc

SEQ ID NO: 4512 - DNA, 20 bp, Artificial
  CRISPR gRNA sequence
gaaggggtgaagagcggggt

SEQ ID NO: 4513 - DNA, 20 bp, Artificial
  CRISPR gRNA sequence
ctgggttttcttgtcccact

SEQ ID NO: 4514 - DNA, 20 bp, Artificial
  CRISPR gRNA sequence
gaaggacggatgtatcacct

SEQ ID NO: 4515 - DNA, 20 bp, Artificial
  CRISPR gRNA sequence
tgatgattatggtgttgggg

SEQ ID NO: 4516 - DNA, 20 bp, Artificial
  CRISPR gRNA sequence
gcagttggtccagaacccac

SEQ ID NO: 4517 - DNA, 20 bp, Artificial
  CRISPR gRNA sequence
agaacccacaactgctttcc

SEQ ID NO: 4518 - DNA, 20 bp, Artificial
  CRISPR gRNA sequence
gtctctcatcacttgtaaag

SEQ ID NO: 4519 - DNA, 20 bp, Artificial
  CRISPR gRNA sequence
gagggaaaaggcctgggtaa

SEQ ID NO: 4520 - DNA, 20 bp, Artificial
  CRISPR gRNA sequence
aggcctgggtaatggggatt

SEQ ID NO: 4521 - DNA, 20 bp, Artificial
  CRISPR gRNA sequence
taatggggattctttgattg

SEQ ID NO: 4522 - DNA, 20 bp, Artificial
  CRISPR gRNA sequence
acactcgaaacgtcccaatc

SEQ ID NO: 4523 - DNA, 20 bp, Artificial
  CRISPR gRNA sequence
cccccgaccacttcagctcc

SEQ ID NO: 4524 - DNA, 20 bp, Artificial
  CRISPR gRNA sequence
ccctccttttccacctgtgg

SEQ ID NO: 4525 - DNA, 20 bp, Artificial
  CRISPR gRNA sequence
gcttgaaactcccagtggga

SEQ ID NO: 4526 - DNA, 20 bp, Artificial
  CRISPR gRNA sequence
gggggttctgacgggaagag

SEQ ID NO: 4527 - DNA, 20 bp, Artificial
  CRISPR gRNA sequence
cagcgcccatgtgaccatcc

SEQ ID NO: 4528 - DNA, 20 bp, Artificial
  CRISPR gRNA sequence
ctgagtggaggctgcaggac

SEQ ID NO: 4529 - DNA, 20 bp, Artificial
  CRISPR gRNA sequence
gaggcagagaacaaggcctg

SEQ ID NO: 4530 - DNA, 20 bp, Artificial
  CRISPR gRNA sequence
acccgcatctcggcctctgg

SEQ ID NO: 4531 - DNA, 20 bp, Artificial
  CRISPR gRNA sequence
aatatcgccctcccttgaat

SEQ ID NO: 4532 - DNA, 20 bp, Artificial
  CRISPR gRNA sequence
ggggggtcacatctcttatc

SEQ ID NO: 4533 - DNA, 20 bp, Artificial
  CRISPR gRNA sequence
tgaaactcccagtgggacaa

SEQ ID NO: 4534 - DNA, 20 bp, Artificial
  CRISPR gRNA sequence
ggccctcagaggaaactcag

SEQ ID NO: 4535 - DNA, 20 bp, Artificial
  CRISPR gRNA sequence
gaaacgtcccaatcaaagaa

SEQ ID NO: 4536 - DNA, 20 bp, Artificial
  CRISPR gRNA sequence
cccaggccttttccctctgc

SEQ ID NO: 4537 - DNA, 20 bp, Artificial
  CRISPR gRNA sequence
ttccctctgccccacccccg

SEQ ID NO: 4538 - DNA, 20 bp, Artificial
  CRISPR gRNA sequence
tccctctgccccacccccga

SEQ ID NO: 4539 - DNA, 20 bp, Artificial
  CRISPR gRNA sequence
ccctctgccccacccccgac

SEQ ID NO: 4540 - DNA, 20 bp, Artificial
  CRISPR gRNA sequence
cctctgccccacccccgacc

SEQ ID NO: 4541 - DNA, 20 bp, Artificial
  CRISPR gRNA sequence
tgccccacccccgaccactt

SEQ ID NO: 4542 - DNA, 20 bp, Artificial
  CRISPR gRNA sequence
ccccacccccgaccacttca

SEQ ID NO: 4543 - DNA, 20 bp, Artificial
  CRISPR gRNA sequence
cagctccccagaatctcacc

SEQ ID NO: 4544 - DNA, 20 bp, Artificial
  CRISPR gRNA sequence
agctccccagaatctcacct

SEQ ID NO: 4545 - DNA, 20 bp, Artificial
  CRISPR gRNA sequence
cccagaatctcacctttaca

SEQ ID NO: 4546 - DNA, 20 bp, Artificial
  CRISPR gRNA sequence
acctttacaagtgatgagag

SEQ ID NO: 4547 - DNA, 20 bp, Artificial
  CRISPR gRNA sequence
tacaagtgatgagagactca

SEQ ID NO: 4548 - DNA, 20 bp, Artificial
  CRISPR gRNA sequence
acaagtgatgagagactcat

SEQ ID NO: 4549 - DNA, 20 bp, Artificial
  CRISPR gRNA sequence
caagtgatgagagactcatc

SEQ ID NO: 4550 - DNA, 20 bp, Artificial
  CRISPR gRNA sequence
atcagagccctgggcactgt

SEQ ID NO: 4551 - DNA, 20 bp, Artificial
  CRISPR gRNA sequence
ggcactgttgctgcctgggg

SEQ ID NO: 4552 - DNA, 20 bp, Artificial
  CRISPR gRNA sequence
ttgctgcctggggtagaaca

SEQ ID NO: 4553 - DNA, 20 bp, Artificial
  CRISPR gRNA sequence
ctgcctggggtagaacaaaa

SEQ ID NO: 4554 - DNA, 20 bp, Artificial
  CRISPR gRNA sequence
cctggggtagaacaaaaaaa

SEQ ID NO: 4555 - DNA, 20 bp, Artificial
  CRISPR gRNA sequence
gggtagaacaaaaaaaaaga

SEQ ID NO: 4556 - DNA, 20 bp, Artificial
  CRISPR gRNA sequence
gtcagagcccgcaggagatg

SEQ ID NO: 4557 - DNA, 20 bp, Artificial
  CRISPR gRNA sequence
tggagtaggtgagctcctcc

SEQ ID NO: 4558 - DNA, 20 bp, Artificial
  CRISPR gRNA sequence
ctccacacgcccgccgccat

SEQ ID NO: 4559 - DNA, 20 bp, Artificial
  CRISPR gRNA sequence
cacacgcccgccgccatcac

SEQ ID NO: 4560 - DNA, 20 bp, Artificial
  CRISPR gRNA sequence
acacgcagcctgagagcagc

SEQ ID NO: 4561 - DNA, 20 bp, Artificial
  CRISPR gRNA sequence
cacgcagcctgagagcagct

SEQ ID NO: 4562 - DNA, 20 bp, Artificial
  CRISPR gRNA sequence
agagcagctccctccttttc

SEQ ID NO: 4563 - DNA, 20 bp, Artificial
  CRISPR gRNA sequence
cctccttttccacctgtggg

SEQ ID NO: 4564 - DNA, 20 bp, Artificial
  CRISPR gRNA sequence
cttttccacctgtgggaaga

SEQ ID NO: 4565 - DNA, 20 bp, Artificial
  CRISPR gRNA sequence
ttccacctgtgggaagaaaa

SEQ ID NO: 4566 - DNA, 20 bp, Artificial
  CRISPR gRNA sequence
tccacctgtgggaagaaaat

SEQ ID NO: 4567 - DNA, 20 bp, Artificial
  CRISPR gRNA sequence
ccacctgtgggaagaaaatg

SEQ ID NO: 4568 - DNA, 20 bp, Artificial
  CRISPR gRNA sequence
cacctgtgggaagaaaatgc

SEQ ID NO: 4569 - DNA, 20 bp, Artificial
  CRISPR gRNA sequence
tgggaagaaaatgccctatg

SEQ ID NO: 4570 - DNA, 20 bp, Artificial
  CRISPR gRNA sequence
tgaggggactgggaggaggc

SEQ ID NO: 4571 - DNA, 20 bp, Artificial
  CRISPR gRNA sequence
ggaggaggcagggccatgtg

SEQ ID NO: 4572 - DNA, 20 bp, Artificial
  CRISPR gRNA sequence
aggggaacctcctagtcttg

SEQ ID NO: 4573 - DNA, 20 bp, Artificial
  CRISPR gRNA sequence
ggggaacctcctagtcttgg

SEQ ID NO: 4574 - DNA, 20 bp, Artificial
  CRISPR gRNA sequence
ctagtcttggacccaagaga

SEQ ID NO: 4575 - DNA, 20 bp, Artificial
  CRISPR gRNA sequence
gtcttggacccaagagaagt

SEQ ID NO: 4576 - DNA, 20 bp, Artificial
  CRISPR gRNA sequence
ggacccaagagaagtttcca

SEQ ID NO: 4577 - DNA, 20 bp, Artificial
  CRISPR gRNA sequence
gacccaagagaagtttccag

SEQ ID NO: 4578 - DNA, 20 bp, Artificial
  CRISPR gRNA sequence
ccagaactacgactgcagac

SEQ ID NO: 4579 - DNA, 20 bp, Artificial
  CRISPR gRNA sequence
cagaactacgactgcagacc

SEQ ID NO: 4580 - DNA, 20 bp, Artificial
  CRISPR gRNA sequence
cgactgcagacccagggcag

SEQ ID NO: 4581 - DNA, 20 bp, Artificial
  CRISPR gRNA sequence
cagacccagggcaggatcag

SEQ ID NO: 4582 - DNA, 20 bp, Artificial
  CRISPR gRNA sequence
tgggttctggaccaactgcc

SEQ ID NO: 4583 - DNA, 20 bp, Artificial
  CRISPR gRNA sequence
tggaccaactgccctcctaa

SEQ ID NO: 4584 - DNA, 20 bp, Artificial
  CRISPR gRNA sequence
gaccaactgccctcctaagg

SEQ ID NO: 4585 - DNA, 20 bp, Artificial
  CRISPR gRNA sequence
ccctcctaaggtctgtcctt

SEQ ID NO: 4586 - DNA, 20 bp, Artificial
  CRISPR gRNA sequence
ctaaggtctgtccttagcag

SEQ ID NO: 4587 - DNA, 20 bp, Artificial
  CRISPR gRNA sequence
aggtctgtccttagcaggga

SEQ ID NO: 4588 - DNA, 20 bp, Artificial
  CRISPR gRNA sequence
tccttagcagggaccttccc

SEQ ID NO: 4589 - DNA, 20 bp, Artificial
  CRISPR gRNA sequence
agcagggaccttcccctgac

SEQ ID NO: 4590 - DNA, 20 bp, Artificial
  CRISPR gRNA sequence
gcagggaccttcccctgact

SEQ ID NO: 4591 - DNA, 20 bp, Artificial
  CRISPR gRNA sequence
cccctgactcatgaatgctg

SEQ ID NO: 4592 - DNA, 20 bp, Artificial
  CRISPR gRNA sequence
ccctgactcatgaatgctgg

SEQ ID NO: 4593 - DNA, 20 bp, Artificial
  CRISPR gRNA sequence
actcatgaatgctggaatca

SEQ ID NO: 4594 - DNA, 20 bp, Artificial
  CRISPR gRNA sequence
atgaatgctggaatcaggac

SEQ ID NO: 4595 - DNA, 20 bp, Artificial
  CRISPR gRNA sequence
gaatcaggaccccaacacca

SEQ ID NO: 4596 - DNA, 20 bp, Artificial
  CRISPR gRNA sequence
cattgtcacatgtgcttcac

SEQ ID NO: 4597 - DNA, 20 bp, Artificial
  CRISPR gRNA sequence
attgtcacatgtgcttcaca

SEQ ID NO: 4598 - DNA, 20 bp, Artificial
  CRISPR gRNA sequence
tcacatgtgcttcacaaaag

SEQ ID NO: 4599 - DNA, 20 bp, Artificial
  CRISPR gRNA sequence
cacaaaagagtaagtgctgg

SEQ ID NO: 4600 - DNA, 20 bp, Artificial
  CRISPR gRNA sequence
acaaaagagtaagtgctggc

SEQ ID NO: 4601 - DNA, 20 bp, Artificial
  CRISPR gRNA sequence
gcacacagggtcccaggctg

SEQ ID NO: 4602 - DNA, 20 bp, Artificial
  CRISPR gRNA sequence
ggatggcccatgtgtggatg

SEQ ID NO: 4603 - DNA, 20 bp, Artificial
  CRISPR gRNA sequence
ccagtaacaaggcggggcac

SEQ ID NO: 4604 - DNA, 20 bp, Artificial
  CRISPR gRNA sequence
cagtaacaaggcggggcaca

SEQ ID NO: 4605 - DNA, 20 bp, Artificial
  CRISPR gRNA sequence
ctacctggggcttgaaactc

SEQ ID NO: 4606 - DNA, 20 bp, Artificial
  CRISPR gRNA sequence
tacctggggcttgaaactcc

SEQ ID NO: 4607 - DNA, 20 bp, Artificial
  CRISPR gRNA sequence
cctggggcttgaaactccca

SEQ ID NO: 4608 - DNA, 20 bp, Artificial
  CRISPR gRNA sequence
gggcttgaaactcccagtgg

SEQ ID NO: 4609 - DNA, 20 bp, Artificial
  CRISPR gRNA sequence
gaaactcccagtgggacaag

SEQ ID NO: 4610 - DNA, 20 bp, Artificial
  CRISPR gRNA sequence
aaactcccagtgggacaaga

SEQ ID NO: 4611 - DNA, 20 bp, Artificial
  CRISPR gRNA sequence
ccagtgggacaagaaaaccc

SEQ ID NO: 4612 - DNA, 20 bp, Artificial
  CRISPR gRNA sequence
ttcaccccttccctacctga

SEQ ID NO: 4613 - DNA, 20 bp, Artificial
  CRISPR gRNA sequence
caccccttccctacctgagc

SEQ ID NO: 4614 - DNA, 20 bp, Artificial
  CRISPR gRNA sequence
accccttccctacctgagct

SEQ ID NO: 4615 - DNA, 20 bp, Artificial
  CRISPR gRNA sequence
ccctacctgagctcttcctc

SEQ ID NO: 4616 - DNA, 20 bp, Artificial
  CRISPR gRNA sequence
cctacctgagctcttcctcc

SEQ ID NO: 4617 - DNA, 20 bp, Artificial
  CRISPR gRNA sequence
cctgagctcttcctcctaca

SEQ ID NO: 4618 - DNA, 20 bp, Artificial
  CRISPR gRNA sequence
agctcttcctcctacacatc

SEQ ID NO: 4619 - DNA, 20 bp, Artificial
  CRISPR gRNA sequence
ttcctcctacacatcatagc

SEQ ID NO: 4620 - DNA, 20 bp, Artificial
  CRISPR gRNA sequence
cctcctacacatcatagcgg

SEQ ID NO: 4621 - DNA, 20 bp, Artificial
  CRISPR gRNA sequence
ctcctacacatcatagcggt

SEQ ID NO: 4622 - DNA, 20 bp, Artificial
  CRISPR gRNA sequence
ctacacatcatagcggtgac

SEQ ID NO: 4623 - DNA, 20 bp, Artificial
  CRISPR gRNA sequence
cacatcatagcggtgaccac

SEQ ID NO: 4624 - DNA, 20 bp, Artificial
  CRISPR gRNA sequence
caaggacagctaggacaacc

SEQ ID NO: 4625 - DNA, 20 bp, Artificial
  CRISPR gRNA sequence
ggacaaccaggacagccagg

SEQ ID NO: 4626 - DNA, 20 bp, Artificial
  CRISPR gRNA sequence
ggaagatggctctgggaaag

SEQ ID NO: 4627 - DNA, 20 bp, Artificial
  CRISPR gRNA sequence
tgggaaaggaggagaaggtg

SEQ ID NO: 4628 - DNA, 20 bp, Artificial
  CRISPR gRNA sequence
ggaaaggaggagaaggtgag

SEQ ID NO: 4629 - DNA, 20 bp, Artificial
  CRISPR gRNA sequence
acccccaagcctcagccctg

SEQ ID NO: 4630 - DNA, 20 bp, Artificial
  CRISPR gRNA sequence
agccctgacccggctgaagg

SEQ ID NO: 4631 - DNA, 20 bp, Artificial
  CRISPR gRNA sequence
acccggctgaagggctccag

SEQ ID NO: 4632 - DNA, 20 bp, Artificial
  CRISPR gRNA sequence
aagggctccagaaggacttc

SEQ ID NO: 4633 - DNA, 20 bp, Artificial
  CRISPR gRNA sequence
cagaaggacttctgctttct

SEQ ID NO: 4634 - DNA, 20 bp, Artificial
  CRISPR gRNA sequence
ctgctttctctgataagaga

SEQ ID NO: 4635 - DNA, 20 bp, Artificial
  CRISPR gRNA sequence
tgctttctctgataagagat

SEQ ID NO: 4636 - DNA, 20 bp, Artificial
  CRISPR gRNA sequence
ctttctctgataagagatgt

SEQ ID NO: 4637 - DNA, 20 bp, Artificial
  CRISPR gRNA sequence
tctctgataagagatgtgac

SEQ ID NO: 4638 - DNA, 20 bp, Artificial
  CRISPR gRNA sequence
ctctgataagagatgtgacc

SEQ ID NO: 4639 - DNA, 20 bp, Artificial
  CRISPR gRNA sequence
tctgataagagatgtgaccc

SEQ ID NO: 4640 - DNA, 20 bp, Artificial
  CRISPR gRNA sequence
tgataagagatgtgaccccc

SEQ ID NO: 4641 - DNA, 20 bp, Artificial
  CRISPR gRNA sequence
ataagagatgtgacccccca

SEQ ID NO: 4642 - DNA, 20 bp, Artificial
  CRISPR gRNA sequence
ccctccttaccccagctcag

SEQ ID NO: 4643 - DNA, 20 bp, Artificial
  CRISPR gRNA sequence
cttaccccagctcagggtga

SEQ ID NO: 4644 - DNA, 20 bp, Artificial
  CRISPR gRNA sequence
accccagctcagggtgaggg

SEQ ID NO: 4645 - DNA, 20 bp, Artificial
  CRISPR gRNA sequence
ccccagctcagggtgagggg

SEQ ID NO: 4646 - DNA, 20 bp, Artificial
  CRISPR gRNA sequence
agggtgaggggctcttgcag

SEQ ID NO: 4647 - DNA, 20 bp, Artificial
  CRISPR gRNA sequence
ttgcagcccctcgtgctgca

SEQ ID NO: 4648 - DNA, 20 bp, Artificial
  CRISPR gRNA sequence
gcagcccctcgtgctgcata

SEQ ID NO: 4649 - DNA, 20 bp, Artificial
  CRISPR gRNA sequence
cagcccctcgtgctgcatat

SEQ ID NO: 4650 - DNA, 20 bp, Artificial
  CRISPR gRNA sequence
gtgctgcatatggcacgtgt

SEQ ID NO: 4651 - DNA, 20 bp, Artificial
  CRISPR gRNA sequence
catatggcacgtgtatctct

SEQ ID NO: 4652 - DNA, 20 bp, Artificial
  CRISPR gRNA sequence
tgctcttgtccagaaggcac

SEQ ID NO: 4653 - DNA, 20 bp, Artificial
  CRISPR gRNA sequence
ctcttgtccagaaggcacca

SEQ ID NO: 4654 - DNA, 20 bp, Artificial
  CRISPR gRNA sequence
ttgtccagaaggcaccacca

SEQ ID NO: 4655 - DNA, 20 bp, Artificial
  CRISPR gRNA sequence
gtccagaaggcaccaccaca

SEQ ID NO: 4656 - DNA, 20 bp, Artificial
  CRISPR gRNA sequence
tccagaaggcaccaccacag

SEQ ID NO: 4657 - DNA, 20 bp, Artificial
  CRISPR gRNA sequence
cccacttctggaaggttcca

SEQ ID NO: 4658 - DNA, 20 bp, Artificial
  CRISPR gRNA sequence
ctggaaggttccatctcctg

SEQ ID NO: 4659 - DNA, 20 bp, Artificial
  CRISPR gRNA sequence
tggaaggttccatctcctgc

SEQ ID NO: 4660 - DNA, 20 bp, Artificial
  CRISPR gRNA sequence
gaaggttccatctcctgctg

SEQ ID NO: 4661 - DNA, 20 bp, Artificial
  CRISPR gRNA sequence
catctcctgctggcctggtc

SEQ ID NO: 4662 - DNA, 20 bp, Artificial
  CRISPR gRNA sequence
ctgctggcctggtctccaca

SEQ ID NO: 4663 - DNA, 20 bp, Artificial
  CRISPR gRNA sequence
ctggcctggtctccacaagc

SEQ ID NO: 4664 - DNA, 20 bp, Artificial
  CRISPR gRNA sequence
gcctggtctccacaagctcg

SEQ ID NO: 4665 - DNA, 20 bp, Artificial
  CRISPR gRNA sequence
gtctccacaagctcggtgtc

SEQ ID NO: 4666 - DNA, 20 bp, Artificial
  CRISPR gRNA sequence
cacaagctcggtgtcctggg

SEQ ID NO: 4667 - DNA, 20 bp, Artificial
  CRISPR gRNA sequence
ggtgtcctgggtctggtcct

SEQ ID NO: 4668 - DNA, 20 bp, Artificial
  CRISPR gRNA sequence
ggtctggtcctccccatccc

SEQ ID NO: 4669 - DNA, 20 bp, Artificial
  CRISPR gRNA sequence
gtcctccccatcccgctgcc

SEQ ID NO: 4670 - DNA, 20 bp, Artificial
  CRISPR gRNA sequence
cccatcccgctgccaggtca

SEQ ID NO: 4671 - DNA, 20 bp, Artificial
  CRISPR gRNA sequence
ccaggtcagtgtgatctccg

SEQ ID NO: 4672 - DNA, 20 bp, Artificial
  CRISPR gRNA sequence
cgcagggtagaagcccaggg

SEQ ID NO: 4673 - DNA, 20 bp, Artificial
  CRISPR gRNA sequence
agggtggcctcatggtcaga

SEQ ID NO: 4674 - DNA, 20 bp, Artificial
  CRISPR gRNA sequence
atggtcagagagggggtggt

SEQ ID NO: 4675 - DNA, 20 bp, Artificial
  CRISPR gRNA sequence
tgggggttctgacgggaaga

SEQ ID NO: 4676 - DNA, 20 bp, Artificial
  CRISPR gRNA sequence
gggggttctgacgggaagag

SEQ ID NO: 4677 - DNA, 20 bp, Artificial
  CRISPR gRNA sequence
ggggttctgacgggaagagt

SEQ ID NO: 4678 - DNA, 20 bp, Artificial
  CRISPR gRNA sequence
tgacgggaagagtcagaaaa

SEQ ID NO: 4679 - DNA, 20 bp, Artificial
  CRISPR gRNA sequence
acgggaagagtcagaaaatt

SEQ ID NO: 4680 - DNA, 20 bp, Artificial
  CRISPR gRNA sequence
agacactttgcatctctctt

SEQ ID NO: 4681 - DNA, 20 bp, Artificial
  CRISPR gRNA sequence
tgcatctctcttgggacact

SEQ ID NO: 4682 - DNA, 20 bp, Artificial
  CRISPR gRNA sequence
gcatctctcttgggacactc

SEQ ID NO: 4683 - DNA, 20 bp, Artificial
  CRISPR gRNA sequence
catctctcttgggacactcc

SEQ ID NO: 4684 - DNA, 20 bp, Artificial
  CRISPR gRNA sequence
tcttgggacactccagcagc

SEQ ID NO: 4685 - DNA, 20 bp, Artificial
  CRISPR gRNA sequence
ttgggacactccagcagcgc

SEQ ID NO: 4686 - DNA, 20 bp, Artificial
  CRISPR gRNA sequence
gggacactccagcagcgccc

SEQ ID NO: 4687 - DNA, 20 bp, Artificial
  CRISPR gRNA sequence
ggacactccagcagcgccca

SEQ ID NO: 4688 - DNA, 20 bp, Artificial
  CRISPR gRNA sequence
cagcagcgcccatgtgacca

SEQ ID NO: 4689 - DNA, 20 bp, Artificial
  CRISPR gRNA sequence
agaatggacaggacacctgg

SEQ ID NO: 4690 - DNA, 20 bp, Artificial
  CRISPR gRNA sequence
gggtggggaaggcggcacag

SEQ ID NO: 4691 - DNA, 20 bp, Artificial
  CRISPR gRNA sequence
gacacaggcacctgggataa

SEQ ID NO: 4692 - DNA, 20 bp, Artificial
  CRISPR gRNA sequence
ggataatctcctattcattg

SEQ ID NO: 4693 - DNA, 20 bp, Artificial
  CRISPR gRNA sequence
ctattcattggaaagttcta

SEQ ID NO: 4694 - DNA, 20 bp, Artificial
  CRISPR gRNA sequence
ttcattggaaagttctagtc

SEQ ID NO: 4695 - DNA, 20 bp, Artificial
  CRISPR gRNA sequence
attggaaagttctagtctct

SEQ ID NO: 4696 - DNA, 20 bp, Artificial
  CRISPR gRNA sequence
gaaagttctagtctctgagg

SEQ ID NO: 4697 - DNA, 20 bp, Artificial
  CRISPR gRNA sequence
tagtctctgagggaggaaca

SEQ ID NO: 4698 - DNA, 20 bp, Artificial
  CRISPR gRNA sequence
gtctctgagggaggaacagc

SEQ ID NO: 4699 - DNA, 20 bp, Artificial
  CRISPR gRNA sequence
tgagggaggaacagcgactt

SEQ ID NO: 4700 - DNA, 20 bp, Artificial
  CRISPR gRNA sequence
agggaggaacagcgacttct

SEQ ID NO: 4701 - DNA, 20 bp, Artificial
  CRISPR gRNA sequence
ctggtcctgacctgagtgga

SEQ ID NO: 4702 - DNA, 20 bp, Artificial
  CRISPR gRNA sequence
tggtcctgacctgagtggag

SEQ ID NO: 4703 - DNA, 20 bp, Artificial
  CRISPR gRNA sequence
gtcctgacctgagtggaggc

SEQ ID NO: 4704 - DNA, 20 bp, Artificial
  CRISPR gRNA sequence
acctgagtggaggctgcagg

SEQ ID NO: 4705 - DNA, 20 bp, Artificial
  CRISPR gRNA sequence
agtggaggctgcaggactca

SEQ ID NO: 4706 - DNA, 20 bp, Artificial
  CRISPR gRNA sequence
caggactcagaaaagctgga

SEQ ID NO: 4707 - DNA, 20 bp, Artificial
  CRISPR gRNA sequence
agaaaagctggaatcaaacc

SEQ ID NO: 4708 - DNA, 20 bp, Artificial
  CRISPR gRNA sequence
gaatcaaaccttcagacaca

SEQ ID NO: 4709 - DNA, 20 bp, Artificial
  CRISPR gRNA sequence
cagacacattgagtgtgagg

SEQ ID NO: 4710 - DNA, 20 bp, Artificial
  CRISPR gRNA sequence
agacacattgagtgtgaggc

SEQ ID NO: 4711 - DNA, 20 bp, Artificial
  CRISPR gRNA sequence
agtgtgaggcagagaacaag

SEQ ID NO: 4712 - DNA, 20 bp, Artificial
  CRISPR gRNA sequence
agagaaaggtcagcagcctg

SEQ ID NO: 4713 - DNA, 20 bp, Artificial
  CRISPR gRNA sequence
accacagctgctgcagtggt

SEQ ID NO: 4714 - DNA, 20 bp, Artificial
  CRISPR gRNA sequence
ctgcagtggtcaaagtggtc

SEQ ID NO: 4715 - DNA, 20 bp, Artificial
  CRISPR gRNA sequence
cagtggtcaaagtggtcaaa

SEQ ID NO: 4716 - DNA, 20 bp, Artificial
  CRISPR gRNA sequence
atcagtattccagggactgt

SEQ ID NO: 4717 - DNA, 20 bp, Artificial
  CRISPR gRNA sequence
cagggactgtcttcccctcc

SEQ ID NO: 4718 - DNA, 20 bp, Artificial
  CRISPR gRNA sequence
tcttcccctccatttcctca

SEQ ID NO: 4719 - DNA, 20 bp, Artificial
  CRISPR gRNA sequence
cccctccatttcctcagaga

SEQ ID NO: 4720 - DNA, 20 bp, Artificial
  CRISPR gRNA sequence
ccctccatttcctcagagac

SEQ ID NO: 4721 - DNA, 20 bp, Artificial
  CRISPR gRNA sequence
catttcctcagagacttcat

SEQ ID NO: 4722 - DNA, 20 bp, Artificial
  CRISPR gRNA sequence
cctcagagacttcatccctt

SEQ ID NO: 4723 - DNA, 20 bp, Artificial
  CRISPR gRNA sequence
ctcagagacttcatccctta

SEQ ID NO: 4724 - DNA, 20 bp, Artificial
  CRISPR gRNA sequence
agagacttcatcccttaatt

SEQ ID NO: 4725 - DNA, 20 bp, Artificial
  CRISPR gRNA sequence
catcccttaattgtcctaga

SEQ ID NO: 4726 - DNA, 20 bp, Artificial
  CRISPR gRNA sequence
atcccttaattgtcctagag

SEQ ID NO: 4727 - DNA, 20 bp, Artificial
  CRISPR gRNA sequence
aattgtcctagagagcagag

SEQ ID NO: 4728 - DNA, 20 bp, Artificial
  CRISPR gRNA sequence
attgtcctagagagcagagg

SEQ ID NO: 4729 - DNA, 20 bp, Artificial
  CRISPR gRNA sequence
tcctagagagcagagggggc

SEQ ID NO: 4730 - DNA, 20 bp, Artificial
  CRISPR gRNA sequence
gagagcagagggggccctca

SEQ ID NO: 4731 - DNA, 20 bp, Artificial
  CRISPR gRNA sequence
agaggaaactcaggaaaact

SEQ ID NO: 4732 - DNA, 20 bp, Artificial
  CRISPR gRNA sequence
aggaaaactcatgccattct

SEQ ID NO: 4733 - DNA, 20 bp, Artificial
  CRISPR gRNA sequence
atgccattctccattcaagg

SEQ ID NO: 4734 - DNA, 20 bp, Artificial
  CRISPR gRNA sequence
tccattcaagggagggcgat

SEQ ID NO: 4735 - DNA, 20 bp, Artificial
  CRISPR gRNA sequence
cattcaagggagggcgatat

SEQ ID NO: 4736 - DNA, 20 bp, Artificial
  CRISPR gRNA sequence
aagggagggcgatattccag

SEQ ID NO: 4737 - DNA, 20 bp, Artificial
  CRISPR gRNA sequence
cagtgctgatcccattttcc

SEQ ID NO: 4738 - DNA, 20 bp, Artificial
  CRISPR gRNA sequence
atcccattttcctcccctcc

SEQ ID NO: 4739 - DNA, 20 bp, Artificial
  CRISPR gRNA sequence
tcctcccctcctcgtgggag

SEQ ID NO: 4740 - DNA, 20 bp, Artificial
  CRISPR gRNA sequence
cctcccctcctcgtgggagg

SEQ ID NO: 4741 - DNA, 20 bp, Artificial
  CRISPR gRNA sequence
ctcccctcctcgtgggaggc

SEQ ID NO: 4742 - DNA, 20 bp, Artificial
  CRISPR gRNA sequence
ccctcctcgtgggaggccat

SEQ ID NO: 4743 - DNA, 20 bp, Artificial
  CRISPR gRNA sequence
ctcgtgggaggccatcccgg

SEQ ID NO: 4744 - DNA, 20 bp, Artificial
  CRISPR gRNA sequence
gtgggaggccatcccgggag

SEQ ID NO: 4745 - DNA, 20 bp, Artificial
  CRISPR gRNA sequence
taggagatggggaaggctcc

SEQ ID NO: 4746 - DNA, 20 bp, Artificial
  CRISPR gRNA sequence
cccactgcccctggtacctg

SEQ ID NO: 4747 - DNA, 20 bp, Artificial
  CRISPR gRNA sequence
cccctggtacctgcgcgctg

SEQ ID NO: 4748 - DNA, 20 bp, Artificial
  CRISPR gRNA sequence
gtacctgcgcgctgcagcgt

SEQ ID NO: 4749 - DNA, 20 bp, Artificial
  CRISPR gRNA sequence
cgcgctgcagcgtctccttc

SEQ ID NO: 4750 - DNA, 20 bp, Artificial
  CRISPR gRNA sequence
cagcgtctccttcccgttct

SEQ ID NO: 4751 - DNA, 20 bp, Artificial
  CRISPR gRNA sequence
cttcccgttctccaggtatc

SEQ ID NO: 4752 - DNA, 20 bp, Artificial
  CRISPR gRNA sequence
cccgttctccaggtatctgc

SEQ ID NO: 4753 - DNA, 20 bp, Artificial
  CRISPR gRNA sequence
ccgttctccaggtatctgcg

SEQ ID NO: 4754 - DNA, 20 bp, Artificial
  CRISPR gRNA sequence
tccaggtatctgcggagcca

SEQ ID NO: 4755 - DNA, 20 bp, Artificial
  CRISPR gRNA sequence
caggtatctgcggagccact

SEQ ID NO: 4756 - DNA, 20 bp, Artificial
  CRISPR gRNA sequence
cggagccactccacgcacgt

SEQ ID NO: 4757 - DNA, 20 bp, Artificial
  CRISPR gRNA sequence
cacgcacgtgccctccaggt

SEQ ID NO: 4758 - DNA, 20 bp, Artificial
  CRISPR gRNA sequence
caggtaggctctcagctgct

SEQ ID NO: 4759 - DNA, 20 bp, Artificial
  CRISPR gRNA sequence
tcagctgctccgccgcacgg

SEQ ID NO: 4760 - DNA, 20 bp, Artificial
  CRISPR gRNA sequence
agctgctccgccgcacgggc

SEQ ID NO: 4761 - DNA, 20 bp, Artificial
  CRISPR gRNA sequence
ctccgccgcacgggccgcct

SEQ ID NO: 4762 - DNA, 20 bp, Artificial
  CRISPR gRNA sequence
cgccgcacgggccgcctcca

SEQ ID NO: 4763 - DNA, 20 bp, Artificial
  CRISPR gRNA sequence
caacttgcgctgggtgatct

SEQ ID NO: 4764 - DNA, 20 bp, Artificial
  CRISPR gRNA sequence
gcgctgggtgatctgagccg

SEQ ID NO: 4765 - DNA, 20 bp, Artificial
  CRISPR gRNA sequence
cgctgggtgatctgagccgc

SEQ ID NO: 4766 - DNA, 20 bp, Artificial
  CRISPR gRNA sequence
ggtgatctgagccgcggtgt

SEQ ID NO: 4767 - DNA, 20 bp, Artificial
  CRISPR gRNA sequence
agccgcggtgtccgcggcgg

SEQ ID NO: 4768 - DNA, 20 bp, Artificial
  CRISPR gRNA sequence
gttcagggcgatgtaatcct

SEQ ID NO: 4769 - DNA, 20 bp, Artificial
  CRISPR gRNA sequence
agggcgatgtaatccttgcc

SEQ ID NO: 4770 - DNA, 20 bp, Artificial
  CRISPR gRNA sequence
gccgtcgtaggcggactggt

SEQ ID NO: 4771 - DNA, 20 bp, Artificial
  CRISPR gRNA sequence
ccgtcgtaggcggactggtc

SEQ ID NO: 4772 - DNA, 20 bp, Artificial
  CRISPR gRNA sequence
gtcatacccgcggaggaggc

SEQ ID NO: 4773 - DNA, 20 bp, Artificial
  CRISPR gRNA sequence
tggagggtgtgagaccctgg

SEQ ID NO: 4774 - DNA, 20 bp, Artificial
  CRISPR gRNA sequence
gagggtgtgagaccctggcc

SEQ ID NO: 4775 - DNA, 20 bp, Artificial
  CRISPR gRNA sequence
gccccgcccccgcggtcagc

SEQ ID NO: 4776 - DNA, 20 bp, Artificial
  CRISPR gRNA sequence
tggcctaaaccgaaaatgaa

SEQ ID NO: 4777 - DNA, 20 bp, Artificial
  CRISPR gRNA sequence
ggcctaaaccgaaaatgaaa

SEQ ID NO: 4778 - DNA, 20 bp, Artificial
  CRISPR gRNA sequence
gcctaaaccgaaaatgaaac

SEQ ID NO: 4779 - DNA, 20 bp, Artificial
  CRISPR gRNA sequence
aaccgaaaatgaaaccgggt

SEQ ID NO: 4780 - DNA, 20 bp, Artificial
  CRISPR gRNA sequence
gggctctctccggtcgaggg

SEQ ID NO: 4781 - DNA, 20 bp, Artificial
  CRISPR gRNA sequence
tctccggtcgagggtctggg

SEQ ID NO: 4782 - DNA, 20 bp, Artificial
  CRISPR gRNA sequence
tccggtcgagggtctgggcg

SEQ ID NO: 4783 - DNA, 20 bp, Artificial
  CRISPR gRNA sequence
cggtcgagggtctgggcggg

SEQ ID NO: 4784 - DNA, 20 bp, Artificial
  CRISPR gRNA sequence
ggcgggttccgcagatccac

SEQ ID NO: 4785 - DNA, 20 bp, Artificial
  CRISPR gRNA sequence
cgcagatccaccttggggtg

SEQ ID NO: 4786 - DNA, 20 bp, Artificial
  CRISPR gRNA sequence
ggggtggatctcagacgggg

SEQ ID NO: 4787 - DNA, 20 bp, Artificial
  CRISPR gRNA sequence
gggtggatctcagacgggga

SEQ ID NO: 4788 - DNA, 20 bp, Artificial
  CRISPR gRNA sequence
agacggggagactcggggcg

SEQ ID NO: 4789 - DNA, 20 bp, Artificial
  CRISPR gRNA sequence
ggggcgacccgggccgtccg

SEQ ID NO: 4790 - DNA, 20 bp, Artificial
  CRISPR gRNA sequence
cgccccgggccggggtcact

SEQ ID NO: 4791 - DNA, 20 bp, Artificial
  CRISPR gRNA sequence
accgtcctcgctctggttgt

SEQ ID NO: 4792 - DNA, 20 bp, Artificial
  CRISPR gRNA sequence
gctctggttgtagtagccgc

SEQ ID NO: 4793 - DNA, 20 bp, Artificial
  CRISPR gRNA sequence
tggttgtagtagccgcgcag

SEQ ID NO: 4794 - DNA, 20 bp, Artificial
  CRISPR gRNA sequence
gttgtagtagccgcgcaggt

SEQ ID NO: 4795 - DNA, 20 bp, Artificial
  CRISPR gRNA sequence
tagtagccgcgcaggttccg

SEQ ID NO: 4796 - DNA, 20 bp, Artificial
  CRISPR gRNA sequence
cgcaggctcactcggtcagc

SEQ ID NO: 4797 - DNA, 20 bp, Artificial
  CRISPR gRNA sequence
actcggtcagcctgtgcctg

SEQ ID NO: 4798 - DNA, 20 bp, Artificial
  CRISPR gRNA sequence
ggtcagcctgtgcctggcgc

SEQ ID NO: 4799 - DNA, 20 bp, Artificial
  CRISPR gRNA sequence
tgcctggcgcttgtagttct

SEQ ID NO: 4800 - DNA, 20 bp, Artificial
  CRISPR gRNA sequence
gcgcttgtagttctgtgtct

SEQ ID NO: 4801 - DNA, 20 bp, Artificial
  CRISPR gRNA sequence
gtagttctgtgtctcccggt

SEQ ID NO: 4802 - DNA, 20 bp, Artificial
  CRISPR gRNA sequence
tagttctgtgtctcccggtc

SEQ ID NO: 4803 - DNA, 20 bp, Artificial
  CRISPR gRNA sequence
tgtgtctcccggtcccaata

SEQ ID NO: 4804 - DNA, 20 bp, Artificial
  CRISPR gRNA sequence
tgtctcccggtcccaatact

SEQ ID NO: 4805 - DNA, 20 bp, Artificial
  CRISPR gRNA sequence
ccggtcccaatactccggcc

SEQ ID NO: 4806 - DNA, 20 bp, Artificial
  CRISPR gRNA sequence
cggcccctcctgctccaccc

SEQ ID NO: 4807 - DNA, 20 bp, Artificial
  CRISPR gRNA sequence
ctgctccacccacggcgccc

SEQ ID NO: 4808 - DNA, 20 bp, Artificial
  CRISPR gRNA sequence
ctccacccacggcgcccgcg

SEQ ID NO: 4809 - DNA, 20 bp, Artificial
  CRISPR gRNA sequence
cacccacggcgcccgcggct

SEQ ID NO: 4810 - DNA, 20 bp, Artificial
  CRISPR gRNA sequence
ccctctcggactcgcggcgt

SEQ ID NO: 4811 - DNA, 20 bp, Artificial
  CRISPR gRNA sequence
tcggactcgcggcgtcgctg

SEQ ID NO: 4812 - DNA, 20 bp, Artificial
  CRISPR gRNA sequence
ggactcgcggcgtcgctgtc

SEQ ID NO: 4813 - DNA, 20 bp, Artificial
  CRISPR gRNA sequence
gcggcgtcgctgtcgaaccg

SEQ ID NO: 4814 - DNA, 20 bp, Artificial
  CRISPR gRNA sequence
tcgaaccgcacgaactgcgt

SEQ ID NO: 4815 - DNA, 20 bp, Artificial
  CRISPR gRNA sequence
cgtgtcgtccacgtagccca

SEQ ID NO: 4816 - DNA, 20 bp, Artificial
  CRISPR gRNA sequence
agatgaagcggggctctccg

SEQ ID NO: 4817 - DNA, 20 bp, Artificial
  CRISPR gRNA sequence
tccgcggccgggccgggaca

SEQ ID NO: 4818 - DNA, 20 bp, Artificial
  CRISPR gRNA sequence
cgcggccgggccgggacacg

SEQ ID NO: 4819 - DNA, 20 bp, Artificial
  CRISPR gRNA sequence
atggagtgggagcctggggg

SEQ ID NO: 4820 - DNA, 20 bp, Artificial
  CRISPR gRNA sequence
ggggcgaggaggggctgaga

SEQ ID NO: 4821 - DNA, 20 bp, Artificial
  CRISPR gRNA sequence
agacccgcccgacccacctc

SEQ ID NO: 4822 - DNA, 20 bp, Artificial
  CRISPR gRNA sequence
cctgcgcggctccccgggtc

SEQ ID NO: 4823 - DNA, 20 bp, Artificial
  CRISPR gRNA sequence
cgcggctccccgggtcctgc

SEQ ID NO: 4824 - DNA, 20 bp, Artificial
  CRISPR gRNA sequence
cccgggtcctgcgccctcgc

SEQ ID NO: 4825 - DNA, 20 bp, Artificial
  CRISPR gRNA sequence
cgccctcgccgggcgggccc

SEQ ID NO: 4826 - DNA, 20 bp, Artificial
  CRISPR gRNA sequence
gccgggcgggcccctcgctc

SEQ ID NO: 4827 - DNA, 20 bp, Artificial
  CRISPR gRNA sequence
gctcctctccgcagaggccg

SEQ ID NO: 4828 - DNA, 20 bp, Artificial
  CRISPR gRNA sequence
ctctccgcagaggccgcttc

SEQ ID NO: 4829 - DNA, 20 bp, Artificial
  CRISPR gRNA sequence
tccgcagaggccgcttccct

SEQ ID NO: 4830 - DNA, 20 bp, Artificial
  CRISPR gRNA sequence
cgcagaggccgcttccctcc

SEQ ID NO: 4831 - DNA, 20 bp, Artificial
  CRISPR gRNA sequence
ccctcccaaccccgcactca

SEQ ID NO: 4832 - DNA, 20 bp, Artificial
  CRISPR gRNA sequence
cctcccaaccccgcactcac

SEQ ID NO: 4833 - DNA, 20 bp, Artificial
  CRISPR gRNA sequence
ccaaccccgcactcacaggc

SEQ ID NO: 4834 - DNA, 20 bp, Artificial
  CRISPR gRNA sequence
acaggcccaggtctcggtca

SEQ ID NO: 4835 - DNA, 20 bp, Artificial
  CRISPR gRNA sequence
ggtcagggccaggcctcccg

SEQ ID NO: 4836 - DNA, 20 bp, Artificial
  CRISPR gRNA sequence
ccgagagcagcaggaggagg

SEQ ID NO: 4837 - DNA, 20 bp, Artificial
  CRISPR gRNA sequence
ggggcgccatgacccgcatc

SEQ ID NO: 4838 - DNA, 20 bp, Artificial
  CRISPR gRNA sequence
ggcctctggggagaatgtga

SEQ ID NO: 4839 - DNA, 20 bp, Artificial
  CRISPR gRNA sequence
tggggagaatgtgagtccgg

SEQ ID NO: 4840 - DNA, 20 bp, Artificial
  CRISPR gRNA sequence
gggagaatgtgagtccgggt

SEQ ID NO: 4841 - DNA, 20 bp, Artificial
  CRISPR gRNA sequence
gggactttagaaccgggact

SEQ ID NO: 4842 - DNA, 20 bp, Artificial
  CRISPR gRNA sequence
tagaaccgggactgcggaga

SEQ ID NO: 4843 - DNA, 20 bp, Artificial
  CRISPR gRNA sequence
agaaccgggactgcggagac

SEQ ID NO: 4844 - DNA, 20 bp, Artificial
  CRISPR gRNA sequence
gaaccgggactgcggagacg

SEQ ID NO: 4845 - DNA, 20 bp, Artificial
  CRISPR gRNA sequence
cggagacgctgattggcttc

SEQ ID NO: 4846 - DNA, 20 bp, Artificial
  CRISPR gRNA sequence
attggcttctctagaacccg

SEQ ID NO: 4847 - DNA, 20 bp, Artificial
  CRISPR gRNA sequence
gcttctctagaacccgacac

SEQ ID NO: 4848 - DNA, 20 bp, Artificial
  CRISPR gRNA sequence
ctctagaacccgacacccaa

SEQ ID NO: 4849 - DNA, 20 bp, Artificial
  CRISPR gRNA sequence
ggtgtcgggttctagagaag

SEQ ID NO: 4850 - DNA, 20 bp, Artificial
  CRISPR gRNA sequence
tagagaagccaatcagcgtc

SEQ ID NO: 4851 - DNA, 20 bp, Artificial
  CRISPR gRNA sequence
gagaagccaatcagcgtctc

SEQ ID NO: 4852 - DNA, 20 bp, Artificial
  CRISPR gRNA sequence
cgcagtcccggttctaaagt

SEQ ID NO: 4853 - DNA, 20 bp, Artificial
  CRISPR gRNA sequence
taaagtccccagtcacccac

SEQ ID NO: 4854 - DNA, 20 bp, Artificial
  CRISPR gRNA sequence
aagtccccagtcacccaccc

SEQ ID NO: 4855 - DNA, 20 bp, Artificial
  CRISPR gRNA sequence
acattctccccagaggccga

SEQ ID NO: 4856 - DNA, 20 bp, Artificial
  CRISPR gRNA sequence
tccccagaggccgagatgcg

SEQ ID NO: 4857 - DNA, 20 bp, Artificial
  CRISPR gRNA sequence
cccagaggccgagatgcggg

SEQ ID NO: 4858 - DNA, 20 bp, Artificial
  CRISPR gRNA sequence
ctcctgctgctctcgggagg

SEQ ID NO: 4859 - DNA, 20 bp, Artificial
  CRISPR gRNA sequence
ctgctgctctcgggaggcct

SEQ ID NO: 4860 - DNA, 20 bp, Artificial
  CRISPR gRNA sequence
ctgctctcgggaggcctggc

SEQ ID NO: 4861 - DNA, 20 bp, Artificial
  CRISPR gRNA sequence
ctctcgggaggcctggccct

SEQ ID NO: 4862 - DNA, 20 bp, Artificial
  CRISPR gRNA sequence
tcgggaggcctggccctgac

SEQ ID NO: 4863 - DNA, 20 bp, Artificial
  CRISPR gRNA sequence
gggaggcctggccctgaccg

SEQ ID NO: 4864 - DNA, 20 bp, Artificial
  CRISPR gRNA sequence
gccctgaccgagacctgggc

SEQ ID NO: 4865 - DNA, 20 bp, Artificial
  CRISPR gRNA sequence
accgagacctgggcctgtga

SEQ ID NO: 4866 - DNA, 20 bp, Artificial
  CRISPR gRNA sequence
ggcctgtgagtgcggggttg

SEQ ID NO: 4867 - DNA, 20 bp, Artificial
  CRISPR gRNA sequence
tgagtgcggggttgggaggg

SEQ ID NO: 4868 - DNA, 20 bp, Artificial
  CRISPR gRNA sequence
ggagggaagcggcctctgcg

SEQ ID NO: 4869 - DNA, 20 bp, Artificial
  CRISPR gRNA sequence
tgcggagaggagcgaggggc

SEQ ID NO: 4870 - DNA, 20 bp, Artificial
  CRISPR gRNA sequence
cggagaggagcgaggggccc

SEQ ID NO: 4871 - DNA, 20 bp, Artificial
  CRISPR gRNA sequence
agcccctcctcgcccccagg

SEQ ID NO: 4872 - DNA, 20 bp, Artificial
  CRISPR gRNA sequence
ctcgcccccaggctcccact

SEQ ID NO: 4873 - DNA, 20 bp, Artificial
  CRISPR gRNA sequence
gcccccaggctcccactcca

SEQ ID NO: 4874 - DNA, 20 bp, Artificial
  CRISPR gRNA sequence
ccactccatgaggtatttcg

SEQ ID NO: 4875 - DNA, 20 bp, Artificial
  CRISPR gRNA sequence
catgaggtatttcgacaccg

SEQ ID NO: 4876 - DNA, 20 bp, Artificial
  CRISPR gRNA sequence
cgacaccgccgtgtcccggc

SEQ ID NO: 4877 - DNA, 20 bp, Artificial
  CRISPR gRNA sequence
gacaccgccgtgtcccggcc

SEQ ID NO: 4878 - DNA, 20 bp, Artificial
  CRISPR gRNA sequence
catctcagtgggctacgtgg

SEQ ID NO: 4879 - DNA, 20 bp, Artificial
  CRISPR gRNA sequence
atctcagtgggctacgtgga

SEQ ID NO: 4880 - DNA, 20 bp, Artificial
  CRISPR gRNA sequence
agtgggctacgtggacgaca

SEQ ID NO: 4881 - DNA, 20 bp, Artificial
  CRISPR gRNA sequence
cgtggacgacacgcagttcg

SEQ ID NO: 4882 - DNA, 20 bp, Artificial
  CRISPR gRNA sequence
gtgcggttcgacagcgacgc

SEQ ID NO: 4883 - DNA, 20 bp, Artificial
  CRISPR gRNA sequence
gacagcgacgccgcgagtcc

SEQ ID NO: 4884 - DNA, 20 bp, Artificial
  CRISPR gRNA sequence
ggaccgggagacacagaact

SEQ ID NO: 4885 - DNA, 20 bp, Artificial
  CRISPR gRNA sequence
caagcgccaggcacaggctg

SEQ ID NO: 4886 - DNA, 20 bp, Artificial
  CRISPR gRNA sequence
accgagtgagcctgcggaac

SEQ ID NO: 4887 - DNA, 20 bp, Artificial
  CRISPR gRNA sequence
cggaacctgcgcggctacta

SEQ ID NO: 4888 - DNA, 20 bp, Artificial
  CRISPR gRNA sequence
cgcggctactacaaccagag

SEQ ID NO: 4889 - DNA, 20 bp, Artificial
  CRISPR gRNA sequence
ctacaaccagagcgaggacg

SEQ ID NO: 4890 - DNA, 20 bp, Artificial
  CRISPR gRNA sequence
caaccagagcgaggacggtg

SEQ ID NO: 4891 - DNA, 20 bp, Artificial
  CRISPR gRNA sequence
cccatcccccacggacggcc

SEQ ID NO: 4892 - DNA, 20 bp, Artificial
  CRISPR gRNA sequence
cccgtctgagatccacccca

SEQ ID NO: 4893 - DNA, 20 bp, Artificial
  CRISPR gRNA sequence
agatccaccccaaggtggat

SEQ ID NO: 4894 - DNA, 20 bp, Artificial
  CRISPR gRNA sequence
cggaacccgcccagaccctc

SEQ ID NO: 4895 - DNA, 20 bp, Artificial
  CRISPR gRNA sequence
gaccggagagagccccagtc

SEQ ID NO: 4896 - DNA, 20 bp, Artificial
  CRISPR gRNA sequence
tacccggtttcattttcggt

SEQ ID NO: 4897 - DNA, 20 bp, Artificial
  CRISPR gRNA sequence
acccggtttcattttcggtt

SEQ ID NO: 4898 - DNA, 20 bp, Artificial
  CRISPR gRNA sequence
cccggtttcattttcggttt

SEQ ID NO: 4899 - DNA, 20 bp, Artificial
  CRISPR gRNA sequence
cattttcggtttaggccaaa

SEQ ID NO: 4900 - DNA, 20 bp, Artificial
  CRISPR gRNA sequence
attttcggtttaggccaaaa

SEQ ID NO: 4901 - DNA, 20 bp, Artificial
  CRISPR gRNA sequence
tcggtttaggccaaaatccc

SEQ ID NO: 4902 - DNA, 20 bp, Artificial
  CRISPR gRNA sequence
cggtttaggccaaaatcccc

SEQ ID NO: 4903 - DNA, 20 bp, Artificial
  CRISPR gRNA sequence
ggtttaggccaaaatccccg

SEQ ID NO: 4904 - DNA, 20 bp, Artificial
  CRISPR gRNA sequence
aggccaaaatccccgcgggt

SEQ ID NO: 4905 - DNA, 20 bp, Artificial
  CRISPR gRNA sequence
ggccaaaatccccgcgggtt

SEQ ID NO: 4906 - DNA, 20 bp, Artificial
  CRISPR gRNA sequence
gtcggggcggggcggggctc

SEQ ID NO: 4907 - DNA, 20 bp, Artificial
  CRISPR gRNA sequence
gggggactgggctgaccgcg

SEQ ID NO: 4908 - DNA, 20 bp, Artificial
  CRISPR gRNA sequence
ggctgaccgcgggggcgggg

SEQ ID NO: 4909 - DNA, 20 bp, Artificial
  CRISPR gRNA sequence
accgcgggggcggggccagg

SEQ ID NO: 4910 - DNA, 20 bp, Artificial
  CRISPR gRNA sequence
acaccctccagaggatgtat

SEQ ID NO: 4911 - DNA, 20 bp, Artificial
  CRISPR gRNA sequence
cagaggatgtatggctgcga

SEQ ID NO: 4912 - DNA, 20 bp, Artificial
  CRISPR gRNA sequence
cgacctggggcccgacgggc

SEQ ID NO: 4913 - DNA, 20 bp, Artificial
  CRISPR gRNA sequence
gggcccgacgggcgcctcct

SEQ ID NO: 4914 - DNA, 20 bp, Artificial
  CRISPR gRNA sequence
ctccgcgggtatgaccagtc

SEQ ID NO: 4915 - DNA, 20 bp, Artificial
  CRISPR gRNA sequence
cgcgggtatgaccagtccgc

SEQ ID NO: 4916 - DNA, 20 bp, Artificial
  CRISPR gRNA sequence
cgacggcaaggattacatcg

SEQ ID NO: 4917 - DNA, 20 bp, Artificial
  CRISPR gRNA sequence
catcgccctgaacgaggacc

SEQ ID NO: 4918 - DNA, 20 bp, Artificial
  CRISPR gRNA sequence
aacgaggacctgcgctcctg

SEQ ID NO: 4919 - DNA, 20 bp, Artificial
  CRISPR gRNA sequence
cgctcctggaccgccgcgga

SEQ ID NO: 4920 - DNA, 20 bp, Artificial
  CRISPR gRNA sequence
ctggaccgccgcggacaccg

SEQ ID NO: 4921 - DNA, 20 bp, Artificial
  CRISPR gRNA sequence
gaccgccgcggacaccgcgg

SEQ ID NO: 4922 - DNA, 20 bp, Artificial
  CRISPR gRNA sequence
agatcacccagcgcaagttg

SEQ ID NO: 4923 - DNA, 20 bp, Artificial
  CRISPR gRNA sequence
gaggcggcccgtgcggcgga

SEQ ID NO: 4924 - DNA, 20 bp, Artificial
  CRISPR gRNA sequence
agagcctacctggagggcac

SEQ ID NO: 4925 - DNA, 20 bp, Artificial
  CRISPR gRNA sequence
cctggagggcacgtgcgtgg

SEQ ID NO: 4926 - DNA, 20 bp, Artificial
  CRISPR gRNA sequence
gagggcacgtgcgtggagtg

SEQ ID NO: 4927 - DNA, 20 bp, Artificial
  CRISPR gRNA sequence
cgcagatacctggagaacgg

SEQ ID NO: 4928 - DNA, 20 bp, Artificial
  CRISPR gRNA sequence
gagaacgggaaggagacgct

SEQ ID NO: 4929 - DNA, 20 bp, Artificial
  CRISPR gRNA sequence
cagcgcgcaggtaccagggg

SEQ ID NO: 4930 - DNA, 20 bp, Artificial
  CRISPR gRNA sequence
ccccatctcctatagatctc

SEQ ID NO: 4931 - DNA, 20 bp, Artificial
  CRISPR gRNA sequence
cccatctcctatagatctcc

SEQ ID NO: 4932 - DNA, 20 bp, Artificial
  CRISPR gRNA sequence
ctatagatctcccgggatgg

SEQ ID NO: 4933 - DNA, 20 bp, Artificial
  CRISPR gRNA sequence
tagatctcccgggatggcct

SEQ ID NO: 4934 - DNA, 20 bp, Artificial
  CRISPR gRNA sequence
ccgggatggcctcccacgag

SEQ ID NO: 4935 - DNA, 20 bp, Artificial
  CRISPR gRNA sequence
ccacgaggaggggaggaaaa

SEQ ID NO: 4936 - DNA, 20 bp, Artificial
  CRISPR gRNA sequence
gaatatcgccctcccttgaa

SEQ ID NO: 4937 - DNA, 20 bp, Artificial
  CRISPR gRNA sequence
ccttgaatggagaatggcat

SEQ ID NO: 4938 - DNA, 20 bp, Artificial
  CRISPR gRNA sequence
gaatggagaatggcatgagt

SEQ ID NO: 4939 - DNA, 20 bp, Artificial
  CRISPR gRNA sequence
aatggagaatggcatgagtt

SEQ ID NO: 4940 - DNA, 20 bp, Artificial
  CRISPR gRNA sequence
tcctgagtttcctctgaggg

SEQ ID NO: 4941 - DNA, 20 bp, Artificial
  CRISPR gRNA sequence
cctgagtttcctctgagggc

SEQ ID NO: 4942 - DNA, 20 bp, Artificial
  CRISPR gRNA sequence
ctgagtttcctctgagggcc

SEQ ID NO: 4943 - DNA, 20 bp, Artificial
  CRISPR gRNA sequence
agtttcctctgagggccccc

SEQ ID NO: 4944 - DNA, 20 bp, Artificial
  CRISPR gRNA sequence
cctctgagggccccctctgc

SEQ ID NO: 4945 - DNA, 20 bp, Artificial
  CRISPR gRNA sequence
ctctgagggccccctctgct

SEQ ID NO: 4946 - DNA, 20 bp, Artificial
  CRISPR gRNA sequence
tgagggccccctctgctctc

SEQ ID NO: 4947 - DNA, 20 bp, Artificial
  CRISPR gRNA sequence
agggccccctctgctctcta

SEQ ID NO: 4948 - DNA, 20 bp, Artificial
  CRISPR gRNA sequence
tgctctctaggacaattaag

SEQ ID NO: 4949 - DNA, 20 bp, Artificial
  CRISPR gRNA sequence
ctctctaggacaattaaggg

SEQ ID NO: 4950 - DNA, 20 bp, Artificial
  CRISPR gRNA sequence
tctaggacaattaagggatg

SEQ ID NO: 4951 - DNA, 20 bp, Artificial
  CRISPR gRNA sequence
taggacaattaagggatgaa

SEQ ID NO: 4952 - DNA, 20 bp, Artificial
  CRISPR gRNA sequence
ggacaattaagggatgaagt

SEQ ID NO: 4953 - DNA, 20 bp, Artificial
  CRISPR gRNA sequence
agggatgaagtctctgagga

SEQ ID NO: 4954 - DNA, 20 bp, Artificial
  CRISPR gRNA sequence
tgaggaaatggaggggaaga

SEQ ID NO: 4955 - DNA, 20 bp, Artificial
  CRISPR gRNA sequence
aggaaatggaggggaagaca

SEQ ID NO: 4956 - DNA, 20 bp, Artificial
  CRISPR gRNA sequence
gaatactgatcaggggtctc

SEQ ID NO: 4957 - DNA, 20 bp, Artificial
  CRISPR gRNA sequence
atcaggggtctcctttgacc

SEQ ID NO: 4958 - DNA, 20 bp, Artificial
  CRISPR gRNA sequence
ctttgaccactttgaccact

SEQ ID NO: 4959 - DNA, 20 bp, Artificial
  CRISPR gRNA sequence
tgaccactttgaccactgca

SEQ ID NO: 4960 - DNA, 20 bp, Artificial
  CRISPR gRNA sequence
gaccactttgaccactgcag

SEQ ID NO: 4961 - DNA, 20 bp, Artificial
  CRISPR gRNA sequence
accactttgaccactgcagc

SEQ ID NO: 4962 - DNA, 20 bp, Artificial
  CRISPR gRNA sequence
tgaccactgcagcagctgtg

SEQ ID NO: 4963 - DNA, 20 bp, Artificial
  CRISPR gRNA sequence
gaccactgcagcagctgtgg

SEQ ID NO: 4964 - DNA, 20 bp, Artificial
  CRISPR gRNA sequence
accactgcagcagctgtggt

SEQ ID NO: 4965 - DNA, 20 bp, Artificial
  CRISPR gRNA sequence
cagcagctgtggtcaggctg

SEQ ID NO: 4966 - DNA, 20 bp, Artificial
  CRISPR gRNA sequence
tggtcaggctgctgaccttt

SEQ ID NO: 4967 - DNA, 20 bp, Artificial
  CRISPR gRNA sequence
ctgacctttctctcaggcct

SEQ ID NO: 4968 - DNA, 20 bp, Artificial
  CRISPR gRNA sequence
acctttctctcaggccttgt

SEQ ID NO: 4969 - DNA, 20 bp, Artificial
  CRISPR gRNA sequence
tctctcaggccttgttctct

SEQ ID NO: 4970 - DNA, 20 bp, Artificial
  CRISPR gRNA sequence
ctctcaggccttgttctctg

SEQ ID NO: 4971 - DNA, 20 bp, Artificial
  CRISPR gRNA sequence
tctcaggccttgttctctgc

SEQ ID NO: 4972 - DNA, 20 bp, Artificial
  CRISPR gRNA sequence
tcaggccttgttctctgcct

SEQ ID NO: 4973 - DNA, 20 bp, Artificial
  CRISPR gRNA sequence
aggccttgttctctgcctca

SEQ ID NO: 4974 - DNA, 20 bp, Artificial
  CRISPR gRNA sequence
gttctctgcctcacactcaa

SEQ ID NO: 4975 - DNA, 20 bp, Artificial
  CRISPR gRNA sequence
ttctctgcctcacactcaat

SEQ ID NO: 4976 - DNA, 20 bp, Artificial
  CRISPR gRNA sequence
tctgcctcacactcaatgtg

SEQ ID NO: 4977 - DNA, 20 bp, Artificial
  CRISPR gRNA sequence
tgcctcacactcaatgtgtc

SEQ ID NO: 4978 - DNA, 20 bp, Artificial
  CRISPR gRNA sequence
cctcacactcaatgtgtctg

SEQ ID NO: 4979 - DNA, 20 bp, Artificial
  CRISPR gRNA sequence
acactcaatgtgtctgaagg

SEQ ID NO: 4980 - DNA, 20 bp, Artificial
  CRISPR gRNA sequence
aatgtgtctgaaggtttgat

SEQ ID NO: 4981 - DNA, 20 bp, Artificial
  CRISPR gRNA sequence
aaggtttgattccagctttt

SEQ ID NO: 4982 - DNA, 20 bp, Artificial
  CRISPR gRNA sequence
gattccagcttttctgagtc

SEQ ID NO: 4983 - DNA, 20 bp, Artificial
  CRISPR gRNA sequence
attccagcttttctgagtcc

SEQ ID NO: 4984 - DNA, 20 bp, Artificial
  CRISPR gRNA sequence
cagcttttctgagtcctgca

SEQ ID NO: 4985 - DNA, 20 bp, Artificial
  CRISPR gRNA sequence
ttctgagtcctgcagcctcc

SEQ ID NO: 4986 - DNA, 20 bp, Artificial
  CRISPR gRNA sequence
tctgagtcctgcagcctcca

SEQ ID NO: 4987 - DNA, 20 bp, Artificial
  CRISPR gRNA sequence
ctgagtcctgcagcctccac

SEQ ID NO: 4988 - DNA, 20 bp, Artificial
  CRISPR gRNA sequence
tgagtcctgcagcctccact

SEQ ID NO: 4989 - DNA, 20 bp, Artificial
  CRISPR gRNA sequence
agtcctgcagcctccactca

SEQ ID NO: 4990 - DNA, 20 bp, Artificial
  CRISPR gRNA sequence
cagcctccactcaggtcagg

SEQ ID NO: 4991 - DNA, 20 bp, Artificial
  CRISPR gRNA sequence
cactcaggtcaggaccagaa

SEQ ID NO: 4992 - DNA, 20 bp, Artificial
  CRISPR gRNA sequence
aggtcaggaccagaagtcgc

SEQ ID NO: 4993 - DNA, 20 bp, Artificial
  CRISPR gRNA sequence
ttcctccctcagagactaga

SEQ ID NO: 4994 - DNA, 20 bp, Artificial
  CRISPR gRNA sequence
ctccctcagagactagaact

SEQ ID NO: 4995 - DNA, 20 bp, Artificial
  CRISPR gRNA sequence
cctcagagactagaactttc

SEQ ID NO: 4996 - DNA, 20 bp, Artificial
  CRISPR gRNA sequence
agagactagaactttccaat

SEQ ID NO: 4997 - DNA, 20 bp, Artificial
  CRISPR gRNA sequence
gaactttccaatgaatagga

SEQ ID NO: 4998 - DNA, 20 bp, Artificial
  CRISPR gRNA sequence
tccaatgaataggagattat

SEQ ID NO: 4999 - DNA, 20 bp, Artificial
  CRISPR gRNA sequence
ccaatgaataggagattatc

SEQ ID NO: 5000 - DNA, 20 bp, Artificial
  CRISPR gRNA sequence
caatgaataggagattatcc

SEQ ID NO: 5001 - DNA, 20 bp, Artificial
  CRISPR gRNA sequence
tcccaggtgcctgtgtccag

SEQ ID NO: 5002 - DNA, 20 bp, Artificial
  CRISPR gRNA sequence
tgtccaggctggcgtctggg

SEQ ID NO: 5003 - DNA, 20 bp, Artificial
  CRISPR gRNA sequence
gcgtctgggttctgtgccgc

SEQ ID NO: 5004 - DNA, 20 bp, Artificial
  CRISPR gRNA sequence
ggttctgtgccgccttcccc

SEQ ID NO: 5005 - DNA, 20 bp, Artificial
  CRISPR gRNA sequence
tgtgccgccttccccacccc

SEQ ID NO: 5006 - DNA, 20 bp, Artificial
  CRISPR gRNA sequence
tgccgccttccccaccccag

SEQ ID NO: 5007 - DNA, 20 bp, Artificial
  CRISPR gRNA sequence
ccccaccccaggtgtcctgt

SEQ ID NO: 5008 - DNA, 20 bp, Artificial
  CRISPR gRNA sequence
cccaccccaggtgtcctgtc

SEQ ID NO: 5009 - DNA, 20 bp, Artificial
  CRISPR gRNA sequence
tccattctcaggatggtcac

SEQ ID NO: 5010 - DNA, 20 bp, Artificial
  CRISPR gRNA sequence
tcaggatggtcacatgggcg

SEQ ID NO: 5011 - DNA, 20 bp, Artificial
  CRISPR gRNA sequence
aggatggtcacatgggcgct

SEQ ID NO: 5012 - DNA, 20 bp, Artificial
  CRISPR gRNA sequence
ctggagtgtcccaagagaga

SEQ ID NO: 5013 - DNA, 20 bp, Artificial
  CRISPR gRNA sequence
gagtgtcccaagagagatgc

SEQ ID NO: 5014 - DNA, 20 bp, Artificial
  CRISPR gRNA sequence
aattttctgactcttcccgt

SEQ ID NO: 5015 - DNA, 20 bp, Artificial
  CRISPR gRNA sequence
tctgactcttcccgtcagaa

SEQ ID NO: 5016 - DNA, 20 bp, Artificial
  CRISPR gRNA sequence
ctgactcttcccgtcagaac

SEQ ID NO: 5017 - DNA, 20 bp, Artificial
  CRISPR gRNA sequence
tgactcttcccgtcagaacc

SEQ ID NO: 5018 - DNA, 20 bp, Artificial
  CRISPR gRNA sequence
actcttcccgtcagaacccc

SEQ ID NO: 5019 - DNA, 20 bp, Artificial
  CRISPR gRNA sequence
ttcccgtcagaacccccaaa

SEQ ID NO: 5020 - DNA, 20 bp, Artificial
  CRISPR gRNA sequence
cccgtcagaacccccaaaga

SEQ ID NO: 5021 - DNA, 20 bp, Artificial
  CRISPR gRNA sequence
ccgtcagaacccccaaagac

SEQ ID NO: 5022 - DNA, 20 bp, Artificial
  CRISPR gRNA sequence
tctgaccatgaggccaccct

SEQ ID NO: 5023 - DNA, 20 bp, Artificial
  CRISPR gRNA sequence
tgaccatgaggccaccctga

SEQ ID NO: 5024 - DNA, 20 bp, Artificial
  CRISPR gRNA sequence
accatgaggccaccctgagg

SEQ ID NO: 5025 - DNA, 20 bp, Artificial
  CRISPR gRNA sequence
aggtgctgggccctgggctt

SEQ ID NO: 5026 - DNA, 20 bp, Artificial
  CRISPR gRNA sequence
ggccctgggcttctaccctg

SEQ ID NO: 5027 - DNA, 20 bp, Artificial
  CRISPR gRNA sequence
ggcttctaccctgcggagat

SEQ ID NO: 5028 - DNA, 20 bp, Artificial
  CRISPR gRNA sequence
ctaccctgcggagatcacac

SEQ ID NO: 5029 - DNA, 20 bp, Artificial
  CRISPR gRNA sequence
taccctgcggagatcacact

SEQ ID NO: 5030 - DNA, 20 bp, Artificial
  CRISPR gRNA sequence
ccctgcggagatcacactga

SEQ ID NO: 5031 - DNA, 20 bp, Artificial
  CRISPR gRNA sequence
cggagatcacactgacctgg

SEQ ID NO: 5032 - DNA, 20 bp, Artificial
  CRISPR gRNA sequence
acctggcagcgggatgggga

SEQ ID NO: 5033 - DNA, 20 bp, Artificial
  CRISPR gRNA sequence
gcagcgggatggggaggacc

SEQ ID NO: 5034 - DNA, 20 bp, Artificial
  CRISPR gRNA sequence
gtggagaccaggccagcagg

SEQ ID NO: 5035 - DNA, 20 bp, Artificial
  CRISPR gRNA sequence
tggagaccaggccagcagga

SEQ ID NO: 5036 - DNA, 20 bp, Artificial
  CRISPR gRNA sequence
ccagaagtgggcagctgtgg

SEQ ID NO: 5037 - DNA, 20 bp, Artificial
  CRISPR gRNA sequence
cagaagtgggcagctgtggt

SEQ ID NO: 5038 - DNA, 20 bp, Artificial
  CRISPR gRNA sequence
tggtggtgccttctggacaa

SEQ ID NO: 5039 - DNA, 20 bp, Artificial
  CRISPR gRNA sequence
ctggacaagagcagagatac

SEQ ID NO: 5040 - DNA, 20 bp, Artificial
  CRISPR gRNA sequence
tggacaagagcagagataca

SEQ ID NO: 5041 - DNA, 20 bp, Artificial
  CRISPR gRNA sequence
gacaagagcagagatacacg

SEQ ID NO: 5042 - DNA, 20 bp, Artificial
  CRISPR gRNA sequence
caagagcccctcaccctgag

SEQ ID NO: 5043 - DNA, 20 bp, Artificial
  CRISPR gRNA sequence
accctgagctggggtaagga

SEQ ID NO: 5044 - DNA, 20 bp, Artificial
  CRISPR gRNA sequence
agctggggtaaggaggggaa

SEQ ID NO: 5045 - DNA, 20 bp, Artificial
  CRISPR gRNA sequence
gggtaaggaggggaatgggg

SEQ ID NO: 5046 - DNA, 20 bp, Artificial
  CRISPR gRNA sequence
ttatcagagaaagcagaagt

SEQ ID NO: 5047 - DNA, 20 bp, Artificial
  CRISPR gRNA sequence
atcagagaaagcagaagtcc

SEQ ID NO: 5048 - DNA, 20 bp, Artificial
  CRISPR gRNA sequence
tcagagaaagcagaagtcct

SEQ ID NO: 5049 - DNA, 20 bp, Artificial
  CRISPR gRNA sequence
ctggagcccttcagccgggt

SEQ ID NO: 5050 - DNA, 20 bp, Artificial
  CRISPR gRNA sequence
tggagcccttcagccgggtc

SEQ ID NO: 5051 - DNA, 20 bp, Artificial
  CRISPR gRNA sequence
gagcccttcagccgggtcag

SEQ ID NO: 5052 - DNA, 20 bp, Artificial
  CRISPR gRNA sequence
cagccgggtcagggctgagg

SEQ ID NO: 5053 - DNA, 20 bp, Artificial
  CRISPR gRNA sequence
agccgggtcagggctgaggc

SEQ ID NO: 5054 - DNA, 20 bp, Artificial
  CRISPR gRNA sequence
aggcttgggggtcagggccc

SEQ ID NO: 5055 - DNA, 20 bp, Artificial
  CRISPR gRNA sequence
gggggtcagggcccctcacc

SEQ ID NO: 5056 - DNA, 20 bp, Artificial
  CRISPR gRNA sequence
ggggtcagggcccctcacct

SEQ ID NO: 5057 - DNA, 20 bp, Artificial
  CRISPR gRNA sequence
accttctcctcctttcccag

SEQ ID NO: 5058 - DNA, 20 bp, Artificial
  CRISPR gRNA sequence
ctcctcctttcccagagcca

SEQ ID NO: 5059 - DNA, 20 bp, Artificial
  CRISPR gRNA sequence
tcctcctttcccagagccat

SEQ ID NO: 5060 - DNA, 20 bp, Artificial
  CRISPR gRNA sequence
ctcctttcccagagccatct

SEQ ID NO: 5061 - DNA, 20 bp, Artificial
  CRISPR gRNA sequence
ctttcccagagccatcttcc

SEQ ID NO: 5062 - DNA, 20 bp, Artificial
  CRISPR gRNA sequence
tcccagagccatcttcccag

SEQ ID NO: 5063 - DNA, 20 bp, Artificial
  CRISPR gRNA sequence
cccagagccatcttcccagc

SEQ ID NO: 5064 - DNA, 20 bp, Artificial
  CRISPR gRNA sequence
ccagagccatcttcccagcc

SEQ ID NO: 5065 - DNA, 20 bp, Artificial
  CRISPR gRNA sequence
cccagcccaccatccccatc

SEQ ID NO: 5066 - DNA, 20 bp, Artificial
  CRISPR gRNA sequence
ccagcccaccatccccatca

SEQ ID NO: 5067 - DNA, 20 bp, Artificial
  CRISPR gRNA sequence
ctggcctggctgtcctggtt

SEQ ID NO: 5068 - DNA, 20 bp, Artificial
  CRISPR gRNA sequence
gcctggctgtcctggttgtc

SEQ ID NO: 5069 - DNA, 20 bp, Artificial
  CRISPR gRNA sequence
gctgtcctggttgtcctagc

SEQ ID NO: 5070 - DNA, 20 bp, Artificial
  CRISPR gRNA sequence
tcctggttgtcctagctgtc

SEQ ID NO: 5071 - DNA, 20 bp, Artificial
  CRISPR gRNA sequence
gttgtcctagctgtccttgg

SEQ ID NO: 5072 - DNA, 20 bp, Artificial
  CRISPR gRNA sequence
tcctagctgtccttggagct

SEQ ID NO: 5073 - DNA, 20 bp, Artificial
  CRISPR gRNA sequence
gctgtccttggagctgtggt

SEQ ID NO: 5074 - DNA, 20 bp, Artificial
  CRISPR gRNA sequence
tccttggagctgtggtcacc

SEQ ID NO: 5075 - DNA, 20 bp, Artificial
  CRISPR gRNA sequence
ggagctgtggtcaccgctat

SEQ ID NO: 5076 - DNA, 20 bp, Artificial
  CRISPR gRNA sequence
gagctgtggtcaccgctatg

SEQ ID NO: 5077 - DNA, 20 bp, Artificial
  CRISPR gRNA sequence
tggtcaccgctatgatgtgt

SEQ ID NO: 5078 - DNA, 20 bp, Artificial
  CRISPR gRNA sequence
tgatgtgtaggaggaagagc

SEQ ID NO: 5079 - DNA, 20 bp, Artificial
  CRISPR gRNA sequence
aggtagggaaggggtgaaga

SEQ ID NO: 5080 - DNA, 20 bp, Artificial
  CRISPR gRNA sequence
ggttttcttgtcccactggg

SEQ ID NO: 5081 - DNA, 20 bp, Artificial
  CRISPR gRNA sequence
tcttgtcccactgggagttt

SEQ ID NO: 5082 - DNA, 20 bp, Artificial
  CRISPR gRNA sequence
cttgtcccactgggagtttc

SEQ ID NO: 5083 - DNA, 20 bp, Artificial
  CRISPR gRNA sequence
ttgtcccactgggagtttca

SEQ ID NO: 5084 - DNA, 20 bp, Artificial
  CRISPR gRNA sequence
gtcccactgggagtttcaag

SEQ ID NO: 5085 - DNA, 20 bp, Artificial
  CRISPR gRNA sequence
tcccactgggagtttcaagc

SEQ ID NO: 5086 - DNA, 20 bp, Artificial
  CRISPR gRNA sequence
ggagtttcaagccccaggta

SEQ ID NO: 5087 - DNA, 20 bp, Artificial
  CRISPR gRNA sequence
caagccccaggtagaagtgt

SEQ ID NO: 5088 - DNA, 20 bp, Artificial
  CRISPR gRNA sequence
aagccccaggtagaagtgtg

SEQ ID NO: 5089 - DNA, 20 bp, Artificial
  CRISPR gRNA sequence
gttactggaagcaccatcca

SEQ ID NO: 5090 - DNA, 20 bp, Artificial
  CRISPR gRNA sequence
ttactggaagcaccatccac

SEQ ID NO: 5091 - DNA, 20 bp, Artificial
  CRISPR gRNA sequence
ctggaagcaccatccacaca

SEQ ID NO: 5092 - DNA, 20 bp, Artificial
  CRISPR gRNA sequence
gaagcaccatccacacatgg

SEQ ID NO: 5093 - DNA, 20 bp, Artificial
  CRISPR gRNA sequence
ggaccctgtgtgccagcact

SEQ ID NO: 5094 - DNA, 20 bp, Artificial
  CRISPR gRNA sequence
tgtgccagcacttactcttt

SEQ ID NO: 5095 - DNA, 20 bp, Artificial
  CRISPR gRNA sequence
actcttttgtgaagcacatg

SEQ ID NO: 5096 - DNA, 20 bp, Artificial
  CRISPR gRNA sequence
ctcttttgtgaagcacatgt

SEQ ID NO: 5097 - DNA, 20 bp, Artificial
  CRISPR gRNA sequence
ttttgtgaagcacatgtgac

SEQ ID NO: 5098 - DNA, 20 bp, Artificial
  CRISPR gRNA sequence
ttgtgaagcacatgtgacaa

SEQ ID NO: 5099 - DNA, 20 bp, Artificial
  CRISPR gRNA sequence
tgtgaagcacatgtgacaat

SEQ ID NO: 5100 - DNA, 20 bp, Artificial
  CRISPR gRNA sequence
gtgaagcacatgtgacaatg

SEQ ID NO: 5101 - DNA, 20 bp, Artificial
  CRISPR gRNA sequence
tgaagcacatgtgacaatga

SEQ ID NO: 5102 - DNA, 20 bp, Artificial
  CRISPR gRNA sequence
gatgattatggtgttggggt

SEQ ID NO: 5103 - DNA, 20 bp, Artificial
  CRISPR gRNA sequence
atgattatggtgttggggtc

SEQ ID NO: 5104 - DNA, 20 bp, Artificial
  CRISPR gRNA sequence
tggtgttggggtcctgattc

SEQ ID NO: 5105 - DNA, 20 bp, Artificial
  CRISPR gRNA sequence
gggtcctgattccagcattc

SEQ ID NO: 5106 - DNA, 20 bp, Artificial
  CRISPR gRNA sequence
attccagcattcatgagtca

SEQ ID NO: 5107 - DNA, 20 bp, Artificial
  CRISPR gRNA sequence
cagcattcatgagtcagggg

SEQ ID NO: 5108 - DNA, 20 bp, Artificial
  CRISPR gRNA sequence
atgagtcaggggaaggtccc

SEQ ID NO: 5109 - DNA, 20 bp, Artificial
  CRISPR gRNA sequence
ctaaggacagaccttaggag

SEQ ID NO: 5110 - DNA, 20 bp, Artificial
  CRISPR gRNA sequence
aggacagaccttaggagggc

SEQ ID NO: 5111 - DNA, 20 bp, Artificial
  CRISPR gRNA sequence
aggagggcagttggtccaga

SEQ ID NO: 5112 - DNA, 20 bp, Artificial
  CRISPR gRNA sequence
ggagggcagttggtccagaa

SEQ ID NO: 5113 - DNA, 20 bp, Artificial
  CRISPR gRNA sequence
gtccagaacccacaactgct

SEQ ID NO: 5114 - DNA, 20 bp, Artificial
  CRISPR gRNA sequence
ctttccccatgtttcctgat

SEQ ID NO: 5115 - DNA, 20 bp, Artificial
  CRISPR gRNA sequence
tccccatgtttcctgatcct

SEQ ID NO: 5116 - DNA, 20 bp, Artificial
  CRISPR gRNA sequence
ccccatgtttcctgatcctg

SEQ ID NO: 5117 - DNA, 20 bp, Artificial
  CRISPR gRNA sequence
cccatgtttcctgatcctgc

SEQ ID NO: 5118 - DNA, 20 bp, Artificial
  CRISPR gRNA sequence
cctgatcctgccctgggtct

SEQ ID NO: 5119 - DNA, 20 bp, Artificial
  CRISPR gRNA sequence
ctgatcctgccctgggtctg

SEQ ID NO: 5120 - DNA, 20 bp, Artificial
  CRISPR gRNA sequence
atcctgccctgggtctgcag

SEQ ID NO: 5121 - DNA, 20 bp, Artificial
  CRISPR gRNA sequence
ccctgggtctgcagtcgtag

SEQ ID NO: 5122 - DNA, 20 bp, Artificial
  CRISPR gRNA sequence
ggtctgcagtcgtagttctg

SEQ ID NO: 5123 - DNA, 20 bp, Artificial
  CRISPR gRNA sequence
cagtcgtagttctggaaact

SEQ ID NO: 5124 - DNA, 20 bp, Artificial
  CRISPR gRNA sequence
tggaaacttctcttgggtcc

SEQ ID NO: 5125 - DNA, 20 bp, Artificial
  CRISPR gRNA sequence
gaaacttctcttgggtccaa

SEQ ID NO: 5126 - DNA, 20 bp, Artificial
  CRISPR gRNA sequence
ctcttgggtccaagactagg

SEQ ID NO: 5127 - DNA, 20 bp, Artificial
  CRISPR gRNA sequence
tcttgggtccaagactagga

SEQ ID NO: 5128 - DNA, 20 bp, Artificial
  CRISPR gRNA sequence
ttgggtccaagactaggagg

SEQ ID NO: 5129 - DNA, 20 bp, Artificial
  CRISPR gRNA sequence
gggtccaagactaggaggtt

SEQ ID NO: 5130 - DNA, 20 bp, Artificial
  CRISPR gRNA sequence
ggtccaagactaggaggttc

SEQ ID NO: 5131 - DNA, 20 bp, Artificial
  CRISPR gRNA sequence
ggaggttcccctaagatcac

SEQ ID NO: 5132 - DNA, 20 bp, Artificial
  CRISPR gRNA sequence
ccctaagatcacatggccct

SEQ ID NO: 5133 - DNA, 20 bp, Artificial
  CRISPR gRNA sequence
agatcacatggccctgcctc

SEQ ID NO: 5134 - DNA, 20 bp, Artificial
  CRISPR gRNA sequence
cctcctcccagtcccctcat

SEQ ID NO: 5135 - DNA, 20 bp, Artificial
  CRISPR gRNA sequence
ctcccagtcccctcataggg

SEQ ID NO: 5136 - DNA, 20 bp, Artificial
  CRISPR gRNA sequence
ccagtcccctcatagggcat

SEQ ID NO: 5137 - DNA, 20 bp, Artificial
  CRISPR gRNA sequence
atagggcattttcttcccac

SEQ ID NO: 5138 - DNA, 20 bp, Artificial
  CRISPR gRNA sequence
tcttcccacaggtggaaaag

SEQ ID NO: 5139 - DNA, 20 bp, Artificial
  CRISPR gRNA sequence
cttcccacaggtggaaaagg

SEQ ID NO: 5140 - DNA, 20 bp, Artificial
  CRISPR gRNA sequence
ttcccacaggtggaaaagga

SEQ ID NO: 5141 - DNA, 20 bp, Artificial
  CRISPR gRNA sequence
cccacaggtggaaaaggagg

SEQ ID NO: 5142 - DNA, 20 bp, Artificial
  CRISPR gRNA sequence
ccacaggtggaaaaggaggg

SEQ ID NO: 5143 - DNA, 20 bp, Artificial
  CRISPR gRNA sequence
ctctcaggctgcgtgtaagt

SEQ ID NO: 5144 - DNA, 20 bp, Artificial
  CRISPR gRNA sequence
tcaggctgcgtgtaagtgat

SEQ ID NO: 5145 - DNA, 20 bp, Artificial
  CRISPR gRNA sequence
aggctgcgtgtaagtgatgg

SEQ ID NO: 5146 - DNA, 20 bp, Artificial
  CRISPR gRNA sequence
cgtgtaagtgatggcggcgg

SEQ ID NO: 5147 - DNA, 20 bp, Artificial
  CRISPR gRNA sequence
acctactccataattcctct

SEQ ID NO: 5148 - DNA, 20 bp, Artificial
  CRISPR gRNA sequence
ctccataattcctcttgtcc

SEQ ID NO: 5149 - DNA, 20 bp, Artificial
  CRISPR gRNA sequence
cataattcctcttgtcccac

SEQ ID NO: 5150 - DNA, 20 bp, Artificial
  CRISPR gRNA sequence
ctcttgtcccacatctcctg

SEQ ID NO: 5151 - DNA, 20 bp, Artificial
  CRISPR gRNA sequence
ttgtcccacatctcctgcgg

SEQ ID NO: 5152 - DNA, 20 bp, Artificial
  CRISPR gRNA sequence
gtcccacatctcctgcgggc

SEQ ID NO: 5153 - DNA, 20 bp, Artificial
  CRISPR gRNA sequence
tcccacatctcctgcgggct

SEQ ID NO: 5154 - DNA, 20 bp, Artificial
  CRISPR gRNA sequence
ctgcgggctctgaccaggtc

SEQ ID NO: 5155 - DNA, 20 bp, Artificial
  CRISPR gRNA sequence
cgggctctgaccaggtcttt

SEQ ID NO: 5156 - DNA, 20 bp, Artificial
  CRISPR gRNA sequence
tgaccaggtctttttttttg

SEQ ID NO: 5157 - DNA, 20 bp, Artificial
  CRISPR gRNA sequence
accaggtctttttttttgtt

SEQ ID NO: 5158 - DNA, 20 bp, Artificial
  CRISPR gRNA sequence
tttttttgttctaccccagg

SEQ ID NO: 5159 - DNA, 20 bp, Artificial
  CRISPR gRNA sequence
ttttttgttctaccccaggc

SEQ ID NO: 5160 - DNA, 20 bp, Artificial
  CRISPR gRNA sequence
tttttgttctaccccaggca

SEQ ID NO: 5161 - DNA, 20 bp, Artificial
  CRISPR gRNA sequence
ttttgttctaccccaggcag

SEQ ID NO: 5162 - DNA, 20 bp, Artificial
  CRISPR gRNA sequence
tttgttctaccccaggcagc

SEQ ID NO: 5163 - DNA, 20 bp, Artificial
  CRISPR gRNA sequence
ttgttctaccccaggcagca

SEQ ID NO: 5164 - DNA, 20 bp, Artificial
  CRISPR gRNA sequence
tgttctaccccaggcagcaa

SEQ ID NO: 5165 - DNA, 20 bp, Artificial
  CRISPR gRNA sequence
gttctaccccaggcagcaac

SEQ ID NO: 5166 - DNA, 20 bp, Artificial
  CRISPR gRNA sequence
ttctaccccaggcagcaaca

SEQ ID NO: 5167 - DNA, 20 bp, Artificial
  CRISPR gRNA sequence
taccccaggcagcaacagtg

SEQ ID NO: 5168 - DNA, 20 bp, Artificial
  CRISPR gRNA sequence
ccccaggcagcaacagtgcc

SEQ ID NO: 5169 - DNA, 20 bp, Artificial
  CRISPR gRNA sequence
tgatgagtctctcatcactt

SEQ ID NO: 5170 - DNA, 20 bp, Artificial
  CRISPR gRNA sequence
atgagtctctcatcacttgt

SEQ ID NO: 5171 - DNA, 20 bp, Artificial
  CRISPR gRNA sequence
tcatcacttgtaaaggtgag

SEQ ID NO: 5172 - DNA, 20 bp, Artificial
  CRISPR gRNA sequence
atcacttgtaaaggtgagat

SEQ ID NO: 5173 - DNA, 20 bp, Artificial
  CRISPR gRNA sequence
gtaaaggtgagattctgggg

SEQ ID NO: 5174 - DNA, 20 bp, Artificial
  CRISPR gRNA sequence
taaaggtgagattctgggga

SEQ ID NO: 5175 - DNA, 20 bp, Artificial
  CRISPR gRNA sequence
tggggagctgaagtggtcgg

SEQ ID NO: 5176 - DNA, 20 bp, Artificial
  CRISPR gRNA sequence
gggagctgaagtggtcgggg

SEQ ID NO: 5177 - DNA, 20 bp, Artificial
  CRISPR gRNA sequence
aagtggtcgggggtggggca

SEQ ID NO: 5178 - DNA, 20 bp, Artificial
  CRISPR gRNA sequence
ggtaatggggattctttgat

SEQ ID NO: 5179 - DNA, 20 bp, Artificial
  CRISPR gRNA sequence
tttgattgggacgtttcgag

SEQ ID NO: 5180 - DNA, 20 bp, Artificial
  CRISPR gRNA sequence
tgattgggacgtttcgagtg

SEQ ID NO: 5181 - DNA, 20 bp, Artificial
  CRISPR gRNA sequence
gattgggacgtttcgagtgt

SEQ ID NO: 5182 - DNA, 20 bp, Artificial
  CRISPR gRNA sequence
attgggacgtttcgagtgtg

SEQ ID NO: 5183 - DNA, 20 bp, Artificial
  CRISPR gRNA sequence
ggacgtttcgagtgtgtggt

SEQ ID NO: 5184 - DNA, 20 bp, Artificial
  CRISPR gRNA sequence
cttctgagctgggcatccga

SEQ ID NO: 5185 - DNA, 20 bp, Artificial
  CRISPR gRNA sequence
tgggcatccgaaggcatcct

SEQ ID NO: 5186 - DNA, 20 bp, Artificial
  CRISPR gRNA sequence
gggcatccgaaggcatcctt

SEQ ID NO: 5187 - DNA, 20 bp, Artificial
  CRISPR gRNA sequence
ggcatccgaaggcatccttg

SEQ ID NO: 5188 - DNA, 20 bp, Artificial
  CRISPR gRNA sequence
atccgaaggcatccttgggg

SEQ ID NO: 5189 - DNA, 20 bp, Artificial
  CRISPR gRNA sequence
aaggcatccttggggaagct

SEQ ID NO: 5190 - DNA, 20 bp, Artificial
  CRISPR gRNA sequence
aggcatccttggggaagctg

SEQ ID NO: 5191 - DNA, 20 bp, Artificial
  CRISPR gRNA sequence
ggcatccttggggaagctga

SEQ ID NO: 5192 - DNA, 20 bp, Artificial
  CRISPR gRNA sequence
cttggggaagctgagggcac

SEQ ID NO: 5193 - DNA, 20 bp, Artificial
  CRISPR gRNA sequence
ttggggaagctgagggcacg

SEQ ID NO: 5194 - DNA, 20 bp, Artificial
  CRISPR gRNA sequence
ggggaagctgagggcacgag

SEQ ID NO: 5195 - DNA, 20 bp, Artificial
  CRISPR gRNA sequence
gggaagctgagggcacgagg

SEQ ID NO: 5196 - DNA, 20 bp, Artificial
  CRISPR gRNA sequence
ggaagctgagggcacgagga

SEQ ID NO: 5197 - DNA, 20 bp, Artificial
  CRISPR gRNA sequence
gaagctgagggcacgaggag

SEQ ID NO: 5198 - DNA, 20 bp, Artificial
  CRISPR gRNA sequence
agggcacgaggaggggctgc

SEQ ID NO: 5199 - DNA, 20 bp, Artificial
  CRISPR gRNA sequence
gaggaggggctgccagactc

SEQ ID NO: 5200 - DNA, 20 bp, Artificial
  CRISPR gRNA sequence
aggaggggctgccagactcc

SEQ ID NO: 5201 - DNA, 20 bp, Artificial
  CRISPR gRNA sequence
gaggggctgccagactccgg

SEQ ID NO: 5202 - DNA, 20 bp, Artificial
  CRISPR gRNA sequence
agactccgggagctgctgcc

SEQ ID NO: 5203 - DNA, 20 bp, Artificial
  CRISPR gRNA sequence
tccgggagctgctgcctggc

SEQ ID NO: 5204 - DNA, 20 bp, Artificial
  CRISPR gRNA sequence
ccgggagctgctgcctggct

SEQ ID NO: 5205 - DNA, 20 bp, Artificial
  CRISPR gRNA sequence
ttcctacacaatgcgttgcc

SEQ ID NO: 5206 - DNA, 20 bp, Artificial
  CRISPR gRNA sequence
tgcctggctccacgccctgc

SEQ ID NO: 5207 - DNA, 20 bp, Artificial
  CRISPR gRNA sequence
gcctggctccacgccctgct

SEQ ID NO: 5208 - DNA, 20 bp, Artificial
  CRISPR gRNA sequence
ccctgctgggtcctacctgt

SEQ ID NO: 5209 - DNA, 20 bp, Artificial
  CRISPR gRNA sequence
ctgctgggtcctacctgtca

SEQ ID NO: 5210 - DNA, 20 bp, Artificial
  CRISPR gRNA sequence
gtcctacctgtcagagcccc

SEQ ID NO: 5211 - DNA, 20 bp, Artificial
  CRISPR gRNA sequence
tcctacctgtcagagcccca

SEQ ID NO: 5212 - DNA, 20 bp, Artificial
  CRISPR gRNA sequence
tgtcagagccccaaggtaaa

SEQ ID NO: 5213 - DNA, 20 bp, Artificial
  CRISPR gRNA sequence
gtcagagccccaaggtaaaa

SEQ ID NO: 5214 - DNA, 20 bp, Artificial
  CRISPR gRNA sequence
gagccccaaggtaaaaaggc

SEQ ID NO: 5215 - DNA, 20 bp, Artificial
  CRISPR gRNA sequence
agccccaaggtaaaaaggcc

SEQ ID NO: 5216 - DNA, 20 bp, Artificial
  CRISPR gRNA sequence
ccaaggtaaaaaggccggga

SEQ ID NO: 5217 - DNA, 20 bp, Artificial
  CRISPR gRNA sequence
gccgggaaagcatcttaatt

SEQ ID NO: 5218 - DNA, 20 bp, Artificial
  CRISPR gRNA sequence
aagcatcttaatttagcgtg

SEQ ID NO: 5219 - DNA, 20 bp, Artificial
  CRISPR gRNA sequence
cttaatttagcgtgcagtct

SEQ ID NO: 5220 - DNA, 20 bp, Artificial
  CRISPR gRNA sequence
atttagcgtgcagtctcagc

SEQ ID NO: 5221 - DNA, 20 bp, Artificial
  CRISPR gRNA sequence
ctcagctggtcctgccattc

SEQ ID NO: 5222 - DNA, 20 bp, Artificial
  CRISPR gRNA sequence
gtcctgccattccagataaa

SEQ ID NO: 5223 - DNA, 20 bp, Artificial
  CRISPR gRNA sequence
cctgccattccagataaaca

SEQ ID NO: 5224 - DNA, 20 bp, Artificial
  CRISPR gRNA sequence
acagagaaaccattctgaat

SEQ ID NO: 5225 - DNA, 20 bp, Artificial
  CRISPR gRNA sequence
cagagaaaccattctgaatt

SEQ ID NO: 5226 - DNA, 20 bp, Artificial
  CRISPR gRNA sequence
agagaaaccattctgaattg

SEQ ID NO: 5227 - DNA, 20 bp, Artificial
  CRISPR gRNA sequence
aaaccattctgaattgggga

SEQ ID NO: 5228 - DNA, 20 bp, Artificial
  CRISPR gRNA sequence
aaccattctgaattggggat

SEQ ID NO: 5229 - DNA, 20 bp, Artificial
  CRISPR gRNA sequence
accattctgaattggggatg

SEQ ID NO: 5230 - DNA, 20 bp, Artificial
  CRISPR gRNA sequence
ccattctgaattggggatgg

SEQ ID NO: 5231 - DNA, 20 bp, Artificial
  CRISPR gRNA sequence
tctgaattggggatgggggt

SEQ ID NO: 5232 - DNA, 20 bp, Artificial
  CRISPR gRNA sequence
ctgaattggggatgggggtg

SEQ ID NO: 5233 - DNA, 20 bp, Artificial
  CRISPR gRNA sequence
attggggatgggggtgagga

SEQ ID NO: 5234 - DNA, 20 bp, Artificial
  CRISPR gRNA sequence
ttggggatgggggtgaggat

SEQ ID NO: 5235 - DNA, 20 bp, Artificial
  CRISPR gRNA sequence
gatgggggtgaggatgggaa

SEQ ID NO: 5236 - DNA, 20 bp, Artificial
  CRISPR gRNA sequence
atgggggtgaggatgggaac

SEQ ID NO: 5237 - DNA, 20 bp, Artificial
  CRISPR gRNA sequence
gggggtgaggatgggaacag

SEQ ID NO: 5238 - DNA, 20 bp, Artificial
  CRISPR gRNA sequence
aacaggagtctgtgtcctgc

SEQ ID NO: 5239 - DNA, 20 bp, Artificial
  CRISPR gRNA sequence
acaggagtctgtgtcctgct

SEQ ID NO: 5240 - DNA, 20 bp, Artificial
  CRISPR gRNA sequence
caggagtctgtgtcctgctg

SEQ ID NO: 5241 - DNA, 20 bp, Artificial
  CRISPR gRNA sequence
gagtctgtgtcctgctgggg

SEQ ID NO: 5242 - DNA, 20 bp, Artificial
  CRISPR gRNA sequence
agtctgtgtcctgctggggc

SEQ ID NO: 5243 - DNA, 20 bp, Artificial
  CRISPR gRNA sequence
gtcctgctggggcaggccat

SEQ ID NO: 5244 - DNA, 20 bp, Artificial
  CRISPR gRNA sequence
ctgctggggcaggccattgg

SEQ ID NO: 5245 - DNA, 20 bp, Artificial
  CRISPR gRNA sequence
caggccattggaagatgtga

SEQ ID NO: 5246 - DNA, 20 bp, Artificial
  CRISPR gRNA sequence
ggccattggaagatgtgaaa

SEQ ID NO: 5247 - DNA, 20 bp, Artificial
  CRISPR gRNA sequence
agttgtctatttccttccac

SEQ ID NO: 5248 - DNA, 20 bp, Artificial
  CRISPR gRNA sequence
ttgtctatttccttccaccg

SEQ ID NO: 5249 - DNA, 20 bp, Artificial
  CRISPR gRNA sequence
tgtctatttccttccaccgg

SEQ ID NO: 5250 - DNA, 20 bp, Artificial
  CRISPR gRNA sequence
gtctatttccttccaccgga

SEQ ID NO: 5251 - DNA, 20 bp, Artificial
  CRISPR gRNA sequence
ctatttccttccaccggagg

SEQ ID NO: 5252 - DNA, 20 bp, Artificial
  CRISPR gRNA sequence
cttccaccggagggagactt

SEQ ID NO: 5253 - DNA, 20 bp, Artificial
  CRISPR gRNA sequence
ttccaccggagggagacttc

SEQ ID NO: 5254 - DNA, 20 bp, Artificial
  CRISPR gRNA sequence
accggagggagacttcaggt

SEQ ID NO: 5255 - DNA, 20 bp, Artificial
  CRISPR gRNA sequence
gagggagacttcaggtcagc

SEQ ID NO: 5256 - DNA, 20 bp, Artificial
  CRISPR gRNA sequence
agggagacttcaggtcagcc

SEQ ID NO: 5257 - DNA, 20 bp, Artificial
  CRISPR gRNA sequence
cttcaggtcagccaggtgtc

SEQ ID NO: 5258 - DNA, 20 bp, Artificial
  CRISPR gRNA sequence
tcaggtcagccaggtgtctg

SEQ ID NO: 5259 - DNA, 20 bp, Artificial
  CRISPR gRNA sequence
ctggagtatgaaccatgtat

SEQ ID NO: 5260 - DNA, 20 bp, Artificial
  CRISPR gRNA sequence
gaaccatgtatcagcaccga

SEQ ID NO: 5261 - DNA, 20 bp, Artificial
  CRISPR gRNA sequence
aaccatgtatcagcaccgaa

SEQ ID NO: 5262 - DNA, 20 bp, Artificial
  CRISPR gRNA sequence
gtatcagcaccgaaaggttc

SEQ ID NO: 5263 - DNA, 20 bp, Artificial
  CRISPR gRNA sequence
tcagcaccgaaaggttctag

SEQ ID NO: 5264 - DNA, 20 bp, Artificial
  CRISPR gRNA sequence
caccgaaaggttctagaagt

SEQ ID NO: 5265 - DNA, 20 bp, Artificial
  CRISPR gRNA sequence
ggttctagaagtcagacttt

SEQ ID NO: 5266 - DNA, 20 bp, Artificial
  CRISPR gRNA sequence
gttctagaagtcagactttc

SEQ ID NO: 5267 - DNA, 20 bp, Artificial
  CRISPR gRNA sequence
ctagaagtcagactttcggg

SEQ ID NO: 5268 - DNA, 20 bp, Artificial
  CRISPR gRNA sequence
ggcagtgtgtcactaactct

SEQ ID NO: 5269 - DNA, 20 bp, Artificial
  CRISPR gRNA sequence
gtcactaactctcagcatgc

SEQ ID NO: 5270 - DNA, 20 bp, Artificial
  CRISPR gRNA sequence
taactctcagcatgctggcc

SEQ ID NO: 5271 - DNA, 20 bp, Artificial
  CRISPR gRNA sequence
ctcagcatgctggcctggct

SEQ ID NO: 5272 - DNA, 20 bp, Artificial
  CRISPR gRNA sequence
tgctggcctggctcggccca

SEQ ID NO: 5273 - DNA, 20 bp, Artificial
  CRISPR gRNA sequence
ggcctggctcggcccacagc

SEQ ID NO: 5274 - DNA, 20 bp, Artificial
  CRISPR gRNA sequence
gcctggctcggcccacagca

SEQ ID NO: 5275 - DNA, 20 bp, Artificial
  CRISPR gRNA sequence
aaggtcttctcgcctccctt

SEQ ID NO: 5276 - DNA, 20 bp, Artificial
  CRISPR gRNA sequence
aggtcttctcgcctcccttt

SEQ ID NO: 5277 - DNA, 20 bp, Artificial
  CRISPR gRNA sequence
cctccctttgggtaaatact

SEQ ID NO: 5278 - DNA, 20 bp, Artificial
  CRISPR gRNA sequence
ctccctttgggtaaatactg

SEQ ID NO: 5279 - DNA, 20 bp, Artificial
  CRISPR gRNA sequence
tccctttgggtaaatactga

SEQ ID NO: 5280 - DNA, 20 bp, Artificial
  CRISPR gRNA sequence
ccctttgggtaaatactgag

SEQ ID NO: 5281 - DNA, 20 bp, Artificial
  CRISPR gRNA sequence
aatactgaggggtgcctctg

SEQ ID NO: 5282 - DNA, 20 bp, Artificial
  CRISPR gRNA sequence
atactgaggggtgcctctgc

SEQ ID NO: 5283 - DNA, 20 bp, Artificial
  CRISPR gRNA sequence
tgaggggtgcctctgcagga

SEQ ID NO: 5284 - DNA, 20 bp, Artificial
  CRISPR gRNA sequence
gaggggtgcctctgcaggac

SEQ ID NO: 5285 - DNA, 20 bp, Artificial
  CRISPR gRNA sequence
ctgcaggacgggacctctgc

SEQ ID NO: 5286 - DNA, 20 bp, Artificial
  CRISPR gRNA sequence
gccagactccactccatacc

SEQ ID NO: 5287 - DNA, 20 bp, Artificial
  CRISPR gRNA sequence
cagactccactccataccca

SEQ ID NO: 5288 - DNA, 20 bp, Artificial
  CRISPR gRNA sequence
actccactccatacccagag

SEQ ID NO: 5289 - DNA, 20 bp, Artificial
  CRISPR gRNA sequence
ccactccatacccagagaag

SEQ ID NO: 5290 - DNA, 20 bp, Artificial
  CRISPR gRNA sequence
cactccatacccagagaagc

SEQ ID NO: 5291 - DNA, 20 bp, Artificial
  CRISPR gRNA sequence
actccatacccagagaagca

SEQ ID NO: 5292 - DNA, 20 bp, Artificial
  CRISPR gRNA sequence
agaagcagggaaaccaaaat

SEQ ID NO: 5293 - DNA, 20 bp, Artificial
  CRISPR gRNA sequence
aagcagggaaaccaaaattg

SEQ ID NO: 5294 - DNA, 20 bp, Artificial
  CRISPR gRNA sequence
agggaaaccaaaattggagt

SEQ ID NO: 5295 - DNA, 20 bp, Artificial
  CRISPR gRNA sequence
ccaaaattggagtcagcctt

SEQ ID NO: 5296 - DNA, 20 bp, Artificial
  CRISPR gRNA sequence
caaaattggagtcagccttg

SEQ ID NO: 5297 - DNA, 20 bp, Artificial
  CRISPR gRNA sequence
ttggagtcagccttgaggtg

SEQ ID NO: 5298 - DNA, 20 bp, Artificial
  CRISPR gRNA sequence
agccttgaggtgtagctgtt

SEQ ID NO: 5299 - DNA, 20 bp, Artificial
  CRISPR gRNA sequence
aggtgtagctgttgagccct

SEQ ID NO: 5300 - DNA, 20 bp, Artificial
  CRISPR gRNA sequence
tgtagctgttgagccctcag

SEQ ID NO: 5301 - DNA, 20 bp, Artificial
  CRISPR gRNA sequence
gctgttgagccctcagcagc

SEQ ID NO: 5302 - DNA, 20 bp, Artificial
  CRISPR gRNA sequence
ctgttgagccctcagcagct

SEQ ID NO: 5303 - DNA, 20 bp, Artificial
  CRISPR gRNA sequence
tgttgagccctcagcagctg

SEQ ID NO: 5304 - DNA, 20 bp, Artificial
  CRISPR gRNA sequence
ttgagccctcagcagctggg

SEQ ID NO: 5305 - DNA, 20 bp, Artificial
  CRISPR gRNA sequence
gagccctcagcagctgggga

SEQ ID NO: 5306 - DNA, 20 bp, Artificial
  CRISPR gRNA sequence
cctcagcagctggggagagc

SEQ ID NO: 5307 - DNA, 20 bp, Artificial
  CRISPR gRNA sequence
cagcagctggggagagctgg

SEQ ID NO: 5308 - DNA, 20 bp, Artificial
  CRISPR gRNA sequence
ggcggatgctgccctccccc

SEQ ID NO: 5309 - DNA, 20 bp, Artificial
  CRISPR gRNA sequence
ccctccccccagtttcctaa

SEQ ID NO: 5310 - DNA, 20 bp, Artificial
  CRISPR gRNA sequence
tcctaatggtgttgtttaaa

SEQ ID NO: 5311 - DNA, 20 bp, Artificial
  CRISPR gRNA sequence
cctaatggtgttgtttaaaa

SEQ ID NO: 5312 - DNA, 20 bp, Artificial
  CRISPR gRNA sequence
ctaatggtgttgtttaaaaa

SEQ ID NO: 5313 - DNA, 20 bp, Artificial
  CRISPR gRNA sequence
tggtgttgtttaaaaagggt

SEQ ID NO: 5314 - DNA, 20 bp, Artificial
  CRISPR gRNA sequence
ggtgttgtttaaaaagggtc

SEQ ID NO: 5315 - DNA, 20 bp, Artificial
  CRISPR gRNA sequence
gtgttgtttaaaaagggtca

SEQ ID NO: 5316 - DNA, 20 bp, Artificial
  CRISPR gRNA sequence
tgttgtttaaaaagggtcag

SEQ ID NO: 5317 - DNA, 20 bp, Artificial
  CRISPR gRNA sequence
gtttaaaaagggtcagggga

SEQ ID NO: 5318 - DNA, 20 bp, Artificial
  CRISPR gRNA sequence
tttaaaaagggtcaggggac

SEQ ID NO: 5319 - DNA, 20 bp, Artificial
  CRISPR gRNA sequence
ttaaaaagggtcaggggacg

SEQ ID NO: 5320 - DNA, 20 bp, Artificial
  CRISPR gRNA sequence
taaaaagggtcaggggacgg

SEQ ID NO: 5321 - DNA, 20 bp, Artificial
  CRISPR gRNA sequence
agggtcaggggacgggggaa

SEQ ID NO: 5322 - DNA, 20 bp, Artificial
  CRISPR gRNA sequence
tcaggggacgggggaacaga

SEQ ID NO: 5323 - DNA, 20 bp, Artificial
  CRISPR gRNA sequence
ggggacgggggaacagatgg

SEQ ID NO: 5324 - DNA, 20 bp, Artificial
  CRISPR gRNA sequence
gggacgggggaacagatggt

SEQ ID NO: 5325 - DNA, 20 bp, Artificial
  CRISPR gRNA sequence
acgggggaacagatggtggg

SEQ ID NO: 5326 - DNA, 20 bp, Artificial
  CRISPR gRNA sequence
gggggaacagatggtgggaa

SEQ ID NO: 5327 - DNA, 20 bp, Artificial
  CRISPR gRNA sequence
aacagatggtgggaagagca

SEQ ID NO: 5328 - DNA, 20 bp, Artificial
  CRISPR gRNA sequence
atggtgggaagagcacagtg

SEQ ID NO: 5329 - DNA, 20 bp, Artificial
  CRISPR gRNA sequence
aagagcacagtgcagacacc

SEQ ID NO: 5330 - DNA, 20 bp, Artificial
  CRISPR gRNA sequence
acagtgcagacacctggcac

SEQ ID NO: 5331 - DNA, 20 bp, Artificial
  CRISPR gRNA sequence
gacacctggcaccggctctg

SEQ ID NO: 5332 - DNA, 20 bp, Artificial
  CRISPR gRNA sequence
acacctggcaccggctctga

SEQ ID NO: 5333 - DNA, 20 bp, Artificial
  CRISPR gRNA sequence
cctggcaccggctctgaagg

SEQ ID NO: 5334 - DNA, 20 bp, Artificial
  CRISPR gRNA sequence
caccggctctgaaggcagca

SEQ ID NO: 5335 - DNA, 20 bp, Artificial
  CRISPR gRNA sequence
cggctctgaaggcagcatgg

SEQ ID NO: 5336 - DNA, 20 bp, Artificial
  CRISPR gRNA sequence
cagcatggcagctacaccgt

SEQ ID NO: 5337 - DNA, 20 bp, Artificial
  CRISPR gRNA sequence
atggcagctacaccgttggc

SEQ ID NO: 5338 - DNA, 20 bp, Artificial
  CRISPR gRNA sequence
tggcagctacaccgttggct

SEQ ID NO: 5339 - DNA, 20 bp, Artificial
  CRISPR gRNA sequence
cagctacaccgttggctggg

SEQ ID NO: 5340 - DNA, 20 bp, Artificial
  CRISPR gRNA sequence
agctacaccgttggctggga

SEQ ID NO: 5341 - DNA, 20 bp, Artificial
  CRISPR gRNA sequence
gctacaccgttggctgggaa

SEQ ID NO: 5342 - DNA, 20 bp, Artificial
  CRISPR gRNA sequence
ctgggaagggtgtgcccctg

SEQ ID NO: 5343 - DNA, 20 bp, Artificial
  CRISPR gRNA sequence
ggaagggtgtgcccctgaag

SEQ ID NO: 5344 - DNA, 20 bp, Artificial
  CRISPR gRNA sequence
aagaagtcgtttacattctc

SEQ ID NO: 5345 - DNA, 20 bp, Artificial
  CRISPR gRNA sequence
cattctcgagtcaattttcc

SEQ ID NO: 5346 - DNA, 20 bp, Artificial
  CRISPR gRNA sequence
ttctcgagtcaattttcctg

SEQ ID NO: 5347 - DNA, 20 bp, Artificial
  CRISPR gRNA sequence
aattttcctggagtgtacaa

SEQ ID NO: 5348 - DNA, 20 bp, Artificial
  CRISPR gRNA sequence
tggagtgtacaatggacctg

SEQ ID NO: 5349 - DNA, 20 bp, Artificial
  CRISPR gRNA sequence
ggagtgtacaatggacctgt

SEQ ID NO: 5350 - DNA, 20 bp, Artificial
  CRISPR gRNA sequence
tgtacaatggacctgtggga

SEQ ID NO: 5351 - DNA, 20 bp, Artificial
  CRISPR gRNA sequence
ctgtgggaaagcctgtatga

SEQ ID NO: 5352 - DNA, 20 bp, Artificial
  CRISPR gRNA sequence
tgtgggaaagcctgtatgaa

SEQ ID NO: 5353 - DNA, 20 bp, Artificial
  CRISPR gRNA sequence
gtgggaaagcctgtatgaaa

SEQ ID NO: 5354 - DNA, 20 bp, Artificial
  CRISPR gRNA sequence
ctgtatgaaagggtaatgat

SEQ ID NO: 5355 - DNA, 20 bp, Artificial
  CRISPR gRNA sequence
tgtatgaaagggtaatgatg

SEQ ID NO: 5356 - DNA, 20 bp, Artificial
  CRISPR gRNA sequence
gtatgaaagggtaatgatga

SEQ ID NO: 5357 - DNA, 20 bp, Artificial
  CRISPR gRNA sequence
aagggtaatgatgagggacc

SEQ ID NO: 5358 - DNA, 20 bp, Artificial
  CRISPR gRNA sequence
taatgatgagggacctagca

SEQ ID NO: 5359 - DNA, 20 bp, Artificial
  CRISPR gRNA sequence
gcacagtgtccaatatttta

SEQ ID NO: 5360 - DNA, 20 bp, Artificial
  CRISPR gRNA sequence
cacagtgtccaatattttat

SEQ ID NO: 5361 - DNA, 20 bp, Artificial
  CRISPR gRNA sequence
gtccaatattttataggaac

SEQ ID NO: 5362 - DNA, 20 bp, Artificial
  CRISPR gRNA sequence
attttataggaactggaatt

SEQ ID NO: 5363 - DNA, 20 bp, Artificial
  CRISPR gRNA sequence
aggaactggaattgagctca

SEQ ID NO: 5364 - DNA, 20 bp, Artificial
  CRISPR gRNA sequence
ggaactggaattgagctcat

SEQ ID NO: 5365 - DNA, 20 bp, Artificial
  CRISPR gRNA sequence
aactggaattgagctcatag

SEQ ID NO: 5366 - DNA, 20 bp, Artificial
  CRISPR gRNA sequence
tcataggagctcaattttat

SEQ ID NO: 5367 - DNA, 20 bp, Artificial
  CRISPR gRNA sequence
tttattggcattgctgttgt

SEQ ID NO: 5368 - DNA, 20 bp, Artificial
  CRISPR gRNA sequence
ttggcattgctgttgttgga

SEQ ID NO: 5369 - DNA, 20 bp, Artificial
  CRISPR gRNA sequence
ttgctgttgttggatggtta

SEQ ID NO: 5370 - DNA, 20 bp, Artificial
  CRISPR gRNA sequence
tgctgttgttggatggttaa

SEQ ID NO: 5371 - DNA, 20 bp, Artificial
  CRISPR gRNA sequence
gctgttgttggatggttaaa

SEQ ID NO: 5372 - DNA, 20 bp, Artificial
  CRISPR gRNA sequence
ctgttgttggatggttaaag

SEQ ID NO: 5373 - DNA, 20 bp, Artificial
  CRISPR gRNA sequence
ttgttggatggttaaagggg

SEQ ID NO: 5374 - DNA, 20 bp, Artificial
  CRISPR gRNA sequence
aggggtggtatcccttttct

SEQ ID NO: 5375 - DNA, 20 bp, Artificial
  CRISPR gRNA sequence
tcagactcccctgaaatgta

SEQ ID NO: 5376 - DNA, 20 bp, Artificial
  CRISPR gRNA sequence
tgtatggtttgctttgaacc

SEQ ID NO: 5377 - DNA, 20 bp, Artificial
  CRISPR gRNA sequence
tatggtttgctttgaaccca

SEQ ID NO: 5378 - DNA, 20 bp, Artificial
  CRISPR gRNA sequence
ttgaacccagagactgatga

SEQ ID NO: 5379 - DNA, 20 bp, Artificial
  CRISPR gRNA sequence
tgaacccagagactgatgac

SEQ ID NO: 5380 - DNA, 20 bp, Artificial
  CRISPR gRNA sequence
gagactgatgacaggtctgc

SEQ ID NO: 5381 - DNA, 20 bp, Artificial
  CRISPR gRNA sequence
tgatgacaggtctgccggtg

SEQ ID NO: 5382 - DNA, 20 bp, Artificial
  CRISPR gRNA sequence
gacaggtctgccggtgtggt

SEQ ID NO: 5383 - DNA, 20 bp, Artificial
  CRISPR gRNA sequence
acaggtctgccggtgtggtt

SEQ ID NO: 5384 - DNA, 20 bp, Artificial
  CRISPR gRNA sequence
tctgccggtgtggttgggtg

SEQ ID NO: 5385 - DNA, 20 bp, Artificial
  CRISPR gRNA sequence
gtgtggttgggtgcagcctt

SEQ ID NO: 5386 - DNA, 20 bp, Artificial
  CRISPR gRNA sequence
ggtgcagccttaagttgcta

SEQ ID NO: 5387 - DNA, 20 bp, Artificial
  CRISPR gRNA sequence
gtgcagccttaagttgctac

SEQ ID NO: 5388 - DNA, 20 bp, Artificial
  CRISPR gRNA sequence
agccttaagttgctacggga

SEQ ID NO: 5389 - DNA, 20 bp, Artificial
  CRISPR gRNA sequence
aagttgctacgggaaagtgt

SEQ ID NO: 5390 - DNA, 20 bp, Artificial
  CRISPR gRNA sequence
gttgctacgggaaagtgttg

SEQ ID NO: 5391 - DNA, 20 bp, Artificial
  CRISPR gRNA sequence
ttgctacgggaaagtgttgg

SEQ ID NO: 5392 - DNA, 20 bp, Artificial
  CRISPR gRNA sequence
tgctacgggaaagtgttgga

SEQ ID NO: 5393 - DNA, 20 bp, Artificial
  CRISPR gRNA sequence
gctacgggaaagtgttggag

SEQ ID NO: 5394 - DNA, 20 bp, Artificial
  CRISPR gRNA sequence
ctacgggaaagtgttggagg

SEQ ID NO: 5395 - DNA, 20 bp, Artificial
  CRISPR gRNA sequence
acgggaaagtgttggagggg

SEQ ID NO: 5396 - DNA, 20 bp, Artificial
  CRISPR gRNA sequence
ggaaagtgttggagggggag

SEQ ID NO: 5397 - DNA, 20 bp, Artificial
  CRISPR gRNA sequence
agtgttggagggggagaagt

SEQ ID NO: 5398 - DNA, 20 bp, Artificial
  CRISPR gRNA sequence
tgttggagggggagaagtca

SEQ ID NO: 5399 - DNA, 20 bp, Artificial
  CRISPR gRNA sequence
gttggagggggagaagtcag

SEQ ID NO: 5400 - DNA, 20 bp, Artificial
  CRISPR gRNA sequence
cttgccccctccctcaattc

SEQ ID NO: 5401 - DNA, 20 bp, Artificial
  CRISPR gRNA sequence
cccctccctcaattccagat

SEQ ID NO: 5402 - DNA, 20 bp, Artificial
  CRISPR gRNA sequence
ccctccctcaattccagatg

SEQ ID NO: 5403 - DNA, 20 bp, Artificial
  CRISPR gRNA sequence
caattccagatgaggaaatt

SEQ ID NO: 5404 - DNA, 20 bp, Artificial
  CRISPR gRNA sequence
aattccagatgaggaaattc

SEQ ID NO: 5405 - DNA, 20 bp, Artificial
  CRISPR gRNA sequence
tgaggaaattcaggcctgaa

SEQ ID NO: 5406 - DNA, 20 bp, Artificial
  CRISPR gRNA sequence
gaggaaattcaggcctgaaa

SEQ ID NO: 5407 - DNA, 20 bp, Artificial
  CRISPR gRNA sequence
aggaaattcaggcctgaaaa

SEQ ID NO: 5408 - DNA, 20 bp, Artificial
  CRISPR gRNA sequence
aattcaggcctgaaaaggga

SEQ ID NO: 5409 - DNA, 20 bp, Artificial
  CRISPR gRNA sequence
aagggaaagtgaccacctca

SEQ ID NO: 5410 - DNA, 20 bp, Artificial
  CRISPR gRNA sequence
cacctcaaagtctcatgcct

SEQ ID NO: 5411 - DNA, 20 bp, Artificial
  CRISPR gRNA sequence
cctcaaagtctcatgccttg

SEQ ID NO: 5412 - DNA, 20 bp, Artificial
  CRISPR gRNA sequence
ctcaaagtctcatgccttgg

SEQ ID NO: 5413 - DNA, 20 bp, Artificial
  CRISPR gRNA sequence
gtctcatgccttggaggacc

SEQ ID NO: 5414 - DNA, 20 bp, Artificial
  CRISPR gRNA sequence
tcatgccttggaggacccag

SEQ ID NO: 5415 - DNA, 20 bp, Artificial
  CRISPR gRNA sequence
catgccttggaggacccagc

SEQ ID NO: 5416 - DNA, 20 bp, Artificial
  CRISPR gRNA sequence
ggaggacccagcaggaatcc

SEQ ID NO: 5417 - DNA, 20 bp, Artificial
  CRISPR gRNA sequence
aggaatccaagacctctgaa

SEQ ID NO: 5418 - DNA, 20 bp, Artificial
  CRISPR gRNA sequence
ggaatccaagacctctgaaa

SEQ ID NO: 5419 - DNA, 20 bp, Artificial
  CRISPR gRNA sequence
ccaagacctctgaaaaggac

SEQ ID NO: 5420 - DNA, 20 bp, Artificial
  CRISPR gRNA sequence
agacctctgaaaaggaccgg

SEQ ID NO: 5421 - DNA, 20 bp, Artificial
  CRISPR gRNA sequence
gacctctgaaaaggaccggc

SEQ ID NO: 5422 - DNA, 20 bp, Artificial
  CRISPR gRNA sequence
acctctgaaaaggaccggca

SEQ ID NO: 5423 - DNA, 20 bp, Artificial
  CRISPR gRNA sequence
gaccggcagggctcttgcca

SEQ ID NO: 5424 - DNA, 20 bp, Artificial
  CRISPR gRNA sequence
ggcagggctcttgccacggc

SEQ ID NO: 5425 - DNA, 20 bp, Artificial
  CRISPR gRNA sequence
gcagggctcttgccacggct

SEQ ID NO: 5426 - DNA, 20 bp, Artificial
  CRISPR gRNA sequence
cagggctcttgccacggctg

SEQ ID NO: 5427 - DNA, 20 bp, Artificial
  CRISPR gRNA sequence
agggctcttgccacggctgg

SEQ ID NO: 5428 - DNA, 20 bp, Artificial
  CRISPR gRNA sequence
tcttgccacggctgggggtg

SEQ ID NO: 5429 - DNA, 20 bp, Artificial
  CRISPR gRNA sequence
cacggctgggggtgtggtca

SEQ ID NO: 5430 - DNA, 20 bp, Artificial
  CRISPR gRNA sequence
ggggtgtggtcatggtaaca

SEQ ID NO: 5431 - DNA, 20 bp, Artificial
  CRISPR gRNA sequence
gggtgtggtcatggtaacac

SEQ ID NO: 5432 - DNA, 20 bp, Artificial
  CRISPR gRNA sequence
taacacaggttttccatcca

SEQ ID NO: 5433 - DNA, 20 bp, Artificial
  CRISPR gRNA sequence
cacaggttttccatccatgg

SEQ ID NO: 5434 - DNA, 20 bp, Artificial
  CRISPR gRNA sequence
acaggttttccatccatgga

SEQ ID NO: 5435 - DNA, 20 bp, Artificial
  CRISPR gRNA sequence
tccatccatggaaggtacct

SEQ ID NO: 5436 - DNA, 20 bp, Artificial
  CRISPR gRNA sequence
ccatccatggaaggtacctg

SEQ ID NO: 5437 - DNA, 20 bp, Artificial
  CRISPR gRNA sequence
catccatggaaggtacctga

SEQ ID NO: 5438 - DNA, 20 bp, Artificial
  CRISPR gRNA sequence
agggattttctcttcctccc

SEQ ID NO: 5439 - DNA, 20 bp, Artificial
  CRISPR gRNA sequence
gggattttctcttcctccct

SEQ ID NO: 5440 - DNA, 20 bp, Artificial
  CRISPR gRNA sequence
ggattttctcttcctcccta

SEQ ID NO: 5441 - DNA, 20 bp, Artificial
  CRISPR gRNA sequence
tttctcttcctccctagggc

SEQ ID NO: 5442 - DNA, 20 bp, Artificial
  CRISPR gRNA sequence
ttcctccctagggccagcat

SEQ ID NO: 5443 - DNA, 20 bp, Artificial
  CRISPR gRNA sequence
cctccctagggccagcatca

SEQ ID NO: 5444 - DNA, 20 bp, Artificial
  CRISPR gRNA sequence
ctccctagggccagcatcag

SEQ ID NO: 5445 - DNA, 20 bp, Artificial
  CRISPR gRNA sequence
ccctagggccagcatcagag

SEQ ID NO: 5446 - DNA, 20 bp, Artificial
  CRISPR gRNA sequence
gccagcatcagaggagtgaa

SEQ ID NO: 5447 - DNA, 20 bp, Artificial
  CRISPR gRNA sequence
catcagaggagtgaatagct

SEQ ID NO: 5448 - DNA, 20 bp, Artificial
  CRISPR gRNA sequence
agaggagtgaatagctcagt

SEQ ID NO: 5449 - DNA, 20 bp, Artificial
  CRISPR gRNA sequence
atagctcagttagctcatct

SEQ ID NO: 5450 - DNA, 20 bp, Artificial
  CRISPR gRNA sequence
tagctcagttagctcatctc

SEQ ID NO: 5451 - DNA, 20 bp, Artificial
  CRISPR gRNA sequence
agctcagttagctcatctca

SEQ ID NO: 5452 - DNA, 20 bp, Artificial
  CRISPR gRNA sequence
gctcagttagctcatctcag

SEQ ID NO: 5453 - DNA, 20 bp, Artificial
  CRISPR gRNA sequence
tctcaggggccatgtgccct

SEQ ID NO: 5454 - DNA, 20 bp, Artificial
  CRISPR gRNA sequence
tcaggggccatgtgccctcg

SEQ ID NO: 5455 - DNA, 20 bp, Artificial
  CRISPR gRNA sequence
caggggccatgtgccctcgg

SEQ ID NO: 5456 - DNA, 20 bp, Artificial
  CRISPR gRNA sequence
gggccatgtgccctcggagg

SEQ ID NO: 5457 - DNA, 20 bp, Artificial
  CRISPR gRNA sequence
gaggtggtttgccactttca

SEQ ID NO: 5458 - DNA, 20 bp, Artificial
  CRISPR gRNA sequence
tggtttgccactttcacggt

SEQ ID NO: 5459 - DNA, 20 bp, Artificial
  CRISPR gRNA sequence
gccactttcacggttggact

SEQ ID NO: 5460 - DNA, 20 bp, Artificial
  CRISPR gRNA sequence
ctttcacggttggactgagt

SEQ ID NO: 5461 - DNA, 20 bp, Artificial
  CRISPR gRNA sequence
ttcacggttggactgagttg

SEQ ID NO: 5462 - DNA, 20 bp, Artificial
  CRISPR gRNA sequence
cacggttggactgagttgga

SEQ ID NO: 5463 - DNA, 20 bp, Artificial
  CRISPR gRNA sequence
tggactgagttggagagaaa

SEQ ID NO: 5464 - DNA, 20 bp, Artificial
  CRISPR gRNA sequence
gactgagttggagagaaaca

SEQ ID NO: 5465 - DNA, 20 bp, Artificial
  CRISPR gRNA sequence
gagagaaacagagacccacc

SEQ ID NO: 5466 - DNA, 20 bp, Artificial
  CRISPR gRNA sequence
agagaaacagagacccaccc

SEQ ID NO: 5467 - DNA, 20 bp, Artificial
  CRISPR gRNA sequence
gagaaacagagacccaccca

SEQ ID NO: 5468 - DNA, 20 bp, Artificial
  CRISPR gRNA sequence
agaaacagagacccacccag

SEQ ID NO: 5469 - DNA, 20 bp, Artificial
  CRISPR gRNA sequence
aacagagacccacccagggg

SEQ ID NO: 5470 - DNA, 20 bp, Artificial
  CRISPR gRNA sequence
acagagacccacccaggggt

SEQ ID NO: 5471 - DNA, 20 bp, Artificial
  CRISPR gRNA sequence
cagagacccacccaggggtg

SEQ ID NO: 5472 - DNA, 20 bp, Artificial
  CRISPR gRNA sequence
acccacccaggggtggggac

SEQ ID NO: 5473 - DNA, 20 bp, Artificial
  CRISPR gRNA sequence
gggacaagctccctgcaact

SEQ ID NO: 5474 - DNA, 20 bp, Artificial
  CRISPR gRNA sequence
ggacaagctccctgcaactc

SEQ ID NO: 5475 - DNA, 20 bp, Artificial
  CRISPR gRNA sequence
tccctgcaactcaggacttg

SEQ ID NO: 5476 - DNA, 20 bp, Artificial
  CRISPR gRNA sequence
gacttgcagatcacttgccc

SEQ ID NO: 5477 - DNA, 20 bp, Artificial
  CRISPR gRNA sequence
ttgcagatcacttgcccaag

SEQ ID NO: 5478 - DNA, 20 bp, Artificial
  CRISPR gRNA sequence
cacttgcccaagtggctccc

SEQ ID NO: 5479 - DNA, 20 bp, Artificial
  CRISPR gRNA sequence
ccaagtggctccctagctcc

SEQ ID NO: 5480 - DNA, 20 bp, Artificial
  CRISPR gRNA sequence
gctccctagctcctggctcc

SEQ ID NO: 5481 - DNA, 20 bp, Artificial
  CRISPR gRNA sequence
ctagctcctggctcctggcc

SEQ ID NO: 5482 - DNA, 20 bp, Artificial
  CRISPR gRNA sequence
tagctcctggctcctggccc

SEQ ID NO: 5483 - DNA, 20 bp, Artificial
  CRISPR gRNA sequence
agctcctggctcctggcccg

SEQ ID NO: 5484 - DNA, 20 bp, Artificial
  CRISPR gRNA sequence
ctggctcctggcccggggcc

SEQ ID NO: 5485 - DNA, 20 bp, Artificial
  CRISPR gRNA sequence
tggctcctggcccggggcct

SEQ ID NO: 5486 - DNA, 20 bp, Artificial
  CRISPR gRNA sequence
ggggcctgggactctccccg

SEQ ID NO: 5487 - DNA, 20 bp, Artificial
  CRISPR gRNA sequence
gcctgggactctccccgaag

SEQ ID NO: 5488 - DNA, 20 bp, Artificial
  CRISPR gRNA sequence
cctgggactctccccgaagt

SEQ ID NO: 5489 - DNA, 20 bp, Artificial
  CRISPR gRNA sequence
ctgggactctccccgaagtg

SEQ ID NO: 5490 - DNA, 20 bp, Artificial
  CRISPR gRNA sequence
gactctccccgaagtggggc

SEQ ID NO: 5491 - DNA, 20 bp, Artificial
  CRISPR gRNA sequence
gaagtggggctggccactgt

SEQ ID NO: 5492 - DNA, 20 bp, Artificial
  CRISPR gRNA sequence
aagtggggctggccactgtg

SEQ ID NO: 5493 - DNA, 20 bp, Artificial
  CRISPR gRNA sequence
ggccactgtgaggaaccgac

SEQ ID NO: 5494 - DNA, 20 bp, Artificial
  CRISPR gRNA sequence
ccactgtgaggaaccgactg

SEQ ID NO: 5495 - DNA, 20 bp, Artificial
  CRISPR gRNA sequence
cactgtgaggaaccgactgg

SEQ ID NO: 5496 - DNA, 20 bp, Artificial
  CRISPR gRNA sequence
tgtgaggaaccgactggagg

SEQ ID NO: 5497 - DNA, 20 bp, Artificial
  CRISPR gRNA sequence
gtgaggaaccgactggaggc

SEQ ID NO: 5498 - DNA, 20 bp, Artificial
  CRISPR gRNA sequence
tgaggaaccgactggaggca

SEQ ID NO: 5499 - DNA, 20 bp, Artificial
  CRISPR gRNA sequence
gactggaggcagggacctct

SEQ ID NO: 5500 - DNA, 20 bp, Artificial
  CRISPR gRNA sequence
cagggacctcttggatgccc

SEQ ID NO: 5501 - DNA, 20 bp, Artificial
  CRISPR gRNA sequence
agggacctcttggatgcccc

SEQ ID NO: 5502 - DNA, 20 bp, Artificial
  CRISPR gRNA sequence
gacctcttggatgccccagg

SEQ ID NO: 5503 - DNA, 20 bp, Artificial
  CRISPR gRNA sequence
tcttggatgccccaggcagt

SEQ ID NO: 5504 - DNA, 20 bp, Artificial
  CRISPR gRNA sequence
cttggatgccccaggcagtt

SEQ ID NO: 5505 - DNA, 20 bp, Artificial
  CRISPR gRNA sequence
ttgggatgccacttctgata

SEQ ID NO: 5506 - DNA, 20 bp, Artificial
  CRISPR gRNA sequence
gccacttctgataaagcacg

SEQ ID NO: 5507 - DNA, 20 bp, Artificial
  CRISPR gRNA sequence
acttctgataaagcacgtgg

SEQ ID NO: 5508 - DNA, 20 bp, Artificial
  CRISPR gRNA sequence
gataaagcacgtggtggcca

SEQ ID NO: 5509 - DNA, 20 bp, Artificial
  CRISPR gRNA sequence
aaagcacgtggtggccacag

SEQ ID NO: 5510 - DNA, 20 bp, Artificial
  CRISPR gRNA sequence
aagcacgtggtggccacagt

SEQ ID NO: 5511 - DNA, 20 bp, Artificial
  CRISPR gRNA sequence
tggtggccacagtaggtgct

SEQ ID NO: 5512 - DNA, 20 bp, Artificial
  CRISPR gRNA sequence
gtaggtgcttggttgctcca

SEQ ID NO: 5513 - DNA, 20 bp, Artificial
  CRISPR gRNA sequence
tgcttggttgctccacagcc

SEQ ID NO: 5514 - DNA, 20 bp, Artificial
  CRISPR gRNA sequence
gttgctccacagcctggccc

SEQ ID NO: 5515 - DNA, 20 bp, Artificial
  CRISPR gRNA sequence
tccacagcctggcccgagct

SEQ ID NO: 5516 - DNA, 20 bp, Artificial
  CRISPR gRNA sequence
ctggcccgagctcagcgctg

SEQ ID NO: 5517 - DNA, 20 bp, Artificial
  CRISPR gRNA sequence
cccgagctcagcgctgcaga

SEQ ID NO: 5518 - DNA, 20 bp, Artificial
  CRISPR gRNA sequence
agctcagcgctgcagaaaga

SEQ ID NO: 5519 - DNA, 20 bp, Artificial
  CRISPR gRNA sequence
gcgctgcagaaagaaagtga

SEQ ID NO: 5520 - DNA, 20 bp, Artificial
  CRISPR gRNA sequence
cgctgcagaaagaaagtgaa

SEQ ID NO: 5521 - DNA, 20 bp, Artificial
  CRISPR gRNA sequence
gctgcagaaagaaagtgaaa

SEQ ID NO: 5522 - DNA, 20 bp, Artificial
  CRISPR gRNA sequence
gaaagaaagtgaaagggaaa

SEQ ID NO: 5523 - DNA, 20 bp, Artificial
  CRISPR gRNA sequence
gtgaaagggaaaaagaactg

SEQ ID NO: 5524 - DNA, 20 bp, Artificial
  CRISPR gRNA sequence
tgaaagggaaaaagaactgc

SEQ ID NO: 5525 - DNA, 20 bp, Artificial
  CRISPR gRNA sequence
gaaagggaaaaagaactgcg

SEQ ID NO: 5526 - DNA, 20 bp, Artificial
  CRISPR gRNA sequence
aagggaaaaagaactgcggg

SEQ ID NO: 5527 - DNA, 20 bp, Artificial
  CRISPR gRNA sequence
agggaaaaagaactgcgggg

SEQ ID NO: 5528 - DNA, 20 bp, Artificial
  CRISPR gRNA sequence
gaaaaagaactgcggggagg

SEQ ID NO: 5529 - DNA, 20 bp, Artificial
  CRISPR gRNA sequence
aaaaagaactgcggggaggc

SEQ ID NO: 5530 - DNA, 20 bp, Artificial
  CRISPR gRNA sequence
aaaagaactgcggggaggcg

SEQ ID NO: 5531 - DNA, 20 bp, Artificial
  CRISPR gRNA sequence
aagaactgcggggaggcggg

SEQ ID NO: 5532 - DNA, 20 bp, Artificial
  CRISPR gRNA sequence
agaactgcggggaggcgggg

SEQ ID NO: 5533 - DNA, 20 bp, Artificial
  CRISPR gRNA sequence
actgcggggaggcggggagg

SEQ ID NO: 5534 - DNA, 20 bp, Artificial
  CRISPR gRNA sequence
ctgcggggaggcggggaggt

SEQ ID NO: 5535 - DNA, 20 bp, Artificial
  CRISPR gRNA sequence
aggcggggaggtaggatgac

SEQ ID NO: 5536 - DNA, 20 bp, Artificial
  CRISPR gRNA sequence
cggggaggtaggatgaccag

SEQ ID NO: 5537 - DNA, 20 bp, Artificial
  CRISPR gRNA sequence
aggtaggatgaccagcggac

SEQ ID NO: 5538 - DNA, 20 bp, Artificial
  CRISPR gRNA sequence
gaccagcggacgagctgcca

SEQ ID NO: 5539 - DNA, 20 bp, Artificial
  CRISPR gRNA sequence
gagctgccacagacttgccg

SEQ ID NO: 5540 - DNA, 20 bp, Artificial
  CRISPR gRNA sequence
ccacagacttgccgcggccc

SEQ ID NO: 5541 - DNA, 20 bp, Artificial
  CRISPR gRNA sequence
acagacttgccgcggcccca

SEQ ID NO: 5542 - DNA, 20 bp, Artificial
  CRISPR gRNA sequence
acttgccgcggccccagagc

SEQ ID NO: 5543 - DNA, 20 bp, Artificial
  CRISPR gRNA sequence
tgccgcggccccagagctgg

SEQ ID NO: 5544 - DNA, 20 bp, Artificial
  CRISPR gRNA sequence
gccgcggccccagagctggc

SEQ ID NO: 5545 - DNA, 20 bp, Artificial
  CRISPR gRNA sequence
cgcggccccagagctggcgg

SEQ ID NO: 5546 - DNA, 20 bp, Artificial
  CRISPR gRNA sequence
gcggccccagagctggcggg

SEQ ID NO: 5547 - DNA, 20 bp, Artificial
  CRISPR gRNA sequence
cggccccagagctggcggga

SEQ ID NO: 5548 - DNA, 20 bp, Artificial
  CRISPR gRNA sequence
gccccagagctggcgggagg

SEQ ID NO: 5549 - DNA, 20 bp, Artificial
  CRISPR gRNA sequence
cccagagctggcgggaggga

SEQ ID NO: 5550 - DNA, 20 bp, Artificial
  CRISPR gRNA sequence
ccagagctggcgggagggag

SEQ ID NO: 5551 - DNA, 20 bp, Artificial
  CRISPR gRNA sequence
tggcgggagggagaggccac

SEQ ID NO: 5552 - DNA, 20 bp, Artificial
  CRISPR gRNA sequence
cgggagggagaggccaccag

SEQ ID NO: 5553 - DNA, 20 bp, Artificial
  CRISPR gRNA sequence
gaggccaccagcagcgcgcg

SEQ ID NO: 5554 - DNA, 20 bp, Artificial
  CRISPR gRNA sequence
aggccaccagcagcgcgcgc

SEQ ID NO: 5555 - DNA, 20 bp, Artificial
  CRISPR gRNA sequence
gccaccagcagcgcgcgcgg

SEQ ID NO: 5556 - DNA, 20 bp, Artificial
  CRISPR gRNA sequence
cagcagcgcgcgcgggagcc

SEQ ID NO: 5557 - DNA, 20 bp, Artificial
  CRISPR gRNA sequence
agcagcgcgcgcgggagccc

SEQ ID NO: 5558 - DNA, 20 bp, Artificial
  CRISPR gRNA sequence
gcagcgcgcgcgggagcccg

SEQ ID NO: 5559 - DNA, 20 bp, Artificial
  CRISPR gRNA sequence
gcgcgcgggagcccggggaa

SEQ ID NO: 5560 - DNA, 20 bp, Artificial
  CRISPR gRNA sequence
cgcgggagcccggggaacag

SEQ ID NO: 5561 - DNA, 20 bp, Artificial
  CRISPR gRNA sequence
gggagcccggggaacagcgg

SEQ ID NO: 5562 - DNA, 20 bp, Artificial
  CRISPR gRNA sequence
ggagcccggggaacagcggt

SEQ ID NO: 5563 - DNA, 20 bp, Artificial
  CRISPR gRNA sequence
ggaacagcggtaggtgacca

SEQ ID NO: 5564 - DNA, 20 bp, Artificial
  CRISPR gRNA sequence
aagtctcctctgtaacccct

SEQ ID NO: 5565 - DNA, 20 bp, Artificial
  CRISPR gRNA sequence
agtctcctctgtaaccccta

SEQ ID NO: 5566 - DNA, 20 bp, Artificial
  CRISPR gRNA sequence
tcctctgtaacccctaaggt

SEQ ID NO: 5567 - DNA, 20 bp, Artificial
  CRISPR gRNA sequence
cctctgtaacccctaaggtc

SEQ ID NO: 5568 - DNA, 20 bp, Artificial
  CRISPR gRNA sequence
gtaacccctaaggtcgggct

SEQ ID NO: 5569 - DNA, 20 bp, Artificial
  CRISPR gRNA sequence
ctaaggtcgggctgagaatc

SEQ ID NO: 5570 - DNA, 20 bp, Artificial
  CRISPR gRNA sequence
taaggtcgggctgagaatcg

SEQ ID NO: 5571 - DNA, 20 bp, Artificial
  CRISPR gRNA sequence
gggctgagaatcgaggctcc

SEQ ID NO: 5572 - DNA, 20 bp, Artificial
  CRISPR gRNA sequence
aatcgaggctccgagactgt

SEQ ID NO: 5573 - DNA, 20 bp, Artificial
  CRISPR gRNA sequence
agactgtcagctacttgctc

SEQ ID NO: 5574 - DNA, 20 bp, Artificial
  CRISPR gRNA sequence
gactgtcagctacttgctca

SEQ ID NO: 5575 - DNA, 20 bp, Artificial
  CRISPR gRNA sequence
gctacttgctcaaggtcaca

SEQ ID NO: 5576 - DNA, 20 bp, Artificial
  CRISPR gRNA sequence
cttgctcaaggtcacacagc

SEQ ID NO: 5577 - DNA, 20 bp, Artificial
  CRISPR gRNA sequence
tcaaggtcacacagcaagtc

SEQ ID NO: 5578 - DNA, 20 bp, Artificial
  CRISPR gRNA sequence
caaggtcacacagcaagtct

SEQ ID NO: 5579 - DNA, 20 bp, Artificial
  CRISPR gRNA sequence
aggtcacacagcaagtctgg

SEQ ID NO: 5580 - DNA, 20 bp, Artificial
  CRISPR gRNA sequence
ggtcacacagcaagtctggg

SEQ ID NO: 5581 - DNA, 20 bp, Artificial
  CRISPR gRNA sequence
acacagcaagtctgggagga

SEQ ID NO: 5582 - DNA, 20 bp, Artificial
  CRISPR gRNA sequence
cacagcaagtctgggaggat

SEQ ID NO: 5583 - DNA, 20 bp, Artificial
  CRISPR gRNA sequence
acagcaagtctgggaggatg

SEQ ID NO: 5584 - DNA, 20 bp, Artificial
  CRISPR gRNA sequence
cagcaagtctgggaggatgg

SEQ ID NO: 5585 - DNA, 20 bp, Artificial
  CRISPR gRNA sequence
agcaagtctgggaggatggg

SEQ ID NO: 5586 - DNA, 20 bp, Artificial
  CRISPR gRNA sequence
agtctgggaggatgggggga

SEQ ID NO: 5587 - DNA, 20 bp, Artificial
  CRISPR gRNA sequence
gggatggaatatgcaaaatg

SEQ ID NO: 5588 - DNA, 20 bp, Artificial
  CRISPR gRNA sequence
ggatggaatatgcaaaatgt

SEQ ID NO: 5589 - DNA, 20 bp, Artificial
  CRISPR gRNA sequence
gatggaatatgcaaaatgta

SEQ ID NO: 5590 - DNA, 20 bp, Artificial
  CRISPR gRNA sequence
gaatatgcaaaatgtagggc

SEQ ID NO: 5591 - DNA, 20 bp, Artificial
  CRISPR gRNA sequence
aatatgcaaaatgtagggcc

SEQ ID NO: 5592 - DNA, 20 bp, Artificial
  CRISPR gRNA sequence
gccgggaaacacctcgtttc

SEQ ID NO: 5593 - DNA, 20 bp, Artificial
  CRISPR gRNA sequence
atccccgcaacgactctgcg

SEQ ID NO: 5594 - DNA, 20 bp, Artificial
  CRISPR gRNA sequence
tccccgcaacgactctgcgc

SEQ ID NO: 5595 - DNA, 20 bp, Artificial
  CRISPR gRNA sequence
caacgactctgcgcgggaac

SEQ ID NO: 5596 - DNA, 20 bp, Artificial
  CRISPR gRNA sequence
aacgactctgcgcgggaacc

SEQ ID NO: 5597 - DNA, 20 bp, Artificial
  CRISPR gRNA sequence
cgactctgcgcgggaaccag

SEQ ID NO: 5598 - DNA, 20 bp, Artificial
  CRISPR gRNA sequence
tctgcgcgggaaccaggagc

SEQ ID NO: 5599 - DNA, 20 bp, Artificial
  CRISPR gRNA sequence
ctgcgcgggaaccaggagcc

SEQ ID NO: 5600 - DNA, 20 bp, Artificial
  CRISPR gRNA sequence
ggaaccaggagccgggaacc

SEQ ID NO: 5601 - DNA, 20 bp, Artificial
  CRISPR gRNA sequence
aaccaggagccgggaacccg

SEQ ID NO: 5602 - DNA, 20 bp, Artificial
  CRISPR gRNA sequence
ggagccgggaacccggagct

SEQ ID NO: 5603 - DNA, 20 bp, Artificial
  CRISPR gRNA sequence
ggagcttggcttgctgtgcc

SEQ ID NO: 5604 - DNA, 20 bp, Artificial
  CRISPR gRNA sequence
agcttggcttgctgtgccca

SEQ ID NO: 5605 - DNA, 20 bp, Artificial
  CRISPR gRNA sequence
gcttgctgtgcccagagctc

SEQ ID NO: 5606 - DNA, 20 bp, Artificial
  CRISPR gRNA sequence
cttgctgtgcccagagctcc

SEQ ID NO: 5607 - DNA, 20 bp, Artificial
  CRISPR gRNA sequence
ttgctgtgcccagagctccg

SEQ ID NO: 5608 - DNA, 20 bp, Artificial
  CRISPR gRNA sequence
tgcccagagctccggggccg

SEQ ID NO: 5609 - DNA, 20 bp, Artificial
  CRISPR gRNA sequence
gcccagagctccggggccgt

SEQ ID NO: 5610 - DNA, 20 bp, Artificial
  CRISPR gRNA sequence
cagagctccggggccgtggg

SEQ ID NO: 5611 - DNA, 20 bp, Artificial
  CRISPR gRNA sequence
agagctccggggccgtgggc

SEQ ID NO: 5612 - DNA, 20 bp, Artificial
  CRISPR gRNA sequence
gctccggggccgtgggcggg

SEQ ID NO: 5613 - DNA, 20 bp, Artificial
  CRISPR gRNA sequence
ccggggccgtgggcgggtgg

SEQ ID NO: 5614 - DNA, 20 bp, Artificial
  CRISPR gRNA sequence
cggggccgtgggcgggtggc

SEQ ID NO: 5615 - DNA, 20 bp, Artificial
  CRISPR gRNA sequence
gccgtgggcgggtggcagga

SEQ ID NO: 5616 - DNA, 20 bp, Artificial
  CRISPR gRNA sequence
gggcgggtggcaggaaagcc

SEQ ID NO: 5617 - DNA, 20 bp, Artificial
  CRISPR gRNA sequence
cgggtggcaggaaagcctgg

SEQ ID NO: 5618 - DNA, 20 bp, Artificial
  CRISPR gRNA sequence
gtggcaggaaagcctggcgg

SEQ ID NO: 5619 - DNA, 20 bp, Artificial
  CRISPR gRNA sequence
aagcctggcggcagcttctg

SEQ ID NO: 5620 - DNA, 20 bp, Artificial
  CRISPR gRNA sequence
gcctggcggcagcttctgca

SEQ ID NO: 5621 - DNA, 20 bp, Artificial
  CRISPR gRNA sequence
tggcggcagcttctgcagag

SEQ ID NO: 5622 - DNA, 20 bp, Artificial
  CRISPR gRNA sequence
ggcagcttctgcagagaagc

SEQ ID NO: 5623 - DNA, 20 bp, Artificial
  CRISPR gRNA sequence
cagcttctgcagagaagccg

SEQ ID NO: 5624 - DNA, 20 bp, Artificial
  CRISPR gRNA sequence
tctgcagagaagccggagcg

SEQ ID NO: 5625 - DNA, 20 bp, Artificial
  CRISPR gRNA sequence
agagaagccggagcgcagac

SEQ ID NO: 5626 - DNA, 20 bp, Artificial
  CRISPR gRNA sequence
gagaagccggagcgcagact

SEQ ID NO: 5627 - DNA, 20 bp, Artificial
  CRISPR gRNA sequence
gaagccggagcgcagactgg

SEQ ID NO: 5628 - DNA, 20 bp, Artificial
  CRISPR gRNA sequence
cggagcgcagactgggagcg

SEQ ID NO: 5629 - DNA, 20 bp, Artificial
  CRISPR gRNA sequence
gagcgcagactgggagcgcg

SEQ ID NO: 5630 - DNA, 20 bp, Artificial
  CRISPR gRNA sequence
cgcagactgggagcgcggag

SEQ ID NO: 5631 - DNA, 20 bp, Artificial
  CRISPR gRNA sequence
gcggagcagacacactcccc

SEQ ID NO: 5632 - DNA, 20 bp, Artificial
  CRISPR gRNA sequence
cacactcccccggccaccct

SEQ ID NO: 5633 - DNA, 20 bp, Artificial
  CRISPR gRNA sequence
cttggccgactccgcgcgcc

SEQ ID NO: 5634 - DNA, 20 bp, Artificial
  CRISPR gRNA sequence
ttggccgactccgcgcgccc

SEQ ID NO: 5635 - DNA, 20 bp, Artificial
  CRISPR gRNA sequence
tccgcgcgcccgggatcctg

SEQ ID NO: 5636 - DNA, 20 bp, Artificial
  CRISPR gRNA sequence
cgcgcgcccgggatcctgca

SEQ ID NO: 5637 - DNA, 20 bp, Artificial
  CRISPR gRNA sequence
gcgcgcccgggatcctgcag

SEQ ID NO: 5638 - DNA, 20 bp, Artificial
  CRISPR gRNA sequence
tgcgcgcccttcttgtacgc

SEQ ID NO: 5639 - DNA, 20 bp, Artificial
  CRISPR gRNA sequence
ccttcttgtacgccagactt

SEQ ID NO: 5640 - DNA, 20 bp, Artificial
  CRISPR gRNA sequence
ttgtacgccagactttggac

SEQ ID NO: 5641 - DNA, 20 bp, Artificial
  CRISPR gRNA sequence
tgtacgccagactttggacc

SEQ ID NO: 5642 - DNA, 20 bp, Artificial
  CRISPR gRNA sequence
gtacgccagactttggacca

SEQ ID NO: 5643 - DNA, 20 bp, Artificial
  CRISPR gRNA sequence
gaccagggccgccgttccct

SEQ ID NO: 5644 - DNA, 20 bp, Artificial
  CRISPR gRNA sequence
ctgagcttcactttccctgt

SEQ ID NO: 5645 - DNA, 20 bp, Artificial
  CRISPR gRNA sequence
tgagcttcactttccctgtt

SEQ ID NO: 5646 - DNA, 20 bp, Artificial
  CRISPR gRNA sequence
tcatattccatctctaactc

SEQ ID NO: 5647 - DNA, 20 bp, Artificial
  CRISPR gRNA sequence
catctctaactctggaatct

SEQ ID NO: 5648 - DNA, 20 bp, Artificial
  CRISPR gRNA sequence
atctctaactctggaatctt

SEQ ID NO: 5649 - DNA, 20 bp, Artificial
  CRISPR gRNA sequence
aactctggaatcttgggtat

SEQ ID NO: 5650 - DNA, 20 bp, Artificial
  CRISPR gRNA sequence
actctggaatcttgggtatt

SEQ ID NO: 5651 - DNA, 20 bp, Artificial
  CRISPR gRNA sequence
atcttgggtattgggctctc

SEQ ID NO: 5652 - DNA, 20 bp, Artificial
  CRISPR gRNA sequence
tcttgggtattgggctctcc

SEQ ID NO: 5653 - DNA, 20 bp, Artificial
  CRISPR gRNA sequence
tgggtattgggctctccagg

SEQ ID NO: 5654 - DNA, 20 bp, Artificial
  CRISPR gRNA sequence
gggtattgggctctccaggc

SEQ ID NO: 5655 - DNA, 20 bp, Artificial
  CRISPR gRNA sequence
ggtattgggctctccaggcg

SEQ ID NO: 5656 - DNA, 20 bp, Artificial
  CRISPR gRNA sequence
gtattgggctctccaggcgg

SEQ ID NO: 5657 - DNA, 20 bp, Artificial
  CRISPR gRNA sequence
tattgggctctccaggcggg

SEQ ID NO: 5658 - DNA, 20 bp, Artificial
  CRISPR gRNA sequence
tccaggcggggggccctgct

SEQ ID NO: 5659 - DNA, 20 bp, Artificial
  CRISPR gRNA sequence
ccaggcggggggccctgctc

SEQ ID NO: 5660 - DNA, 20 bp, Artificial
  CRISPR gRNA sequence
caggcggggggccctgctca

SEQ ID NO: 5661 - DNA, 20 bp, Artificial
  CRISPR gRNA sequence
ggcggggggccctgctcagg

SEQ ID NO: 5662 - DNA, 20 bp, Artificial
  CRISPR gRNA sequence
gcggggggccctgctcaggg

SEQ ID NO: 5663 - DNA, 20 bp, Artificial
  CRISPR gRNA sequence
gggggccctgctcagggagg

SEQ ID NO: 5664 - DNA, 20 bp, Artificial
  CRISPR gRNA sequence
ggccctgctcagggaggcag

SEQ ID NO: 5665 - DNA, 20 bp, Artificial
  CRISPR gRNA sequence
gccctgctcagggaggcagt

SEQ ID NO: 5666 - DNA, 20 bp, Artificial
  CRISPR gRNA sequence
ccctgctcagggaggcagta

SEQ ID NO: 5667 - DNA, 20 bp, Artificial
  CRISPR gRNA sequence
ctgctcagggaggcagtagg

SEQ ID NO: 5668 - DNA, 20 bp, Artificial
  CRISPR gRNA sequence
tagggagccaaacctttaac

SEQ ID NO: 5669 - DNA, 20 bp, Artificial
  CRISPR gRNA sequence
gggagccaaacctttaacca

SEQ ID NO: 5670 - DNA, 20 bp, Artificial
  CRISPR gRNA sequence
ggagccaaacctttaaccag

SEQ ID NO: 5671 - DNA, 20 bp, Artificial
  CRISPR gRNA sequence
ccaaacctttaaccagagga

SEQ ID NO: 5672 - DNA, 20 bp, Artificial
  CRISPR gRNA sequence
caaacctttaaccagaggat

SEQ ID NO: 5673 - DNA, 20 bp, Artificial
  CRISPR gRNA sequence
ctttaaccagaggatgggat

SEQ ID NO: 5674 - DNA, 20 bp, Artificial
  CRISPR gRNA sequence
tcaactctcgttgaacatct

SEQ ID NO: 5675 - DNA, 20 bp, Artificial
  CRISPR gRNA sequence
tctcgttgaacatcttggcg

SEQ ID NO: 5676 - DNA, 20 bp, Artificial
  CRISPR gRNA sequence
ctcgttgaacatcttggcga

SEQ ID NO: 5677 - DNA, 20 bp, Artificial
  CRISPR gRNA sequence
ttggcgaaggtgtgtgttgt

SEQ ID NO: 5678 - DNA, 20 bp, Artificial
  CRISPR gRNA sequence
tggcgaaggtgtgtgttgtt

SEQ ID NO: 5679 - DNA, 20 bp, Artificial
  CRISPR gRNA sequence
gcgaaggtgtgtgttgttgg

SEQ ID NO: 5680 - DNA, 20 bp, Artificial
  CRISPR gRNA sequence
cgaaggtgtgtgttgttggg

SEQ ID NO: 5681 - DNA, 20 bp, Artificial
  CRISPR gRNA sequence
gaaggtgtgtgttgttggga

SEQ ID NO: 5682 - DNA, 20 bp, Artificial
  CRISPR gRNA sequence
aaggtgtgtgttgttgggag

SEQ ID NO: 5683 - DNA, 20 bp, Artificial
  CRISPR gRNA sequence
gtgtgtgttgttgggagggg

SEQ ID NO: 5684 - DNA, 20 bp, Artificial
  CRISPR gRNA sequence
tgtgtgttgttgggaggggt

SEQ ID NO: 5685 - DNA, 20 bp, Artificial
  CRISPR gRNA sequence
gtgtgttgttgggaggggtg

SEQ ID NO: 5686 - DNA, 20 bp, Artificial
  CRISPR gRNA sequence
tgtgttgttgggaggggtgg

SEQ ID NO: 5687 - DNA, 20 bp, Artificial
  CRISPR gRNA sequence
tgttgttgggaggggtgggg

SEQ ID NO: 5688 - DNA, 20 bp, Artificial
  CRISPR gRNA sequence
gttgttgggaggggtggggg

SEQ ID NO: 5689 - DNA, 20 bp, Artificial
  CRISPR gRNA sequence
ttgttgggaggggtggggga

SEQ ID NO: 5690 - DNA, 20 bp, Artificial
  CRISPR gRNA sequence
gggtgggggagggatccccc

SEQ ID NO: 5691 - DNA, 20 bp, Artificial
  CRISPR gRNA sequence
ctcacttctctacctcgctt

SEQ ID NO: 5692 - DNA, 20 bp, Artificial
  CRISPR gRNA sequence
tcacttctctacctcgcttt

SEQ ID NO: 5693 - DNA, 20 bp, Artificial
  CRISPR gRNA sequence
cacttctctacctcgctttg

SEQ ID NO: 5694 - DNA, 20 bp, Artificial
  CRISPR gRNA sequence
ctacctcgctttggggccct

SEQ ID NO: 5695 - DNA, 20 bp, Artificial
  CRISPR gRNA sequence
ggccctgagtcacaccctct

SEQ ID NO: 5696 - DNA, 20 bp, Artificial
  CRISPR gRNA sequence
gccctgagtcacaccctcta

SEQ ID NO: 5697 - DNA, 20 bp, Artificial
  CRISPR gRNA sequence
cctgagtcacaccctctaag

SEQ ID NO: 5698 - DNA, 20 bp, Artificial
  CRISPR gRNA sequence
tgagtcacaccctctaagga

SEQ ID NO: 5699 - DNA, 20 bp, Artificial
  CRISPR gRNA sequence
agtcacaccctctaaggaga

SEQ ID NO: 5700 - DNA, 20 bp, Artificial
  CRISPR gRNA sequence
gtcacaccctctaaggagag

SEQ ID NO: 5701 - DNA, 20 bp, Artificial
  CRISPR gRNA sequence
ccctctaaggagagaggcta

SEQ ID NO: 5702 - DNA, 20 bp, Artificial
  CRISPR gRNA sequence
ggagagaggctaaagcgccc

SEQ ID NO: 5703 - DNA, 20 bp, Artificial
  CRISPR gRNA sequence
agaggctaaagcgccccgga

SEQ ID NO: 5704 - DNA, 20 bp, Artificial
  CRISPR gRNA sequence
gctaaagcgccccggaaagc

SEQ ID NO: 5705 - DNA, 20 bp, Artificial
  CRISPR gRNA sequence
gaaagccagcgtgcgaatgc

SEQ ID NO: 5706 - DNA, 20 bp, Artificial
  CRISPR gRNA sequence
aaagccagcgtgcgaatgcc

SEQ ID NO: 5707 - DNA, 20 bp, Artificial
  CRISPR gRNA sequence
aagccagcgtgcgaatgccg

SEQ ID NO: 5708 - DNA, 20 bp, Artificial
  CRISPR gRNA sequence
ccagcgtgcgaatgccgggg

SEQ ID NO: 5709 - DNA, 20 bp, Artificial
  CRISPR gRNA sequence
cagcgtgcgaatgccggggt

SEQ ID NO: 5710 - DNA, 20 bp, Artificial
  CRISPR gRNA sequence
gcgtgcgaatgccggggtgg

SEQ ID NO: 5711 - DNA, 20 bp, Artificial
  CRISPR gRNA sequence
tgcgaatgccggggtgggag

SEQ ID NO: 5712 - DNA, 20 bp, Artificial
  CRISPR gRNA sequence
gcgaatgccggggtgggagt

SEQ ID NO: 5713 - DNA, 20 bp, Artificial
  CRISPR gRNA sequence
gaatgccggggtgggagtgg

SEQ ID NO: 5714 - DNA, 20 bp, Artificial
  CRISPR gRNA sequence
ccggggtgggagtgggagat

SEQ ID NO: 5715 - DNA, 20 bp, Artificial
  CRISPR gRNA sequence
agtgggagattggatctccc

SEQ ID NO: 5716 - DNA, 20 bp, Artificial
  CRISPR gRNA sequence
gtgggagattggatctccct

SEQ ID NO: 5717 - DNA, 20 bp, Artificial
  CRISPR gRNA sequence
tgggagattggatctccctg

SEQ ID NO: 5718 - DNA, 20 bp, Artificial
  CRISPR gRNA sequence
gattggatctccctggggtc

SEQ ID NO: 5719 - DNA, 20 bp, Artificial
  CRISPR gRNA sequence
attggatctccctggggtcc

SEQ ID NO: 5720 - DNA, 20 bp, Artificial
  CRISPR gRNA sequence
gatctccctggggtccagga

SEQ ID NO: 5721 - DNA, 20 bp, Artificial
  CRISPR gRNA sequence
tccctggggtccaggaaagc

SEQ ID NO: 5722 - DNA, 20 bp, Artificial
  CRISPR gRNA sequence
gggtccaggaaagccggaat

SEQ ID NO: 5723 - DNA, 20 bp, Artificial
  CRISPR gRNA sequence
gtccaggaaagccggaatcg

SEQ ID NO: 5724 - DNA, 20 bp, Artificial
  CRISPR gRNA sequence
ggaatcggagccaccatgct

SEQ ID NO: 5725 - DNA, 20 bp, Artificial
  CRISPR gRNA sequence
cggagccaccatgcttagct

SEQ ID NO: 5726 - DNA, 20 bp, Artificial
  CRISPR gRNA sequence
ccaccatgcttagcttagtc

SEQ ID NO: 5727 - DNA, 20 bp, Artificial
  CRISPR gRNA sequence
gcttagtctggaactcttaa

SEQ ID NO: 5728 - DNA, 20 bp, Artificial
  CRISPR gRNA sequence
tctggaactcttaaaagccg

SEQ ID NO: 5729 - DNA, 20 bp, Artificial
  CRISPR gRNA sequence
ttaaaagccgcggtcctcct

SEQ ID NO: 5730 - DNA, 20 bp, Artificial
  CRISPR gRNA sequence
cgcggtcctcctgagtccca

SEQ ID NO: 5731 - DNA, 20 bp, Artificial
  CRISPR gRNA sequence
cccacagcccctctccaccc

SEQ ID NO: 5732 - DNA, 20 bp, Artificial
  CRISPR gRNA sequence
ccacagcccctctccaccct

SEQ ID NO: 5733 - DNA, 20 bp, Artificial
  CRISPR gRNA sequence
cagcccctctccaccctagg

SEQ ID NO: 5734 - DNA, 20 bp, Artificial
  CRISPR gRNA sequence
cctctccaccctaggtggca

SEQ ID NO: 5735 - DNA, 20 bp, Artificial
  CRISPR gRNA sequence
ctctccaccctaggtggcac

SEQ ID NO: 5736 - DNA, 20 bp, Artificial
  CRISPR gRNA sequence
ctccaccctaggtggcacag

SEQ ID NO: 5737 - DNA, 20 bp, Artificial
  CRISPR gRNA sequence
ccaccctaggtggcacagga

SEQ ID NO: 5738 - DNA, 20 bp, Artificial
  CRISPR gRNA sequence
caccctaggtggcacaggag

SEQ ID NO: 5739 - DNA, 20 bp, Artificial
  CRISPR gRNA sequence
cctaggtggcacaggagagg

SEQ ID NO: 5740 - DNA, 20 bp, Artificial
  CRISPR gRNA sequence
tggcacaggagaggtggcaa

SEQ ID NO: 5741 - DNA, 20 bp, Artificial
  CRISPR gRNA sequence
caggagaggtggcaaaagcc

SEQ ID NO: 5742 - DNA, 20 bp, Artificial
  CRISPR gRNA sequence
gagaggtggcaaaagcctag

SEQ ID NO: 5743 - DNA, 20 bp, Artificial
  CRISPR gRNA sequence
tggcaaaagcctagaagttc

SEQ ID NO: 5744 - DNA, 20 bp, Artificial
  CRISPR gRNA sequence
ggcaaaagcctagaagttca

SEQ ID NO: 5745 - DNA, 20 bp, Artificial
  CRISPR gRNA sequence
aagcctagaagttcaaggca

SEQ ID NO: 5746 - DNA, 20 bp, Artificial
  CRISPR gRNA sequence
tcaaggcatggctccctccc

SEQ ID NO: 5747 - DNA, 20 bp, Artificial
  CRISPR gRNA sequence
catggctccctccccagccg

SEQ ID NO: 5748 - DNA, 20 bp, Artificial
  CRISPR gRNA sequence
ctccctccccagccgcagcc

SEQ ID NO: 5749 - DNA, 20 bp, Artificial
  CRISPR gRNA sequence
ccctccccagccgcagcctg

SEQ ID NO: 5750 - DNA, 20 bp, Artificial
  CRISPR gRNA sequence
cagcctggagtgtctaactt

SEQ ID NO: 5751 - DNA, 20 bp, Artificial
  CRISPR gRNA sequence
cctggagtgtctaactttgg

SEQ ID NO: 5752 - DNA, 20 bp, Artificial
  CRISPR gRNA sequence
ctggagtgtctaactttggc

SEQ ID NO: 5753 - DNA, 20 bp, Artificial
  CRISPR gRNA sequence
gagtgtctaactttggcagg

SEQ ID NO: 5754 - DNA, 20 bp, Artificial
  CRISPR gRNA sequence
tccgtttctgctccccactc

SEQ ID NO: 5755 - DNA, 20 bp, Artificial
  CRISPR gRNA sequence
cgtttctgctccccactcca

SEQ ID NO: 5756 - DNA, 20 bp, Artificial
  CRISPR gRNA sequence
aaaataaataaatacttctc

SEQ ID NO: 5757 - DNA, 20 bp, Artificial
  CRISPR gRNA sequence
aataaataaatacttctccg

SEQ ID NO: 5758 - DNA, 20 bp, Artificial
  CRISPR gRNA sequence
aataaatacttctccggagt

SEQ ID NO: 5759 - DNA, 20 bp, Artificial
  CRISPR gRNA sequence
tacttctccggagtgagatt

SEQ ID NO: 5760 - DNA, 20 bp, Artificial
  CRISPR gRNA sequence
acttctccggagtgagatta

SEQ ID NO: 5761 - DNA, 20 bp, Artificial
  CRISPR gRNA sequence
ccggagtgagattaaggaaa

SEQ ID NO: 5762 - DNA, 20 bp, Artificial
  CRISPR gRNA sequence
cggagtgagattaaggaaac

SEQ ID NO: 5763 - DNA, 20 bp, Artificial
  CRISPR gRNA sequence
aaacaggtacttcttcctct

SEQ ID NO: 5764 - DNA, 20 bp, Artificial
  CRISPR gRNA sequence
acaggtacttcttcctcttg

SEQ ID NO: 5765 - DNA, 20 bp, Artificial
  CRISPR gRNA sequence
gtacttcttcctcttggaga

SEQ ID NO: 5766 - DNA, 20 bp, Artificial
  CRISPR gRNA sequence
acttcttcctcttggagaaa

SEQ ID NO: 5767 - DNA, 20 bp, Artificial
  CRISPR gRNA sequence
cttcttcctcttggagaaag

SEQ ID NO: 5768 - DNA, 20 bp, Artificial
  CRISPR gRNA sequence
tcttcctcttggagaaagag

SEQ ID NO: 5769 - DNA, 20 bp, Artificial
  CRISPR gRNA sequence
tcttggagaaagaggagcca

SEQ ID NO: 5770 - DNA, 20 bp, Artificial
  CRISPR gRNA sequence
cttggagaaagaggagccaa

SEQ ID NO: 5771 - DNA, 20 bp, Artificial
  CRISPR gRNA sequence
atgatcaccttgcaaacccc

SEQ ID NO: 5772 - DNA, 20 bp, Artificial
  CRISPR gRNA sequence
ttgcaaacccccggctccct

SEQ ID NO: 5773 - DNA, 20 bp, Artificial
  CRISPR gRNA sequence
tgcaaacccccggctccctt

SEQ ID NO: 5774 - DNA, 20 bp, Artificial
  CRISPR gRNA sequence
gcaaacccccggctccctta

SEQ ID NO: 5775 - DNA, 20 bp, Artificial
  CRISPR gRNA sequence
caaacccccggctcccttag

SEQ ID NO: 5776 - DNA, 20 bp, Artificial
  CRISPR gRNA sequence
ggctcccttaggggatgacc

SEQ ID NO: 5777 - DNA, 20 bp, Artificial
  CRISPR gRNA sequence
gacctggtctccaacaatct

SEQ ID NO: 5778 - DNA, 20 bp, Artificial
  CRISPR gRNA sequence
cctggtctccaacaatctca

SEQ ID NO: 5779 - DNA, 20 bp, Artificial
  CRISPR gRNA sequence
tccaacaatctcagagcgtt

SEQ ID NO: 5780 - DNA, 20 bp, Artificial
  CRISPR gRNA sequence
caacaatctcagagcgtttg

SEQ ID NO: 5781 - DNA, 20 bp, Artificial
  CRISPR gRNA sequence
aacaatctcagagcgtttgg

SEQ ID NO: 5782 - DNA, 20 bp, Artificial
  CRISPR gRNA sequence
aatctcagagcgtttggagg

SEQ ID NO: 5783 - DNA, 20 bp, Artificial
  CRISPR gRNA sequence
atctcagagcgtttggaggc

SEQ ID NO: 5784 - DNA, 20 bp, Artificial
  CRISPR gRNA sequence
tctcagagcgtttggaggca

SEQ ID NO: 5785 - DNA, 20 bp, Artificial
  CRISPR gRNA sequence
gcgtttggaggcagggtctt

SEQ ID NO: 5786 - DNA, 20 bp, Artificial
  CRISPR gRNA sequence
gtttggaggcagggtctttg

SEQ ID NO: 5787 - DNA, 20 bp, Artificial
  CRISPR gRNA sequence
cagggtctttggagatgact

SEQ ID NO: 5788 - DNA, 20 bp, Artificial
  CRISPR gRNA sequence
ggtctttggagatgactgag

SEQ ID NO: 5789 - DNA, 20 bp, Artificial
  CRISPR gRNA sequence
gtctttggagatgactgagt

SEQ ID NO: 5790 - DNA, 20 bp, Artificial
  CRISPR gRNA sequence
tctttggagatgactgagtg

SEQ ID NO: 5791 - DNA, 20 bp, Artificial
  CRISPR gRNA sequence
gatgactgagtggggaatcc

SEQ ID NO: 5792 - DNA, 20 bp, Artificial
  CRISPR gRNA sequence
atgactgagtggggaatccc

SEQ ID NO: 5793 - DNA, 20 bp, Artificial
  CRISPR gRNA sequence
ccccacacatgaacatcacc

SEQ ID NO: 5794 - DNA, 20 bp, Artificial
  CRISPR gRNA sequence
cccacacatgaacatcacct

SEQ ID NO: 5795 - DNA, 20 bp, Artificial
  CRISPR gRNA sequence
cctgggatgatcaacctgtt

SEQ ID NO: 5796 - DNA, 20 bp, Artificial
  CRISPR gRNA sequence
ctgggatgatcaacctgttc

SEQ ID NO: 5797 - DNA, 20 bp, Artificial
  CRISPR gRNA sequence
tgatcaacctgttcaggatg

SEQ ID NO: 5798 - DNA, 20 bp, Artificial
  CRISPR gRNA sequence
gatcaacctgttcaggatgt

SEQ ID NO: 5799 - DNA, 20 bp, Artificial
  CRISPR gRNA sequence
ctgttcaggatgtaggttcc

SEQ ID NO: 5800 - DNA, 20 bp, Artificial
  CRISPR gRNA sequence
tgttcaggatgtaggttccc

SEQ ID NO: 5801 - DNA, 20 bp, Artificial
  CRISPR gRNA sequence
taggttcccgggctcacccc

SEQ ID NO: 5802 - DNA, 20 bp, Artificial
  CRISPR gRNA sequence
aggttcccgggctcaccccc

SEQ ID NO: 5803 - DNA, 20 bp, Artificial
  CRISPR gRNA sequence
cccgggctcacccccaggcc

SEQ ID NO: 5804 - DNA, 20 bp, Artificial
  CRISPR gRNA sequence
ggctcacccccaggcccggt

SEQ ID NO: 5805 - DNA, 20 bp, Artificial
  CRISPR gRNA sequence
cacccccaggcccggttggc

SEQ ID NO: 5806 - DNA, 20 bp, Artificial
  CRISPR gRNA sequence
acccccaggcccggttggct

SEQ ID NO: 5807 - DNA, 20 bp, Artificial
  CRISPR gRNA sequence
caggcccggttggctaggcc

SEQ ID NO: 5808 - DNA, 20 bp, Artificial
  CRISPR gRNA sequence
aggcccggttggctaggcct

SEQ ID NO: 5809 - DNA, 20 bp, Artificial
  CRISPR gRNA sequence
ggcccggttggctaggcctg

SEQ ID NO: 5810 - DNA, 20 bp, Artificial
  CRISPR gRNA sequence
cggttggctaggcctggggt

SEQ ID NO: 5811 - DNA, 20 bp, Artificial
  CRISPR gRNA sequence
ggttggctaggcctggggtg

SEQ ID NO: 5812 - DNA, 20 bp, Artificial
  CRISPR gRNA sequence
gctaggcctggggtgaggct

SEQ ID NO: 5813 - DNA, 20 bp, Artificial
  CRISPR gRNA sequence
ggggtgaggctgagatcctg

SEQ ID NO: 5814 - DNA, 20 bp, Artificial
  CRISPR gRNA sequence
gggtgaggctgagatcctgc

SEQ ID NO: 5815 - DNA, 20 bp, Artificial
  CRISPR gRNA sequence
gcaggttaaaccatctatcc

SEQ ID NO: 5816 - DNA, 20 bp, Artificial
  CRISPR gRNA sequence
caggttaaaccatctatccc

SEQ ID NO: 5817 - DNA, 20 bp, Artificial
  CRISPR gRNA sequence
gtgactccaatgttcgtttg

SEQ ID NO: 5818 - DNA, 20 bp, Artificial
  CRISPR gRNA sequence
tgactccaatgttcgtttgt

SEQ ID NO: 5819 - DNA, 20 bp, Artificial
  CRISPR gRNA sequence
gactccaatgttcgtttgtg

SEQ ID NO: 5820 - DNA, 20 bp, Artificial
  CRISPR gRNA sequence
aatgttcgtttgtggggcaa

SEQ ID NO: 5821 - DNA, 20 bp, Artificial
  CRISPR gRNA sequence
ttgtggggcaaaagtccctc

SEQ ID NO: 5822 - DNA, 20 bp, Artificial
  CRISPR gRNA sequence
ggggcaaaagtccctcaagt

SEQ ID NO: 5823 - DNA, 20 bp, Artificial
  CRISPR gRNA sequence
ggcaaaagtccctcaagtca

SEQ ID NO: 5824 - DNA, 20 bp, Artificial
  CRISPR gRNA sequence
gtccctcaagtcagagacac

SEQ ID NO: 5825 - DNA, 20 bp, Artificial
  CRISPR gRNA sequence
tccctcaagtcagagacact

SEQ ID NO: 5826 - DNA, 20 bp, Artificial
  CRISPR gRNA sequence
cctcaagtcagagacactgg

SEQ ID NO: 5827 - DNA, 20 bp, Artificial
  CRISPR gRNA sequence
ctcaagtcagagacactggg

SEQ ID NO: 5828 - DNA, 20 bp, Artificial
  CRISPR gRNA sequence
gacactgggaggcgctgatg

SEQ ID NO: 5829 - DNA, 20 bp, Artificial
  CRISPR gRNA sequence
ccctgttacaaaacctctat

SEQ ID NO: 5830 - DNA, 20 bp, Artificial
  CRISPR gRNA sequence
ttacaaaacctctatcagaa

SEQ ID NO: 5831 - DNA, 20 bp, Artificial
  CRISPR gRNA sequence
tacaaaacctctatcagaaa

SEQ ID NO: 5832 - DNA, 20 bp, Artificial
  CRISPR gRNA sequence
caaaacctctatcagaaaag

SEQ ID NO: 5833 - DNA, 20 bp, Artificial
  CRISPR gRNA sequence
ctctatcagaaaaggagtac

SEQ ID NO: 5834 - DNA, 20 bp, Artificial
  CRISPR gRNA sequence
tctatcagaaaaggagtacc

SEQ ID NO: 5835 - DNA, 20 bp, Artificial
  CRISPR gRNA sequence
tatcagaaaaggagtaccag

SEQ ID NO: 5836 - DNA, 20 bp, Artificial
  CRISPR gRNA sequence
atcagaaaaggagtaccagg

SEQ ID NO: 5837 - DNA, 20 bp, Artificial
  CRISPR gRNA sequence
ttgttttgcttaacgccaca

SEQ ID NO: 5838 - DNA, 20 bp, Artificial
  CRISPR gRNA sequence
tttgcttaacgccacatagc

SEQ ID NO: 5839 - DNA, 20 bp, Artificial
  CRISPR gRNA sequence
gcttaacgccacatagcaag

SEQ ID NO: 5840 - DNA, 20 bp, Artificial
  CRISPR gRNA sequence
gccacatagcaagcagtttg

SEQ ID NO: 5841 - DNA, 20 bp, Artificial
  CRISPR gRNA sequence
tagcaagcagtttgcagacg

SEQ ID NO: 5842 - DNA, 20 bp, Artificial
  CRISPR gRNA sequence
agcaagcagtttgcagacgc

SEQ ID NO: 5843 - DNA, 20 bp, Artificial
  CRISPR gRNA sequence
cagacgcaggatttgaaccc

SEQ ID NO: 5844 - DNA, 20 bp, Artificial
  CRISPR gRNA sequence
gatttgaaccctggtctact

SEQ ID NO: 5845 - DNA, 20 bp, Artificial
  CRISPR gRNA sequence
tttgaaccctggtctactga

SEQ ID NO: 5846 - DNA, 20 bp, Artificial
  CRISPR gRNA sequence
accctggtctactgagagcc

SEQ ID NO: 5847 - DNA, 20 bp, Artificial
  CRISPR gRNA sequence
ggtctactgagagcccagcc

SEQ ID NO: 5848 - DNA, 20 bp, Artificial
  CRISPR gRNA sequence
actgagagcccagcccagtg

SEQ ID NO: 5849 - DNA, 20 bp, Artificial
  CRISPR gRNA sequence
agagcccagcccagtgcagc

SEQ ID NO: 5850 - DNA, 20 bp, Artificial
  CRISPR gRNA sequence
gcccagcccagtgcagcaag

SEQ ID NO: 5851 - DNA, 20 bp, Artificial
  CRISPR gRNA sequence
gatgtgaacctccacaaatg

SEQ ID NO: 5852 - DNA, 20 bp, Artificial
  CRISPR gRNA sequence
atgtgaacctccacaaatgc

SEQ ID NO: 5853 - DNA, 20 bp, Artificial
  CRISPR gRNA sequence
tgtgaacctccacaaatgca

SEQ ID NO: 5854 - DNA, 20 bp, Artificial
  CRISPR gRNA sequence
gaacctccacaaatgcaggg

SEQ ID NO: 5855 - DNA, 20 bp, Artificial
  CRISPR gRNA sequence
aacctccacaaatgcagggc

SEQ ID NO: 5856 - DNA, 20 bp, Artificial
  CRISPR gRNA sequence
cacaaatgcagggcaggtcc

SEQ ID NO: 5857 - DNA, 20 bp, Artificial
  CRISPR gRNA sequence
acaaatgcagggcaggtccc

SEQ ID NO: 5858 - DNA, 20 bp, Artificial
  CRISPR gRNA sequence
aatgcagggcaggtcccagg

SEQ ID NO: 5859 - DNA, 20 bp, Artificial
  CRISPR gRNA sequence
cagggcaggtcccaggcagt

SEQ ID NO: 5860 - DNA, 20 bp, Artificial
  CRISPR gRNA sequence
gggcaggtcccaggcagtca

SEQ ID NO: 5861 - DNA, 20 bp, Artificial
  CRISPR gRNA sequence
gcaggtcccaggcagtcaga

SEQ ID NO: 5862 - DNA, 20 bp, Artificial
  CRISPR gRNA sequence
gagagaaacctgttgatacc

SEQ ID NO: 5863 - DNA, 20 bp, Artificial
  CRISPR gRNA sequence
ttgatacccagtctgtctga

SEQ ID NO: 5864 - DNA, 20 bp, Artificial
  CRISPR gRNA sequence
tacccagtctgtctgatggc

SEQ ID NO: 5865 - DNA, 20 bp, Artificial
  CRISPR gRNA sequence
acccagtctgtctgatggct

SEQ ID NO: 5866 - DNA, 20 bp, Artificial
  CRISPR gRNA sequence
cccagtctgtctgatggctg

SEQ ID NO: 5867 - DNA, 20 bp, Artificial
  CRISPR gRNA sequence
tctgtctgatggctggggct

SEQ ID NO: 5868 - DNA, 20 bp, Artificial
  CRISPR gRNA sequence
ggggcttggtttcatgtcct

SEQ ID NO: 5869 - DNA, 20 bp, Artificial
  CRISPR gRNA sequence
tggtttcatgtcctaagacc

SEQ ID NO: 5870 - DNA, 20 bp, Artificial
  CRISPR gRNA sequence
catgtcctaagacccagcct

SEQ ID NO: 5871 - DNA, 20 bp, Artificial
  CRISPR gRNA sequence
gacccagcctcagatacctt

SEQ ID NO: 5872 - DNA, 20 bp, Artificial
  CRISPR gRNA sequence
ccagcctcagataccttgag

SEQ ID NO: 5873 - DNA, 20 bp, Artificial
  CRISPR gRNA sequence
agcctcagataccttgagaa

SEQ ID NO: 5874 - DNA, 20 bp, Artificial
  CRISPR gRNA sequence
ctcagataccttgagaagag

SEQ ID NO: 5875 - DNA, 20 bp, Artificial
  CRISPR gRNA sequence
taccttgagaagagcagaat

SEQ ID NO: 5876 - DNA, 20 bp, Artificial
  CRISPR gRNA sequence
gcagaatcagaaattaaccc

SEQ ID NO: 5877 - DNA, 20 bp, Artificial
  CRISPR gRNA sequence
cagaatcagaaattaaccca

SEQ ID NO: 5878 - DNA, 20 bp, Artificial
  CRISPR gRNA sequence
aaattaacccaaggaaactc

SEQ ID NO: 5879 - DNA, 20 bp, Artificial
  CRISPR gRNA sequence
aacccaaggaaactctggat

SEQ ID NO: 5880 - DNA, 20 bp, Artificial
  CRISPR gRNA sequence
aggaaactctggattagttc

SEQ ID NO: 5881 - DNA, 20 bp, Artificial
  CRISPR gRNA sequence
ggaaactctggattagttcc

SEQ ID NO: 5882 - DNA, 20 bp, Artificial
  CRISPR gRNA sequence
ctggattagttccaggcaat

SEQ ID NO: 5883 - DNA, 20 bp, Artificial
  CRISPR gRNA sequence
tggattagttccaggcaatc

SEQ ID NO: 5884 - DNA, 20 bp, Artificial
  CRISPR gRNA sequence
ggattagttccaggcaatca

SEQ ID NO: 5885 - DNA, 20 bp, Artificial
  CRISPR gRNA sequence
ttagttccaggcaatcaggg

SEQ ID NO: 5886 - DNA, 20 bp, Artificial
  CRISPR gRNA sequence
gttccaggcaatcagggaag

SEQ ID NO: 5887 - DNA, 20 bp, Artificial
  CRISPR gRNA sequence
caggcaatcagggaagtggc

SEQ ID NO: 5888 - DNA, 20 bp, Artificial
  CRISPR gRNA sequence
ggcaatcagggaagtggctg

SEQ ID NO: 5889 - DNA, 20 bp, Artificial
  CRISPR gRNA sequence
gcaatcagggaagtggctgg

SEQ ID NO: 5890 - DNA, 20 bp, Artificial
  CRISPR gRNA sequence
caatcagggaagtggctgga

SEQ ID NO: 5891 - DNA, 20 bp, Artificial
  CRISPR gRNA sequence
atcagggaagtggctggagg

SEQ ID NO: 5892 - DNA, 20 bp, Artificial
  CRISPR gRNA sequence
tcagggaagtggctggaggg

SEQ ID NO: 5893 - DNA, 20 bp, Artificial
  CRISPR gRNA sequence
gggaagtggctggagggagg

SEQ ID NO: 5894 - DNA, 20 bp, Artificial
  CRISPR gRNA sequence
ggaagtggctggagggaggt

SEQ ID NO: 5895 - DNA, 20 bp, Artificial
  CRISPR gRNA sequence
ggagggaggtaggaaacttc

SEQ ID NO: 5896 - DNA, 20 bp, Artificial
  CRISPR gRNA sequence
aggtaggaaacttctggact

SEQ ID NO: 5897 - DNA, 20 bp, Artificial
  CRISPR gRNA sequence
gaaacttctggacttagcct

SEQ ID NO: 5898 - DNA, 20 bp, Artificial
  CRISPR gRNA sequence
cttagcctcagatttgcctt

SEQ ID NO: 5899 - DNA, 20 bp, Artificial
  CRISPR gRNA sequence
ttgccttgagtcacactgac

SEQ ID NO: 5900 - DNA, 20 bp, Artificial
  CRISPR gRNA sequence
acaagtgacttcccctctct

SEQ ID NO: 5901 - DNA, 20 bp, Artificial
  CRISPR gRNA sequence
caagtgacttcccctctctg

SEQ ID NO: 5902 - DNA, 20 bp, Artificial
  CRISPR gRNA sequence
tctgaggttcatctgtaaaa

SEQ ID NO: 5903 - DNA, 20 bp, Artificial
  CRISPR gRNA sequence
ctgtaaaatggataaaacat

SEQ ID NO: 5904 - DNA, 20 bp, Artificial
  CRISPR gRNA sequence
gtaaaatggataaaacatga

SEQ ID NO: 5905 - DNA, 20 bp, Artificial
  CRISPR gRNA sequence
ttgatgatgtctgatgtgta

SEQ ID NO: 5906 - DNA, 20 bp, Artificial
  CRISPR gRNA sequence
atgtctgatgtgtacagaaa

SEQ ID NO: 5907 - DNA, 20 bp, Artificial
  CRISPR gRNA sequence
tgtgtacagaaaaagcactt

SEQ ID NO: 5908 - DNA, 20 bp, Artificial
  CRISPR gRNA sequence
agcactttagaaaaccacca

SEQ ID NO: 5909 - DNA, 20 bp, Artificial
  CRISPR gRNA sequence
accaaagaatattcatgcat

SEQ ID NO: 5910 - DNA, 20 bp, Artificial
  CRISPR gRNA sequence
ccaaagaatattcatgcatt

SEQ ID NO: 5911 - DNA, 20 bp, Artificial
  CRISPR gRNA sequence
tgcattgggaataattatta

SEQ ID NO: 5912 - DNA, 20 bp, Artificial
  CRISPR gRNA sequence
aataattattatagatccta

SEQ ID NO: 5913 - DNA, 20 bp, Artificial
  CRISPR gRNA sequence
ataattattatagatcctaa

SEQ ID NO: 5914 - DNA, 20 bp, Artificial
  CRISPR gRNA sequence
taattattatagatcctaaa

SEQ ID NO: 5915 - DNA, 20 bp, Artificial
  CRISPR gRNA sequence
tagatcctaaagggattgtt

SEQ ID NO: 5916 - DNA, 20 bp, Artificial
  CRISPR gRNA sequence
tcctaaagggattgtttaga

SEQ ID NO: 5917 - DNA, 20 bp, Artificial
  CRISPR gRNA sequence
aagggattgtttagaaagat

SEQ ID NO: 5918 - DNA, 20 bp, Artificial
  CRISPR gRNA sequence
gggattgtttagaaagatca

SEQ ID NO: 5919 - DNA, 20 bp, Artificial
  CRISPR gRNA sequence
gattgtttagaaagatcaga

SEQ ID NO: 5920 - DNA, 20 bp, Artificial
  CRISPR gRNA sequence
attgtttagaaagatcagag

SEQ ID NO: 5921 - DNA, 20 bp, Artificial
  CRISPR gRNA sequence
ttgtttagaaagatcagaga

SEQ ID NO: 5922 - DNA, 20 bp, Artificial
  CRISPR gRNA sequence
tgtttagaaagatcagagag

SEQ ID NO: 5923 - DNA, 20 bp, Artificial
  CRISPR gRNA sequence
tagaaagatcagagaggggc

SEQ ID NO: 5924 - DNA, 20 bp, Artificial
  CRISPR gRNA sequence
agaaagatcagagaggggcc

SEQ ID NO: 5925 - DNA, 20 bp, Artificial
  CRISPR gRNA sequence
aaagatcagagaggggccgg

SEQ ID NO: 5926 - DNA, 20 bp, Artificial
  CRISPR gRNA sequence
gatcagagaggggccgggag

SEQ ID NO: 5927 - DNA, 20 bp, Artificial
  CRISPR gRNA sequence
cagagaggggccgggagcag

SEQ ID NO: 5928 - DNA, 20 bp, Artificial
  CRISPR gRNA sequence
gtggttcacacctgtaatcc

SEQ ID NO: 5929 - DNA, 20 bp, Artificial
  CRISPR gRNA sequence
cacctgtaatcctagcactt

SEQ ID NO: 5930 - DNA, 20 bp, Artificial
  CRISPR gRNA sequence
acctgtaatcctagcacttt

SEQ ID NO: 5931 - DNA, 20 bp, Artificial
  CRISPR gRNA sequence
ctgtaatcctagcactttgg

SEQ ID NO: 5932 - DNA, 20 bp, Artificial
  CRISPR gRNA sequence
tgtaatcctagcactttggg

SEQ ID NO: 5933 - DNA, 20 bp, Artificial
  CRISPR gRNA sequence
tcctagcactttgggaggcc

SEQ ID NO: 5934 - DNA, 20 bp, Artificial
  CRISPR gRNA sequence
cctagcactttgggaggccg

SEQ ID NO: 5935 - DNA, 20 bp, Artificial
  CRISPR gRNA sequence
agcactttgggaggccgagg

SEQ ID NO: 5936 - DNA, 20 bp, Artificial
  CRISPR gRNA sequence
gcactttgggaggccgaggc

SEQ ID NO: 5937 - DNA, 20 bp, Artificial
  CRISPR gRNA sequence
ctttgggaggccgaggcggg

SEQ ID NO: 5938 - DNA, 20 bp, Artificial
  CRISPR gRNA sequence
ccgaggcgggtggattgctt

SEQ ID NO: 5939 - DNA, 20 bp, Artificial
  CRISPR gRNA sequence
cgaggcgggtggattgcttg

SEQ ID NO: 5940 - DNA, 20 bp, Artificial
  CRISPR gRNA sequence
gcgggtggattgcttgaggc

SEQ ID NO: 5941 - DNA, 20 bp, Artificial
  CRISPR gRNA sequence
cgggtggattgcttgaggcc

SEQ ID NO: 5942 - DNA, 20 bp, Artificial
  CRISPR gRNA sequence
ggtggattgcttgaggccag

SEQ ID NO: 5943 - DNA, 20 bp, Artificial
  CRISPR gRNA sequence
ttgcttgaggccaggagttc

SEQ ID NO: 5944 - DNA, 20 bp, Artificial
  CRISPR gRNA sequence
tgaggccaggagttcaagac

SEQ ID NO: 5945 - DNA, 20 bp, Artificial
  CRISPR gRNA sequence
ccaggagttcaagaccagcc

SEQ ID NO: 5946 - DNA, 20 bp, Artificial
  CRISPR gRNA sequence
caggagttcaagaccagcct

SEQ ID NO: 5947 - DNA, 20 bp, Artificial
  CRISPR gRNA sequence
caagaccagcctgggcaacc

SEQ ID NO: 5948 - DNA, 20 bp, Artificial
  CRISPR gRNA sequence
agaccagcctgggcaacctg

SEQ ID NO: 5949 - DNA, 20 bp, Artificial
  CRISPR gRNA sequence
taaaacacttttttgtgttt

SEQ ID NO: 5950 - DNA, 20 bp, Artificial
  CRISPR gRNA sequence
acacttttttgtgttttagc

SEQ ID NO: 5951 - DNA, 20 bp, Artificial
  CRISPR gRNA sequence
cacttttttgtgttttagcc

SEQ ID NO: 5952 - DNA, 20 bp, Artificial
  CRISPR gRNA sequence
ttttgtgttttagccgggca

SEQ ID NO: 5953 - DNA, 20 bp, Artificial
  CRISPR gRNA sequence
tgtgttttagccgggcatgg

SEQ ID NO: 5954 - DNA, 20 bp, Artificial
  CRISPR gRNA sequence
cacctgtaatctcaactact

SEQ ID NO: 5955 - DNA, 20 bp, Artificial
  CRISPR gRNA sequence
acctgtaatctcaactactt

SEQ ID NO: 5956 - DNA, 20 bp, Artificial
  CRISPR gRNA sequence
ctgtaatctcaactacttgg

SEQ ID NO: 5957 - DNA, 20 bp, Artificial
  CRISPR gRNA sequence
tgtaatctcaactacttggg

SEQ ID NO: 5958 - DNA, 20 bp, Artificial
  CRISPR gRNA sequence
tctcaactacttgggaggct

SEQ ID NO: 5959 - DNA, 20 bp, Artificial
  CRISPR gRNA sequence
ctcaactacttgggaggctg

SEQ ID NO: 5960 - DNA, 20 bp, Artificial
  CRISPR gRNA sequence
tacttgggaggctgaggcac

SEQ ID NO: 5961 - DNA, 20 bp, Artificial
  CRISPR gRNA sequence
cacgagaatcacttgaaccc

SEQ ID NO: 5962 - DNA, 20 bp, Artificial
  CRISPR gRNA sequence
cgagaatcacttgaacccaa

SEQ ID NO: 5963 - DNA, 20 bp, Artificial
  CRISPR gRNA sequence
gagaatcacttgaacccaag

SEQ ID NO: 5964 - DNA, 20 bp, Artificial
  CRISPR gRNA sequence
aatcacttgaacccaagagg

SEQ ID NO: 5965 - DNA, 20 bp, Artificial
  CRISPR gRNA sequence
tcacttgaacccaagaggcg

SEQ ID NO: 5966 - DNA, 20 bp, Artificial
  CRISPR gRNA sequence
ccaagaggcggagtttaccc

SEQ ID NO: 5967 - DNA, 20 bp, Artificial
  CRISPR gRNA sequence
aagaggcggagtttacccga

SEQ ID NO: 5968 - DNA, 20 bp, Artificial
  CRISPR gRNA sequence
agaggcggagtttacccgag

SEQ ID NO: 5969 - DNA, 20 bp, Artificial
  CRISPR gRNA sequence
ggcggagtttacccgagagg

SEQ ID NO: 5970 - DNA, 20 bp, Artificial
  CRISPR gRNA sequence
cggagtttacccgagaggtg

SEQ ID NO: 5971 - DNA, 20 bp, Artificial
  CRISPR gRNA sequence
ggagtttacccgagaggtgg

SEQ ID NO: 5972 - DNA, 20 bp, Artificial
  CRISPR gRNA sequence
ccgagaggtggaggttaccc

SEQ ID NO: 5973 - DNA, 20 bp, Artificial
  CRISPR gRNA sequence
gagaggtggaggttacccga

SEQ ID NO: 5974 - DNA, 20 bp, Artificial
  CRISPR gRNA sequence
gtggaggttacccgagagct

SEQ ID NO: 5975 - DNA, 20 bp, Artificial
  CRISPR gRNA sequence
gagattgcaccactgcacgc

SEQ ID NO: 5976 - DNA, 20 bp, Artificial
  CRISPR gRNA sequence
tgcaccactgcacgccagcc

SEQ ID NO: 5977 - DNA, 20 bp, Artificial
  CRISPR gRNA sequence
gcaccactgcacgccagcct

SEQ ID NO: 5978 - DNA, 20 bp, Artificial
  CRISPR gRNA sequence
ctgcacgccagcctgggcaa

SEQ ID NO: 5979 - DNA, 20 bp, Artificial
  CRISPR gRNA sequence
gcacgccagcctgggcaaca

SEQ ID NO: 5980 - DNA, 20 bp, Artificial
  CRISPR gRNA sequence
gccagcctgggcaacagagc

SEQ ID NO: 5981 - DNA, 20 bp, Artificial
  CRISPR gRNA sequence
gcaacagagcaagactgtct

SEQ ID NO: 5982 - DNA, 20 bp, Artificial
  CRISPR gRNA sequence
caacagagcaagactgtctc

SEQ ID NO: 5983 - DNA, 20 bp, Artificial
  CRISPR gRNA sequence
gactgtctcaggaaaaaaaa

SEQ ID NO: 5984 - DNA, 20 bp, Artificial
  CRISPR gRNA sequence
ctgtctcaggaaaaaaaaaa

SEQ ID NO: 5985 - DNA, 20 bp, Artificial
  CRISPR gRNA sequence
gtctcaggaaaaaaaaaaga

SEQ ID NO: 5986 - DNA, 20 bp, Artificial
  CRISPR gRNA sequence
ctcaggaaaaaaaaaagaga

SEQ ID NO: 5987 - DNA, 20 bp, Artificial
  CRISPR gRNA sequence
aaaaaaaaagagagagaaaa

SEQ ID NO: 5988 - DNA, 20 bp, Artificial
  CRISPR gRNA sequence
aaaaagagagagaaaaaagt

SEQ ID NO: 5989 - DNA, 20 bp, Artificial
  CRISPR gRNA sequence
aaagagagagaaaaaagtca

SEQ ID NO: 5990 - DNA, 20 bp, Artificial
  CRISPR gRNA sequence
agagagagaaaaaagtcaga

SEQ ID NO: 5991 - DNA, 20 bp, Artificial
  CRISPR gRNA sequence
gagagagaaaaaagtcagag

SEQ ID NO: 5992 - DNA, 20 bp, Artificial
  CRISPR gRNA sequence
gagaaaaaagtcagagagga

SEQ ID NO: 5993 - DNA, 20 bp, Artificial
  CRISPR gRNA sequence
aaaagtcagagaggaaagca

SEQ ID NO: 5994 - DNA, 20 bp, Artificial
  CRISPR gRNA sequence
aaagtcagagaggaaagcat

SEQ ID NO: 5995 - DNA, 20 bp, Artificial
  CRISPR gRNA sequence
gtcagagaggaaagcatagg

SEQ ID NO: 5996 - DNA, 20 bp, Artificial
  CRISPR gRNA sequence
gagaggaaagcataggcaga

SEQ ID NO: 5997 - DNA, 20 bp, Artificial
  CRISPR gRNA sequence
agaggaaagcataggcagat

SEQ ID NO: 5998 - DNA, 20 bp, Artificial
  CRISPR gRNA sequence
aggaaagcataggcagatgg

SEQ ID NO: 5999 - DNA, 20 bp, Artificial
  CRISPR gRNA sequence
ggaaagcataggcagatggg

SEQ ID NO: 6000 - DNA, 20 bp, Artificial
  CRISPR gRNA sequence
aggcagatgggaggtttcca

SEQ ID NO: 6001 - DNA, 20 bp, Artificial
  CRISPR gRNA sequence
atgggaggtttccaaagacc

SEQ ID NO: 6002 - DNA, 20 bp, Artificial
  CRISPR gRNA sequence
tccaaagaccaagacacaca

SEQ ID NO: 6003 - DNA, 20 bp, Artificial
  CRISPR gRNA sequence
accaagacacacacagtcaa

SEQ ID NO: 6004 - DNA, 20 bp, Artificial
  CRISPR gRNA sequence
agacacacacagtcaaaaga

SEQ ID NO: 6005 - DNA, 20 bp, Artificial
  CRISPR gRNA sequence
cacacagtcaaaagacagtt

SEQ ID NO: 6006 - DNA, 20 bp, Artificial
  CRISPR gRNA sequence
cagtcaaaagacagttcaga

SEQ ID NO: 6007 - DNA, 20 bp, Artificial
  CRISPR gRNA sequence
agtcaaaagacagttcagaa

SEQ ID NO: 6008 - DNA, 20 bp, Artificial
  CRISPR gRNA sequence
gtcaaaagacagttcagaaa

SEQ ID NO: 6009 - DNA, 20 bp, Artificial
  CRISPR gRNA sequence
tcaaaagacagttcagaaag

SEQ ID NO: 6010 - DNA, 20 bp, Artificial
  CRISPR gRNA sequence
gacagttcagaaaggggcat

SEQ ID NO: 6011 - DNA, 20 bp, Artificial
  CRISPR gRNA sequence
ttagttaccaccgattctca

SEQ ID NO: 6012 - DNA, 20 bp, Artificial
  CRISPR gRNA sequence
tagttaccaccgattctcat

SEQ ID NO: 6013 - DNA, 20 bp, Artificial
  CRISPR gRNA sequence
ttaccaccgattctcatagg

SEQ ID NO: 6014 - DNA, 20 bp, Artificial
  CRISPR gRNA sequence
taccaccgattctcatagga

SEQ ID NO: 6015 - DNA, 20 bp, Artificial
  CRISPR gRNA sequence
cgattctcataggaaggaca

SEQ ID NO: 6016 - DNA, 20 bp, Artificial
  CRISPR gRNA sequence
tctcataggaaggacataga

SEQ ID NO: 6017 - DNA, 20 bp, Artificial
  CRISPR gRNA sequence
ggaaggacatagatagtttt

SEQ ID NO: 6018 - DNA, 20 bp, Artificial
  CRISPR gRNA sequence
ccttcaatccttctgacatc

SEQ ID NO: 6019 - DNA, 20 bp, Artificial
  CRISPR gRNA sequence
cttcaatccttctgacatca

SEQ ID NO: 6020 - DNA, 20 bp, Artificial
  CRISPR gRNA sequence
tccttctgacatcaaggaca

SEQ ID NO: 6021 - DNA, 20 bp, Artificial
  CRISPR gRNA sequence
tgattttccctgatgtttga

SEQ ID NO: 6022 - DNA, 20 bp, Artificial
  CRISPR gRNA sequence
acagtgccctaatgcttgct

SEQ ID NO: 6023 - DNA, 20 bp, Artificial
  CRISPR gRNA sequence
gctaagatttctttttaaca

SEQ ID NO: 6024 - DNA, 20 bp, Artificial
  CRISPR gRNA sequence
aagatttctttttaacaaag

SEQ ID NO: 6025 - DNA, 20 bp, Artificial
  CRISPR gRNA sequence
ttctttttaacaaagtggta

SEQ ID NO: 6026 - DNA, 20 bp, Artificial
  CRISPR gRNA sequence
tttttaacaaagtggtaaag

SEQ ID NO: 6027 - DNA, 20 bp, Artificial
  CRISPR gRNA sequence
aacaaagtggtaaagaagct

SEQ ID NO: 6028 - DNA, 20 bp, Artificial
  CRISPR gRNA sequence
taaagaagctgagattattt

SEQ ID NO: 6029 - DNA, 20 bp, Artificial
  CRISPR gRNA sequence
attgtttctttttcaaccac

SEQ ID NO: 6030 - DNA, 20 bp, Artificial
  CRISPR gRNA sequence
tcaaccacaagtgatactgt

SEQ ID NO: 6031 - DNA, 20 bp, Artificial
  CRISPR gRNA sequence
cacaagtgatactgttggtt

SEQ ID NO: 6032 - DNA, 20 bp, Artificial
  CRISPR gRNA sequence
tttgcttttccgtttataca

SEQ ID NO: 6033 - DNA, 20 bp, Artificial
  CRISPR gRNA sequence
ccgtttatacatggaaaaaa

SEQ ID NO: 6034 - DNA, 20 bp, Artificial
  CRISPR gRNA sequence
gttttctttttgtaaaatca

SEQ ID NO: 6035 - DNA, 20 bp, Artificial
  CRISPR gRNA sequence
ccactttcaaatgtacattt

SEQ ID NO: 6036 - DNA, 20 bp, Artificial
  CRISPR gRNA sequence
ctttcaaatgtacatttcag

SEQ ID NO: 6037 - DNA, 20 bp, Artificial
  CRISPR gRNA sequence
cctccgctaccatccatctc

SEQ ID NO: 6038 - DNA, 20 bp, Artificial
  CRISPR gRNA sequence
aaactgaaactctacccaat

SEQ ID NO: 6039 - DNA, 20 bp, Artificial
  CRISPR gRNA sequence
tccccactgccccttccacc

SEQ ID NO: 6040 - DNA, 20 bp, Artificial
  CRISPR gRNA sequence
tgccccttccacccagctcg

SEQ ID NO: 6041 - DNA, 20 bp, Artificial
  CRISPR gRNA sequence
aacttcctgtctctatgttt

SEQ ID NO: 6042 - DNA, 20 bp, Artificial
  CRISPR gRNA sequence
acttcctgtctctatgtttt

SEQ ID NO: 6043 - DNA, 20 bp, Artificial
  CRISPR gRNA sequence
ctctatgttttgggctactc

SEQ ID NO: 6044 - DNA, 20 bp, Artificial
  CRISPR gRNA sequence
ctctagacaccgcctataaa

SEQ ID NO: 6045 - DNA, 20 bp, Artificial
  CRISPR gRNA sequence
gatatttgtctttttgtgcc

SEQ ID NO: 6046 - DNA, 20 bp, Artificial
  CRISPR gRNA sequence
tgtgcctggcttctttcact

SEQ ID NO: 6047 - DNA, 20 bp, Artificial
  CRISPR gRNA sequence
tcacttagcataatgtcttc

SEQ ID NO: 6048 - DNA, 20 bp, Artificial
  CRISPR gRNA sequence
cacttagcataatgtcttcc

SEQ ID NO: 6049 - DNA, 20 bp, Artificial
  CRISPR gRNA sequence
ccatgtgtaattcctttcta

SEQ ID NO: 6050 - DNA, 20 bp, Artificial
  CRISPR gRNA sequence
tgtgtaattcctttctatgg

SEQ ID NO: 6051 - DNA, 20 bp, Artificial
  CRISPR gRNA sequence
aattcctttctatggcggaa

SEQ ID NO: 6052 - DNA, 20 bp, Artificial
  CRISPR gRNA sequence
cggaatagtattctaatatg

SEQ ID NO: 6053 - DNA, 20 bp, Artificial
  CRISPR gRNA sequence
ttcatccattcatttgttga

SEQ ID NO: 6054 - DNA, 20 bp, Artificial
  CRISPR gRNA sequence
ttcatttgttgatagacact

SEQ ID NO: 6055 - DNA, 20 bp, Artificial
  CRISPR gRNA sequence
tcatttgttgatagacactt

SEQ ID NO: 6056 - DNA, 20 bp, Artificial
  CRISPR gRNA sequence
actattgtgaataatcttgc

SEQ ID NO: 6057 - DNA, 20 bp, Artificial
  CRISPR gRNA sequence
ctattgtgaataatcttgct

SEQ ID NO: 6058 - DNA, 20 bp, Artificial
  CRISPR gRNA sequence
gaataatcttgctaggtaca

SEQ ID NO: 6059 - DNA, 20 bp, Artificial
  CRISPR gRNA sequence
aataatcttgctaggtacat

SEQ ID NO: 6060 - DNA, 20 bp, Artificial
  CRISPR gRNA sequence
aatcttgctaggtacatggg

SEQ ID NO: 6061 - DNA, 20 bp, Artificial
  CRISPR gRNA sequence
tgactccccgctttcaactc

SEQ ID NO: 6062 - DNA, 20 bp, Artificial
  CRISPR gRNA sequence
tccccgctttcaactctaga

SEQ ID NO: 6063 - DNA, 20 bp, Artificial
  CRISPR gRNA sequence
agaaagctttcttttaaaat

SEQ ID NO: 6064 - DNA, 20 bp, Artificial
  CRISPR gRNA sequence
cttttaaaatcggtctattt

SEQ ID NO: 6065 - DNA, 20 bp, Artificial
  CRISPR gRNA sequence
tctatttaagtttctttaaa

SEQ ID NO: 6066 - DNA, 20 bp, Artificial
  CRISPR gRNA sequence
tttctttaaaaagttaattt

SEQ ID NO: 6067 - DNA, 20 bp, Artificial
  CRISPR gRNA sequence
gttaatttaagaaaaatact

SEQ ID NO: 6068 - DNA, 20 bp, Artificial
  CRISPR gRNA sequence
ttaatttaagaaaaatacta

SEQ ID NO: 6069 - DNA, 20 bp, Artificial
  CRISPR gRNA sequence
aaaaatactaaggtaaattg

SEQ ID NO: 6070 - DNA, 20 bp, Artificial
  CRISPR gRNA sequence
tactaaggtaaattgtagaa

SEQ ID NO: 6071 - DNA, 20 bp, Artificial
  CRISPR gRNA sequence
actaaggtaaattgtagaac

SEQ ID NO: 6072 - DNA, 20 bp, Artificial
  CRISPR gRNA sequence
atatgaccccaaaaattgta

SEQ ID NO: 6073 - DNA, 20 bp, Artificial
  CRISPR gRNA sequence
gaccccaaaaattgtaaaga

SEQ ID NO: 6074 - DNA, 20 bp, Artificial
  CRISPR gRNA sequence
cccaaaaattgtaaagatgg

SEQ ID NO: 6075 - DNA, 20 bp, Artificial
  CRISPR gRNA sequence
agatggaagacgaatgcctg

SEQ ID NO: 6076 - DNA, 20 bp, Artificial
  CRISPR gRNA sequence
gaagacgaatgcctgcagtt

SEQ ID NO: 6077 - DNA, 20 bp, Artificial
  CRISPR gRNA sequence
aagacgaatgcctgcagttt

SEQ ID NO: 6078 - DNA, 20 bp, Artificial
  CRISPR gRNA sequence
atgcctgcagtttgggaaac

SEQ ID NO: 6079 - DNA, 20 bp, Artificial
  CRISPR gRNA sequence
tgcagtttgggaaaccggat

SEQ ID NO: 6080 - DNA, 20 bp, Artificial
  CRISPR gRNA sequence
cagtttgggaaaccggatga

SEQ ID NO: 6081 - DNA, 20 bp, Artificial
  CRISPR gRNA sequence
agtttgggaaaccggatgag

SEQ ID NO: 6082 - DNA, 20 bp, Artificial
  CRISPR gRNA sequence
tgggaaaccggatgagagga

SEQ ID NO: 6083 - DNA, 20 bp, Artificial
  CRISPR gRNA sequence
accggatgagaggaaagacc

SEQ ID NO: 6084 - DNA, 20 bp, Artificial
  CRISPR gRNA sequence
ggatgagaggaaagacctgg

SEQ ID NO: 6085 - DNA, 20 bp, Artificial
  CRISPR gRNA sequence
gctattgtaaaatctatgct

SEQ ID NO: 6086 - DNA, 20 bp, Artificial
  CRISPR gRNA sequence
ctattgtaaaatctatgctg

SEQ ID NO: 6087 - DNA, 20 bp, Artificial
  CRISPR gRNA sequence
tattgtaaaatctatgctga

SEQ ID NO: 6088 - DNA, 20 bp, Artificial
  CRISPR gRNA sequence
taaaatctatgctgagggtc

SEQ ID NO: 6089 - DNA, 20 bp, Artificial
  CRISPR gRNA sequence
gctgagggtctggtgactac

SEQ ID NO: 6090 - DNA, 20 bp, Artificial
  CRISPR gRNA sequence
ggtctggtgactactagacc

SEQ ID NO: 6091 - DNA, 20 bp, Artificial
  CRISPR gRNA sequence
gtctggtgactactagacca

SEQ ID NO: 6092 - DNA, 20 bp, Artificial
  CRISPR gRNA sequence
tctggtgactactagaccaa

SEQ ID NO: 6093 - DNA, 20 bp, Artificial
  CRISPR gRNA sequence
tgactactagaccaagggca

SEQ ID NO: 6094 - DNA, 20 bp, Artificial
  CRISPR gRNA sequence
ctactagaccaagggcatgg

SEQ ID NO: 6095 - DNA, 20 bp, Artificial
  CRISPR gRNA sequence
ctagaccaagggcatggcag

SEQ ID NO: 6096 - DNA, 20 bp, Artificial
  CRISPR gRNA sequence
agaccaagggcatggcagca

SEQ ID NO: 6097 - DNA, 20 bp, Artificial
  CRISPR gRNA sequence
gaccaagggcatggcagcag

SEQ ID NO: 6098 - DNA, 20 bp, Artificial
  CRISPR gRNA sequence
accaagggcatggcagcaga

SEQ ID NO: 6099 - DNA, 20 bp, Artificial
  CRISPR gRNA sequence
aagggcatggcagcagaggg

SEQ ID NO: 6100 - DNA, 20 bp, Artificial
  CRISPR gRNA sequence
tggcagcagagggcagctga

SEQ ID NO: 6101 - DNA, 20 bp, Artificial
  CRISPR gRNA sequence
agagggcagctgaaagactt

SEQ ID NO: 6102 - DNA, 20 bp, Artificial
  CRISPR gRNA sequence
gagggcagctgaaagacttc

SEQ ID NO: 6103 - DNA, 20 bp, Artificial
  CRISPR gRNA sequence
ggcagctgaaagacttcagg

SEQ ID NO: 6104 - DNA, 20 bp, Artificial
  CRISPR gRNA sequence
gcagctgaaagacttcagga

SEQ ID NO: 6105 - DNA, 20 bp, Artificial
  CRISPR gRNA sequence
ctgaaagacttcaggaagga

SEQ ID NO: 6106 - DNA, 20 bp, Artificial
  CRISPR gRNA sequence
acttcaggaaggaaagatat

SEQ ID NO: 6107 - DNA, 20 bp, Artificial
  CRISPR gRNA sequence
gaaggaaagatataagaatt

SEQ ID NO: 6108 - DNA, 20 bp, Artificial
  CRISPR gRNA sequence
gaaagatataagaattaaga

SEQ ID NO: 6109 - DNA, 20 bp, Artificial
  CRISPR gRNA sequence
aaagatataagaattaagaa

SEQ ID NO: 6110 - DNA, 20 bp, Artificial
  CRISPR gRNA sequence
aagatataagaattaagaaa

SEQ ID NO: 6111 - DNA, 20 bp, Artificial
  CRISPR gRNA sequence
agatataagaattaagaaag

SEQ ID NO: 6112 - DNA, 20 bp, Artificial
  CRISPR gRNA sequence
taagaattaagaaaggggcc

SEQ ID NO: 6113 - DNA, 20 bp, Artificial
  CRISPR gRNA sequence
attaagaaaggggcctggtg

SEQ ID NO: 6114 - DNA, 20 bp, Artificial
  CRISPR gRNA sequence
aagaaaggggcctggtgcag

SEQ ID NO: 6115 - DNA, 20 bp, Artificial
  CRISPR gRNA sequence
tgcctgtaattccatcacct

SEQ ID NO: 6116 - DNA, 20 bp, Artificial
  CRISPR gRNA sequence
gcctgtaattccatcacctt

SEQ ID NO: 6117 - DNA, 20 bp, Artificial
  CRISPR gRNA sequence
ctgtaattccatcaccttgg

SEQ ID NO: 6118 - DNA, 20 bp, Artificial
  CRISPR gRNA sequence
tgtaattccatcaccttggg

SEQ ID NO: 6119 - DNA, 20 bp, Artificial
  CRISPR gRNA sequence
ttccatcaccttgggaggtc

SEQ ID NO: 6120 - DNA, 20 bp, Artificial
  CRISPR gRNA sequence
tccatcaccttgggaggtca

SEQ ID NO: 6121 - DNA, 20 bp, Artificial
  CRISPR gRNA sequence
atcaccttgggaggtcaagg

SEQ ID NO: 6122 - DNA, 20 bp, Artificial
  CRISPR gRNA sequence
tcaccttgggaggtcaaggc

SEQ ID NO: 6123 - DNA, 20 bp, Artificial
  CRISPR gRNA sequence
gggaggtcaaggcaggatga

SEQ ID NO: 6124 - DNA, 20 bp, Artificial
  CRISPR gRNA sequence
tcaaggcaggatgatggctt

SEQ ID NO: 6125 - DNA, 20 bp, Artificial
  CRISPR gRNA sequence
gcaggatgatggcttgagac

SEQ ID NO: 6126 - DNA, 20 bp, Artificial
  CRISPR gRNA sequence
caggatgatggcttgagacc

SEQ ID NO: 6127 - DNA, 20 bp, Artificial
  CRISPR gRNA sequence
ggatgatggcttgagaccag

SEQ ID NO: 6128 - DNA, 20 bp, Artificial
  CRISPR gRNA sequence
tggcttgagaccaggagttc

SEQ ID NO: 6129 - DNA, 20 bp, Artificial
  CRISPR gRNA sequence
tgagaccaggagttcaagac

SEQ ID NO: 6130 - DNA, 20 bp, Artificial
  CRISPR gRNA sequence
ccaggagttcaagaccagcc

SEQ ID NO: 6131 - DNA, 20 bp, Artificial
  CRISPR gRNA sequence
caggagttcaagaccagcct

SEQ ID NO: 6132 - DNA, 20 bp, Artificial
  CRISPR gRNA sequence
ttcaagaccagcctgggcaa

SEQ ID NO: 6133 - DNA, 20 bp, Artificial
  CRISPR gRNA sequence
caagaccagcctgggcaaca

SEQ ID NO: 6134 - DNA, 20 bp, Artificial
  CRISPR gRNA sequence
accagcctgggcaacagagc

SEQ ID NO: 6135 - DNA, 20 bp, Artificial
  CRISPR gRNA sequence
aacagagcaagacctttttt

SEQ ID NO: 6136 - DNA, 20 bp, Artificial
  CRISPR gRNA sequence
acagagcaagaccttttttt

SEQ ID NO: 6137 - DNA, 20 bp, Artificial
  CRISPR gRNA sequence
aaaataaatttttgaaaata

SEQ ID NO: 6138 - DNA, 20 bp, Artificial
  CRISPR gRNA sequence
atttttgaaaatacagattc

SEQ ID NO: 6139 - DNA, 20 bp, Artificial
  CRISPR gRNA sequence
tttttgaaaatacagattcc

SEQ ID NO: 6140 - DNA, 20 bp, Artificial
  CRISPR gRNA sequence
tgaaaatacagattccaggc

SEQ ID NO: 6141 - DNA, 20 bp, Artificial
  CRISPR gRNA sequence
gaaaatacagattccaggcc

SEQ ID NO: 6142 - DNA, 20 bp, Artificial
  CRISPR gRNA sequence
tacagattccaggccgggca

SEQ ID NO: 6143 - DNA, 20 bp, Artificial
  CRISPR gRNA sequence
agattccaggccgggcatgg

SEQ ID NO: 6144 - DNA, 20 bp, Artificial
  CRISPR gRNA sequence
gtggctcacacctgtaaccc

SEQ ID NO: 6145 - DNA, 20 bp, Artificial
  CRISPR gRNA sequence
cacctgtaaccccagcactt

SEQ ID NO: 6146 - DNA, 20 bp, Artificial
  CRISPR gRNA sequence
acctgtaaccccagcacttt

SEQ ID NO: 6147 - DNA, 20 bp, Artificial
  CRISPR gRNA sequence
ctgtaaccccagcactttgg

SEQ ID NO: 6148 - DNA, 20 bp, Artificial
  CRISPR gRNA sequence
tgtaaccccagcactttggg

SEQ ID NO: 6149 - DNA, 20 bp, Artificial
  CRISPR gRNA sequence
ccccagcactttgggaggct

SEQ ID NO: 6150 - DNA, 20 bp, Artificial
  CRISPR gRNA sequence
cccagcactttgggaggctg

SEQ ID NO: 6151 - DNA, 20 bp, Artificial
  CRISPR gRNA sequence
gcactttgggaggctgaggc

SEQ ID NO: 6152 - DNA, 20 bp, Artificial
  CRISPR gRNA sequence
ctttgggaggctgaggccgg

SEQ ID NO: 6153 - DNA, 20 bp, Artificial
  CRISPR gRNA sequence
gctgaggccggtggatcacc

SEQ ID NO: 6154 - DNA, 20 bp, Artificial
  CRISPR gRNA sequence
ctgaggccggtggatcacct

SEQ ID NO: 6155 - DNA, 20 bp, Artificial
  CRISPR gRNA sequence
gccggtggatcacctgggat

SEQ ID NO: 6156 - DNA, 20 bp, Artificial
  CRISPR gRNA sequence
ccggtggatcacctgggatc

SEQ ID NO: 6157 - DNA, 20 bp, Artificial
  CRISPR gRNA sequence
ggtggatcacctgggatcag

SEQ ID NO: 6158 - DNA, 20 bp, Artificial
  CRISPR gRNA sequence
tcacctgggatcaggagttc

SEQ ID NO: 6159 - DNA, 20 bp, Artificial
  CRISPR gRNA sequence
tgggatcaggagttcgagac

SEQ ID NO: 6160 - DNA, 20 bp, Artificial
  CRISPR gRNA sequence
tcaggagttcgagaccagcc

SEQ ID NO: 6161 - DNA, 20 bp, Artificial
  CRISPR gRNA sequence
caggagttcgagaccagcct

SEQ ID NO: 6162 - DNA, 20 bp, Artificial
  CRISPR gRNA sequence
cgagaccagcctgggcaaca

SEQ ID NO: 6163 - DNA, 20 bp, Artificial
  CRISPR gRNA sequence
ctctcctaaaaatacaaaat

SEQ ID NO: 6164 - DNA, 20 bp, Artificial
  CRISPR gRNA sequence
cctaaaaatacaaaattagc

SEQ ID NO: 6165 - DNA, 20 bp, Artificial
  CRISPR gRNA sequence
ctaaaaatacaaaattagcc

SEQ ID NO: 6166 - DNA, 20 bp, Artificial
  CRISPR gRNA sequence
aatacaaaattagccgggtg

SEQ ID NO: 6167 - DNA, 20 bp, Artificial
  CRISPR gRNA sequence
acaaaattagccgggtgtag

SEQ ID NO: 6168 - DNA, 20 bp, Artificial
  CRISPR gRNA sequence
gtggtgcatgcctgtaatcc

SEQ ID NO: 6169 - DNA, 20 bp, Artificial
  CRISPR gRNA sequence
tgcctgtaatcccagctact

SEQ ID NO: 6170 - DNA, 20 bp, Artificial
  CRISPR gRNA sequence
ctgtaatcccagctactcgg

SEQ ID NO: 6171 - DNA, 20 bp, Artificial
  CRISPR gRNA sequence
tgtaatcccagctactcggt

SEQ ID NO: 6172 - DNA, 20 bp, Artificial
  CRISPR gRNA sequence
atcccagctactcggtaggc

SEQ ID NO: 6173 - DNA, 20 bp, Artificial
  CRISPR gRNA sequence
ccagctactcggtaggctgg

SEQ ID NO: 6174 - DNA, 20 bp, Artificial
  CRISPR gRNA sequence
agctactcggtaggctggtg

SEQ ID NO: 6175 - DNA, 20 bp, Artificial
  CRISPR gRNA sequence
gctactcggtaggctggtgg

SEQ ID NO: 6176 - DNA, 20 bp, Artificial
  CRISPR gRNA sequence
tactcggtaggctggtggag

SEQ ID NO: 6177 - DNA, 20 bp, Artificial
  CRISPR gRNA sequence
ggaggagaatcgcctgaacc

SEQ ID NO: 6178 - DNA, 20 bp, Artificial
  CRISPR gRNA sequence
gaggagaatcgcctgaaccc

SEQ ID NO: 6179 - DNA, 20 bp, Artificial
  CRISPR gRNA sequence
ggagaatcgcctgaacccag

SEQ ID NO: 6180 - DNA, 20 bp, Artificial
  CRISPR gRNA sequence
gagaatcgcctgaacccagg

SEQ ID NO: 6181 - DNA, 20 bp, Artificial
  CRISPR gRNA sequence
aatcgcctgaacccaggagg

SEQ ID NO: 6182 - DNA, 20 bp, Artificial
  CRISPR gRNA sequence
tcgcctgaacccaggaggcg

SEQ ID NO: 6183 - DNA, 20 bp, Artificial
  CRISPR gRNA sequence
aacccaggaggcggagattg

SEQ ID NO: 6184 - DNA, 20 bp, Artificial
  CRISPR gRNA sequence
caggaggcggagattgcggt

SEQ ID NO: 6185 - DNA, 20 bp, Artificial
  CRISPR gRNA sequence
ggcggagattgcggtgagcc

SEQ ID NO: 6186 - DNA, 20 bp, Artificial
  CRISPR gRNA sequence
gagatcacaccattgcactc

SEQ ID NO: 6187 - DNA, 20 bp, Artificial
  CRISPR gRNA sequence
cacaccattgcactccagcc

SEQ ID NO: 6188 - DNA, 20 bp, Artificial
  CRISPR gRNA sequence
acaccattgcactccagcct

SEQ ID NO: 6189 - DNA, 20 bp, Artificial
  CRISPR gRNA sequence
tgcactccagcctgggcaac

SEQ ID NO: 6190 - DNA, 20 bp, Artificial
  CRISPR gRNA sequence
cactccagcctgggcaacaa

SEQ ID NO: 6191 - DNA, 20 bp, Artificial
  CRISPR gRNA sequence
ctccgtctcaaaaaaaatga

SEQ ID NO: 6192 - DNA, 20 bp, Artificial
  CRISPR gRNA sequence
aaaaaaaatgaaagaaaata

SEQ ID NO: 6193 - DNA, 20 bp, Artificial
  CRISPR gRNA sequence
tgaaagaaaatacagattcc

SEQ ID NO: 6194 - DNA, 20 bp, Artificial
  CRISPR gRNA sequence
gaaagaaaatacagattcct

SEQ ID NO: 6195 - DNA, 20 bp, Artificial
  CRISPR gRNA sequence
aaaatacagattcctgggcc

SEQ ID NO: 6196 - DNA, 20 bp, Artificial
  CRISPR gRNA sequence
cagattcctgggcccggctg

SEQ ID NO: 6197 - DNA, 20 bp, Artificial
  CRISPR gRNA sequence
ccggctgcagactccctgaa

SEQ ID NO: 6198 - DNA, 20 bp, Artificial
  CRISPR gRNA sequence
gactccctgaatagaatcac

SEQ ID NO: 6199 - DNA, 20 bp, Artificial
  CRISPR gRNA sequence
actccctgaatagaatcact

SEQ ID NO: 6200 - DNA, 20 bp, Artificial
  CRISPR gRNA sequence
ctccctgaatagaatcactg

SEQ ID NO: 6201 - DNA, 20 bp, Artificial
  CRISPR gRNA sequence
tccctgaatagaatcactgg

SEQ ID NO: 6202 - DNA, 20 bp, Artificial
  CRISPR gRNA sequence
tgaatagaatcactgggggt

SEQ ID NO: 6203 - DNA, 20 bp, Artificial
  CRISPR gRNA sequence
gaatagaatcactgggggtg

SEQ ID NO: 6204 - DNA, 20 bp, Artificial
  CRISPR gRNA sequence
gaatcactgggggtgaggcc

SEQ ID NO: 6205 - DNA, 20 bp, Artificial
  CRISPR gRNA sequence
aatcactgggggtgaggccc

SEQ ID NO: 6206 - DNA, 20 bp, Artificial
  CRISPR gRNA sequence
tgtgtttttaacacccttcc

SEQ ID NO: 6207 - DNA, 20 bp, Artificial
  CRISPR gRNA sequence
gtgtttttaacacccttccc

SEQ ID NO: 6208 - DNA, 20 bp, Artificial
  CRISPR gRNA sequence
tcccaggtaattctcactca

SEQ ID NO: 6209 - DNA, 20 bp, Artificial
  CRISPR gRNA sequence
ggtaattctcactcacagcc

SEQ ID NO: 6210 - DNA, 20 bp, Artificial
  CRISPR gRNA sequence
ctcacagccaagcctgccga

SEQ ID NO: 6211 - DNA, 20 bp, Artificial
  CRISPR gRNA sequence
cagccaagcctgccgatggc

SEQ ID NO: 6212 - DNA, 20 bp, Artificial
  CRISPR gRNA sequence
ctgccgatggctggactccg

SEQ ID NO: 6213 - DNA, 20 bp, Artificial
  CRISPR gRNA sequence
cgatggctggactccgtagt

SEQ ID NO: 6214 - DNA, 20 bp, Artificial
  CRISPR gRNA sequence
tggactccgtagtcagatct

SEQ ID NO: 6215 - DNA, 20 bp, Artificial
  CRISPR gRNA sequence
ctccgtagtcagatctcagc

SEQ ID NO: 6216 - DNA, 20 bp, Artificial
  CRISPR gRNA sequence
cgtagtcagatctcagcaag

SEQ ID NO: 6217 - DNA, 20 bp, Artificial
  CRISPR gRNA sequence
gtagtcagatctcagcaagc

SEQ ID NO: 6218 - DNA, 20 bp, Artificial
  CRISPR gRNA sequence
cagatctcagcaagcaggac

SEQ ID NO: 6219 - DNA, 20 bp, Artificial
  CRISPR gRNA sequence
cagcaagcaggactggctcg

SEQ ID NO: 6220 - DNA, 20 bp, Artificial
  CRISPR gRNA sequence
gactggctcgtggttcatct

SEQ ID NO: 6221 - DNA, 20 bp, Artificial
  CRISPR gRNA sequence
actggctcgtggttcatctt

SEQ ID NO: 6222 - DNA, 20 bp, Artificial
  CRISPR gRNA sequence
ctggctcgtggttcatcttg

SEQ ID NO: 6223 - DNA, 20 bp, Artificial
  CRISPR gRNA sequence
gtggttcatcttggggtctc

SEQ ID NO: 6224 - DNA, 20 bp, Artificial
  CRISPR gRNA sequence
atcttggggtctccagcacc

SEQ ID NO: 6225 - DNA, 20 bp, Artificial
  CRISPR gRNA sequence
ttggggtctccagcacccag

SEQ ID NO: 6226 - DNA, 20 bp, Artificial
  CRISPR gRNA sequence
ggggtctccagcacccagca

SEQ ID NO: 6227 - DNA, 20 bp, Artificial
  CRISPR gRNA sequence
tccagcacccagcagagtgc

SEQ ID NO: 6228 - DNA, 20 bp, Artificial
  CRISPR gRNA sequence
agcacccagcagagtgctgg

SEQ ID NO: 6229 - DNA, 20 bp, Artificial
  CRISPR gRNA sequence
gcacccagcagagtgctggc

SEQ ID NO: 6230 - DNA, 20 bp, Artificial
  CRISPR gRNA sequence
cacccagcagagtgctggcg

SEQ ID NO: 6231 - DNA, 20 bp, Artificial
  CRISPR gRNA sequence
acccagcagagtgctggcgg

SEQ ID NO: 6232 - DNA, 20 bp, Artificial
  CRISPR gRNA sequence
cccagcagagtgctggcggg

SEQ ID NO: 6233 - DNA, 20 bp, Artificial
  CRISPR gRNA sequence
gctggcggggggactgtgtt

SEQ ID NO: 6234 - DNA, 20 bp, Artificial
  CRISPR gRNA sequence
ggcggggggactgtgttaag

SEQ ID NO: 6235 - DNA, 20 bp, Artificial
  CRISPR gRNA sequence
cggggggactgtgttaagta

SEQ ID NO: 6236 - DNA, 20 bp, Artificial
  CRISPR gRNA sequence
gggactgtgttaagtagagc

SEQ ID NO: 6237 - DNA, 20 bp, Artificial
  CRISPR gRNA sequence
ctgtgttaagtagagccgga

SEQ ID NO: 6238 - DNA, 20 bp, Artificial
  CRISPR gRNA sequence
tgtgttaagtagagccggat

SEQ ID NO: 6239 - DNA, 20 bp, Artificial
  CRISPR gRNA sequence
ttaagtagagccggatgggt

SEQ ID NO: 6240 - DNA, 20 bp, Artificial
  CRISPR gRNA sequence
taagtagagccggatgggtc

SEQ ID NO: 6241 - DNA, 20 bp, Artificial
  CRISPR gRNA sequence
agagccggatgggtcaggac

SEQ ID NO: 6242 - DNA, 20 bp, Artificial
  CRISPR gRNA sequence
agccggatgggtcaggactg

SEQ ID NO: 6243 - DNA, 20 bp, Artificial
  CRISPR gRNA sequence
gatgggtcaggactggagtg

SEQ ID NO: 6244 - DNA, 20 bp, Artificial
  CRISPR gRNA sequence
atgggtcaggactggagtgt

SEQ ID NO: 6245 - DNA, 20 bp, Artificial
  CRISPR gRNA sequence
tgggtcaggactggagtgtg

SEQ ID NO: 6246 - DNA, 20 bp, Artificial
  CRISPR gRNA sequence
caggactggagtgtggggcc

SEQ ID NO: 6247 - DNA, 20 bp, Artificial
  CRISPR gRNA sequence
gggcctggctttgctaactg

SEQ ID NO: 6248 - DNA, 20 bp, Artificial
  CRISPR gRNA sequence
gctttgctaactgcagtcac

SEQ ID NO: 6249 - DNA, 20 bp, Artificial
  CRISPR gRNA sequence
catcactccaccccctaccc

SEQ ID NO: 6250 - DNA, 20 bp, Artificial
  CRISPR gRNA sequence
tccaccccctaccccagcac

SEQ ID NO: 6251 - DNA, 20 bp, Artificial
  CRISPR gRNA sequence
ccaccccctaccccagcacc

SEQ ID NO: 6252 - DNA, 20 bp, Artificial
  CRISPR gRNA sequence
caccccctaccccagcacca

SEQ ID NO: 6253 - DNA, 20 bp, Artificial
  CRISPR gRNA sequence
ccctaccccagcaccagggt

SEQ ID NO: 6254 - DNA, 20 bp, Artificial
  CRISPR gRNA sequence
cctaccccagcaccagggtc

SEQ ID NO: 6255 - DNA, 20 bp, Artificial
  CRISPR gRNA sequence
accagggtcaggttcccttc

SEQ ID NO: 6256 - DNA, 20 bp, Artificial
  CRISPR gRNA sequence
ccagggtcaggttcccttcc

SEQ ID NO: 6257 - DNA, 20 bp, Artificial
  CRISPR gRNA sequence
cccttccaggaaaaacttgt

SEQ ID NO: 6258 - DNA, 20 bp, Artificial
  CRISPR gRNA sequence
aaacttgttggactcctttc

SEQ ID NO: 6259 - DNA, 20 bp, Artificial
  CRISPR gRNA sequence
aacttgttggactcctttcc

SEQ ID NO: 6260 - DNA, 20 bp, Artificial
  CRISPR gRNA sequence
cctttccaggtcattgactg

SEQ ID NO: 6261 - DNA, 20 bp, Artificial
  CRISPR gRNA sequence
tccaggtcattgactgcagt

SEQ ID NO: 6262 - DNA, 20 bp, Artificial
  CRISPR gRNA sequence
ccaggtcattgactgcagtt

SEQ ID NO: 6263 - DNA, 20 bp, Artificial
  CRISPR gRNA sequence
aggtcattgactgcagttag

SEQ ID NO: 6264 - DNA, 20 bp, Artificial
  CRISPR gRNA sequence
tcattgactgcagttaggag

SEQ ID NO: 6265 - DNA, 20 bp, Artificial
  CRISPR gRNA sequence
ctgcagttaggagtggcatg

SEQ ID NO: 6266 - DNA, 20 bp, Artificial
  CRISPR gRNA sequence
cagttaggagtggcatgcag

SEQ ID NO: 6267 - DNA, 20 bp, Artificial
  CRISPR gRNA sequence
agttaggagtggcatgcaga

SEQ ID NO: 6268 - DNA, 20 bp, Artificial
  CRISPR gRNA sequence
gttaggagtggcatgcagaa

SEQ ID NO: 6269 - DNA, 20 bp, Artificial
  CRISPR gRNA sequence
taggagtggcatgcagaagg

SEQ ID NO: 6270 - DNA, 20 bp, Artificial
  CRISPR gRNA sequence
aggagtggcatgcagaaggg

SEQ ID NO: 6271 - DNA, 20 bp, Artificial
  CRISPR gRNA sequence
catgcagaagggaggctatc

SEQ ID NO: 6272 - DNA, 20 bp, Artificial
  CRISPR gRNA sequence
tgcagaagggaggctatctg

SEQ ID NO: 6273 - DNA, 20 bp, Artificial
  CRISPR gRNA sequence
gaagggaggctatctggagc

SEQ ID NO: 6274 - DNA, 20 bp, Artificial
  CRISPR gRNA sequence
aagggaggctatctggagct

SEQ ID NO: 6275 - DNA, 20 bp, Artificial
  CRISPR gRNA sequence
gaggctatctggagctggga

SEQ ID NO: 6276 - DNA, 20 bp, Artificial
  CRISPR gRNA sequence
tatctggagctgggacagac

SEQ ID NO: 6277 - DNA, 20 bp, Artificial
  CRISPR gRNA sequence
atctggagctgggacagacc

SEQ ID NO: 6278 - DNA, 20 bp, Artificial
  CRISPR gRNA sequence
ggagctgggacagaccaggc

SEQ ID NO: 6279 - DNA, 20 bp, Artificial
  CRISPR gRNA sequence
gctgggacagaccaggcaag

SEQ ID NO: 6280 - DNA, 20 bp, Artificial
  CRISPR gRNA sequence
ctgggacagaccaggcaagc

SEQ ID NO: 6281 - DNA, 20 bp, Artificial
  CRISPR gRNA sequence
tgggacagaccaggcaagcg

SEQ ID NO: 6282 - DNA, 20 bp, Artificial
  CRISPR gRNA sequence
gacagaccaggcaagcgggg

SEQ ID NO: 6283 - DNA, 20 bp, Artificial
  CRISPR gRNA sequence
acagaccaggcaagcgggga

SEQ ID NO: 6284 - DNA, 20 bp, Artificial
  CRISPR gRNA sequence
cagaccaggcaagcggggaa

SEQ ID NO: 6285 - DNA, 20 bp, Artificial
  CRISPR gRNA sequence
cttatcccaaccctgcattc

SEQ ID NO: 6286 - DNA, 20 bp, Artificial
  CRISPR gRNA sequence
tcccaaccctgcattctgga

SEQ ID NO: 6287 - DNA, 20 bp, Artificial
  CRISPR gRNA sequence
cccaaccctgcattctggac

SEQ ID NO: 6288 - DNA, 20 bp, Artificial
  CRISPR gRNA sequence
ccaaccctgcattctggaca

SEQ ID NO: 6289 - DNA, 20 bp, Artificial
  CRISPR gRNA sequence
tgcattctggacagggaccg

SEQ ID NO: 6290 - DNA, 20 bp, Artificial
  CRISPR gRNA sequence
gcattctggacagggaccga

SEQ ID NO: 6291 - DNA, 20 bp, Artificial
  CRISPR gRNA sequence
gacagggaccgaaggtctcc

SEQ ID NO: 6292 - DNA, 20 bp, Artificial
  CRISPR gRNA sequence
gaccgaaggtctcctggctg

SEQ ID NO: 6293 - DNA, 20 bp, Artificial
  CRISPR gRNA sequence
tctcctggctgcagctcata

SEQ ID NO: 6294 - DNA, 20 bp, Artificial
  CRISPR gRNA sequence
gctcatcttcattctcatcc

SEQ ID NO: 6295 - DNA, 20 bp, Artificial
  CRISPR gRNA sequence
ctcatcttcattctcatcct

SEQ ID NO: 6296 - DNA, 20 bp, Artificial
  CRISPR gRNA sequence
cattctcatcctgggaccac

SEQ ID NO: 6297 - DNA, 20 bp, Artificial
  CRISPR gRNA sequence
attctcatcctgggaccacc

SEQ ID NO: 6298 - DNA, 20 bp, Artificial
  CRISPR gRNA sequence
acaataactttaccctttac

SEQ ID NO: 6299 - DNA, 20 bp, Artificial
  CRISPR gRNA sequence
ccctttactggcaaatgcac

SEQ ID NO: 6300 - DNA, 20 bp, Artificial
  CRISPR gRNA sequence
ttactggcaaatgcacaagc

SEQ ID NO: 6301 - DNA, 20 bp, Artificial
  CRISPR gRNA sequence
actggcaaatgcacaagctg

SEQ ID NO: 6302 - DNA, 20 bp, Artificial
  CRISPR gRNA sequence
aatgcacaagctggagatga

SEQ ID NO: 6303 - DNA, 20 bp, Artificial
  CRISPR gRNA sequence
ctggagatgatggcccattc

SEQ ID NO: 6304 - DNA, 20 bp, Artificial
  CRISPR gRNA sequence
tgatggcccattcgagtttt

SEQ ID NO: 6305 - DNA, 20 bp, Artificial
  CRISPR gRNA sequence
ttcgagttttaagattttcc

SEQ ID NO: 6306 - DNA, 20 bp, Artificial
  CRISPR gRNA sequence
aagattttccaagttgttat

SEQ ID NO: 6307 - DNA, 20 bp, Artificial
  CRISPR gRNA sequence
agattttccaagttgttatg

SEQ ID NO: 6308 - DNA, 20 bp, Artificial
  CRISPR gRNA sequence
tttccaagttgttatgaggt

SEQ ID NO: 6309 - DNA, 20 bp, Artificial
  CRISPR gRNA sequence
atgaggtcagtgtcctcaat

SEQ ID NO: 6310 - DNA, 20 bp, Artificial
  CRISPR gRNA sequence
tgaggtcagtgtcctcaatc

SEQ ID NO: 6311 - DNA, 20 bp, Artificial
  CRISPR gRNA sequence
cagtgtcctcaatcgggacc

SEQ ID NO: 6312 - DNA, 20 bp, Artificial
  CRISPR gRNA sequence
gtgtcctcaatcgggaccca

SEQ ID NO: 6313 - DNA, 20 bp, Artificial
  CRISPR gRNA sequence
tcctcaatcgggacccagag

SEQ ID NO: 6314 - DNA, 20 bp, Artificial
  CRISPR gRNA sequence
caatcgggacccagagaaga

SEQ ID NO: 6315 - DNA, 20 bp, Artificial
  CRISPR gRNA sequence
aatcgggacccagagaagat

SEQ ID NO: 6316 - DNA, 20 bp, Artificial
  CRISPR gRNA sequence
cgggacccagagaagatagg

SEQ ID NO: 6317 - DNA, 20 bp, Artificial
  CRISPR gRNA sequence
aggtggcttgcctgaacttt

SEQ ID NO: 6318 - DNA, 20 bp, Artificial
  CRISPR gRNA sequence
gtggcttgcctgaactttca

SEQ ID NO: 6319 - DNA, 20 bp, Artificial
  CRISPR gRNA sequence
tggcttgcctgaactttcag

SEQ ID NO: 6320 - DNA, 20 bp, Artificial
  CRISPR gRNA sequence
ggcttgcctgaactttcaga

SEQ ID NO: 6321 - DNA, 20 bp, Artificial
  CRISPR gRNA sequence
gcttgcctgaactttcagag

SEQ ID NO: 6322 - DNA, 20 bp, Artificial
  CRISPR gRNA sequence
cttgcctgaactttcagagg

SEQ ID NO: 6323 - DNA, 20 bp, Artificial
  CRISPR gRNA sequence
actttcagagggggcatctg

SEQ ID NO: 6324 - DNA, 20 bp, Artificial
  CRISPR gRNA sequence
ggcatctgtggtgtcttttg

SEQ ID NO: 6325 - DNA, 20 bp, Artificial
  CRISPR gRNA sequence
gcatctgtggtgtcttttgt

SEQ ID NO: 6326 - DNA, 20 bp, Artificial
  CRISPR gRNA sequence
catctgtggtgtcttttgtg

SEQ ID NO: 6327 - DNA, 20 bp, Artificial
  CRISPR gRNA sequence
gtgtcttttgtggggtcctg

SEQ ID NO: 6328 - DNA, 20 bp, Artificial
  CRISPR gRNA sequence
tgtcttttgtggggtcctgt

SEQ ID NO: 6329 - DNA, 20 bp, Artificial
  CRISPR gRNA sequence
taggatttccacgtccctct

SEQ ID NO: 6330 - DNA, 20 bp, Artificial
  CRISPR gRNA sequence
ggatttccacgtccctcttg

SEQ ID NO: 6331 - DNA, 20 bp, Artificial
  CRISPR gRNA sequence
gatttccacgtccctcttgg

SEQ ID NO: 6332 - DNA, 20 bp, Artificial
  CRISPR gRNA sequence
cgtccctcttggaggaaaaa

SEQ ID NO: 6333 - DNA, 20 bp, Artificial
  CRISPR gRNA sequence
ccctcttggaggaaaaatag

SEQ ID NO: 6334 - DNA, 20 bp, Artificial
  CRISPR gRNA sequence
cttggaggaaaaatagaagt

SEQ ID NO: 6335 - DNA, 20 bp, Artificial
  CRISPR gRNA sequence
aaaatagaagtaagttgtct

SEQ ID NO: 6336 - DNA, 20 bp, Artificial
  CRISPR gRNA sequence
aaatagaagtaagttgtctc

SEQ ID NO: 6337 - DNA, 20 bp, Artificial
  CRISPR gRNA sequence
agaagtaagttgtctcaggt

SEQ ID NO: 6338 - DNA, 20 bp, Artificial
  CRISPR gRNA sequence
ttgtctcaggtcagattgtc

SEQ ID NO: 6339 - DNA, 20 bp, Artificial
  CRISPR gRNA sequence
tgtctcaggtcagattgtct

SEQ ID NO: 6340 - DNA, 20 bp, Artificial
  CRISPR gRNA sequence
ctcaggtcagattgtctggg

SEQ ID NO: 6341 - DNA, 20 bp, Artificial
  CRISPR gRNA sequence
gtcagattgtctgggaagcc

SEQ ID NO: 6342 - DNA, 20 bp, Artificial
  CRISPR gRNA sequence
agattgtctgggaagccaag

SEQ ID NO: 6343 - DNA, 20 bp, Artificial
  CRISPR gRNA sequence
gattgtctgggaagccaagt

SEQ ID NO: 6344 - DNA, 20 bp, Artificial
  CRISPR gRNA sequence
ttgtctgggaagccaagtag

SEQ ID NO: 6345 - DNA, 20 bp, Artificial
  CRISPR gRNA sequence
ctgggaagccaagtaggaga

SEQ ID NO: 6346 - DNA, 20 bp, Artificial
  CRISPR gRNA sequence
gggaagccaagtaggagatg

SEQ ID NO: 6347 - DNA, 20 bp, Artificial
  CRISPR gRNA sequence
aggagatggagatttgcata

SEQ ID NO: 6348 - DNA, 20 bp, Artificial
  CRISPR gRNA sequence
ggagatggagatttgcatat

SEQ ID NO: 6349 - DNA, 20 bp, Artificial
  CRISPR gRNA sequence
agatggagatttgcatatag

SEQ ID NO: 6350 - DNA, 20 bp, Artificial
  CRISPR gRNA sequence
gatggagatttgcatatagg

SEQ ID NO: 6351 - DNA, 20 bp, Artificial
  CRISPR gRNA sequence
tttgcatataggaggtttac

SEQ ID NO: 6352 - DNA, 20 bp, Artificial
  CRISPR gRNA sequence
ttgcatataggaggtttact

SEQ ID NO: 6353 - DNA, 20 bp, Artificial
  CRISPR gRNA sequence
tgcatataggaggtttactg

SEQ ID NO: 6354 - DNA, 20 bp, Artificial
  CRISPR gRNA sequence
aggtttactggggacattca

SEQ ID NO: 6355 - DNA, 20 bp, Artificial
  CRISPR gRNA sequence
ggtttactggggacattcac

SEQ ID NO: 6356 - DNA, 20 bp, Artificial
  CRISPR gRNA sequence
tttactggggacattcacag

SEQ ID NO: 6357 - DNA, 20 bp, Artificial
  CRISPR gRNA sequence
ttactggggacattcacagg

SEQ ID NO: 6358 - DNA, 20 bp, Artificial
  CRISPR gRNA sequence
tactggggacattcacagga

SEQ ID NO: 6359 - DNA, 20 bp, Artificial
  CRISPR gRNA sequence
ttcacaggagggaacacccg

SEQ ID NO: 6360 - DNA, 20 bp, Artificial
  CRISPR gRNA sequence
tcacaggagggaacacccga

SEQ ID NO: 6361 - DNA, 20 bp, Artificial
  CRISPR gRNA sequence
ggagggaacacccgaaggaa

SEQ ID NO: 6362 - DNA, 20 bp, Artificial
  CRISPR gRNA sequence
gagggaacacccgaaggaaa

SEQ ID NO: 6363 - DNA, 20 bp, Artificial
  CRISPR gRNA sequence
agggaacacccgaaggaaaa

SEQ ID NO: 6364 - DNA, 20 bp, Artificial
  CRISPR gRNA sequence
gaacacccgaaggaaaaggg

SEQ ID NO: 6365 - DNA, 20 bp, Artificial
  CRISPR gRNA sequence
acccgaaggaaaagggaaga

SEQ ID NO: 6366 - DNA, 20 bp, Artificial
  CRISPR gRNA sequence
cgaaggaaaagggaagaaag

SEQ ID NO: 6367 - DNA, 20 bp, Artificial
  CRISPR gRNA sequence
gaaggaaaagggaagaaagc

SEQ ID NO: 6368 - DNA, 20 bp, Artificial
  CRISPR gRNA sequence
aaggaaaagggaagaaagca

SEQ ID NO: 6369 - DNA, 20 bp, Artificial
  CRISPR gRNA sequence
aaaagggaagaaagcagggt

SEQ ID NO: 6370 - DNA, 20 bp, Artificial
  CRISPR gRNA sequence
aaagggaagaaagcagggtt

SEQ ID NO: 6371 - DNA, 20 bp, Artificial
  CRISPR gRNA sequence
gggaagaaagcagggttggg

SEQ ID NO: 6372 - DNA, 20 bp, Artificial
  CRISPR gRNA sequence
aagaaagcagggttgggaag

SEQ ID NO: 6373 - DNA, 20 bp, Artificial
  CRISPR gRNA sequence
aaagcagggttgggaagcag

SEQ ID NO: 6374 - DNA, 20 bp, Artificial
  CRISPR gRNA sequence
aagcagggttgggaagcagc

SEQ ID NO: 6375 - DNA, 20 bp, Artificial
  CRISPR gRNA sequence
gcagggttgggaagcagcag

SEQ ID NO: 6376 - DNA, 20 bp, Artificial
  CRISPR gRNA sequence
gttgggaagcagcaggagtt

SEQ ID NO: 6377 - DNA, 20 bp, Artificial
  CRISPR gRNA sequence
ttgggaagcagcaggagttg

SEQ ID NO: 6378 - DNA, 20 bp, Artificial
  CRISPR gRNA sequence
gcaggagttgaggtgcaatg

SEQ ID NO: 6379 - DNA, 20 bp, Artificial
  CRISPR gRNA sequence
gaggtgcaatgcagtcacaa

SEQ ID NO: 6380 - DNA, 20 bp, Artificial
  CRISPR gRNA sequence
ggtgcaatgcagtcacaaca

SEQ ID NO: 6381 - DNA, 20 bp, Artificial
  CRISPR gRNA sequence
gtgcaatgcagtcacaacag

SEQ ID NO: 6382 - DNA, 20 bp, Artificial
  CRISPR gRNA sequence
tgcagtcacaacagaggtct

SEQ ID NO: 6383 - DNA, 20 bp, Artificial
  CRISPR gRNA sequence
agaggtcttagccaatccca

SEQ ID NO: 6384 - DNA, 20 bp, Artificial
  CRISPR gRNA sequence
gaggtcttagccaatcccat

SEQ ID NO: 6385 - DNA, 20 bp, Artificial
  CRISPR gRNA sequence
aggtcttagccaatcccata

SEQ ID NO: 6386 - DNA, 20 bp, Artificial
  CRISPR gRNA sequence
gtcttagccaatcccatagg

SEQ ID NO: 6387 - DNA, 20 bp, Artificial
  CRISPR gRNA sequence
caatcccatagggagcactc

SEQ ID NO: 6388 - DNA, 20 bp, Artificial
  CRISPR gRNA sequence
cccatagggagcactcaagc

SEQ ID NO: 6389 - DNA, 20 bp, Artificial
  CRISPR gRNA sequence
ccatagggagcactcaagct

SEQ ID NO: 6390 - DNA, 20 bp, Artificial
  CRISPR gRNA sequence
agggagcactcaagctggga

SEQ ID NO: 6391 - DNA, 20 bp, Artificial
  CRISPR gRNA sequence
agcactcaagctgggacagc

SEQ ID NO: 6392 - DNA, 20 bp, Artificial
  CRISPR gRNA sequence
gcactcaagctgggacagca

SEQ ID NO: 6393 - DNA, 20 bp, Artificial
  CRISPR gRNA sequence
ctcaagctgggacagcaagg

SEQ ID NO: 6394 - DNA, 20 bp, Artificial
  CRISPR gRNA sequence
agctgggacagcaaggaagc

SEQ ID NO: 6395 - DNA, 20 bp, Artificial
  CRISPR gRNA sequence
tctacctccgtcctcccata

SEQ ID NO: 6396 - DNA, 20 bp, Artificial
  CRISPR gRNA sequence
ctacctccgtcctcccatac

SEQ ID NO: 6397 - DNA, 20 bp, Artificial
  CRISPR gRNA sequence
tccgtcctcccatacaggca

SEQ ID NO: 6398 - DNA, 20 bp, Artificial
  CRISPR gRNA sequence
cctcccccatgatgaacact

SEQ ID NO: 6399 - DNA, 20 bp, Artificial
  CRISPR gRNA sequence
ccatgatgaacactcagcac

SEQ ID NO: 6400 - DNA, 20 bp, Artificial
  CRISPR gRNA sequence
ttgatgcatcattattaccc

SEQ ID NO: 6401 - DNA, 20 bp, Artificial
  CRISPR gRNA sequence
tgatgcatcattattaccca

SEQ ID NO: 6402 - DNA, 20 bp, Artificial
  CRISPR gRNA sequence
tcattattacccaaggtcca

SEQ ID NO: 6403 - DNA, 20 bp, Artificial
  CRISPR gRNA sequence
ggtccatggtttgtttacat

SEQ ID NO: 6404 - DNA, 20 bp, Artificial
  CRISPR gRNA sequence
gtccatggtttgtttacatg

SEQ ID NO: 6405 - DNA, 20 bp, Artificial
  CRISPR gRNA sequence
tccatggtttgtttacatga

SEQ ID NO: 6406 - DNA, 20 bp, Artificial
  CRISPR gRNA sequence
tttacatgagggtttactct

SEQ ID NO: 6407 - DNA, 20 bp, Artificial
  CRISPR gRNA sequence
tcttggtgttgtacattctg

SEQ ID NO: 6408 - DNA, 20 bp, Artificial
  CRISPR gRNA sequence
cttggtgttgtacattctgt

SEQ ID NO: 6409 - DNA, 20 bp, Artificial
  CRISPR gRNA sequence
tgttgtacattctgtgggtt

SEQ ID NO: 6410 - DNA, 20 bp, Artificial
  CRISPR gRNA sequence
gtacattctgtgggtttgga

SEQ ID NO: 6411 - DNA, 20 bp, Artificial
  CRISPR gRNA sequence
atgtaatgtatatgacatta

SEQ ID NO: 6412 - DNA, 20 bp, Artificial
  CRISPR gRNA sequence
tatgacattatagtatcaca

SEQ ID NO: 6413 - DNA, 20 bp, Artificial
  CRISPR gRNA sequence
gactcatttcacttgtgact

SEQ ID NO: 6414 - DNA, 20 bp, Artificial
  CRISPR gRNA sequence
ttaacctgcctccaactgct

SEQ ID NO: 6415 - DNA, 20 bp, Artificial
  CRISPR gRNA sequence
acctgcctccaactgctgag

SEQ ID NO: 6416 - DNA, 20 bp, Artificial
  CRISPR gRNA sequence
ccaactgctgagaagccctt

SEQ ID NO: 6417 - DNA, 20 bp, Artificial
  CRISPR gRNA sequence
ctgctgagaagccctttggc

SEQ ID NO: 6418 - DNA, 20 bp, Artificial
  CRISPR gRNA sequence
tgctgagaagccctttggct

SEQ ID NO: 6419 - DNA, 20 bp, Artificial
  CRISPR gRNA sequence
gctgagaagccctttggcta

SEQ ID NO: 6420 - DNA, 20 bp, Artificial
  CRISPR gRNA sequence
agccctttggctagggattg

SEQ ID NO: 6421 - DNA, 20 bp, Artificial
  CRISPR gRNA sequence
ttttccactttcctgctctg

SEQ ID NO: 6422 - DNA, 20 bp, Artificial
  CRISPR gRNA sequence
tctgaagttactttgtttgc

SEQ ID NO: 6423 - DNA, 20 bp, Artificial
  CRISPR gRNA sequence
tgaagttactttgtttgcca

SEQ ID NO: 6424 - DNA, 20 bp, Artificial
  CRISPR gRNA sequence
gaagttactttgtttgccag

SEQ ID NO: 6425 - DNA, 20 bp, Artificial
  CRISPR gRNA sequence
ttactttgtttgccagaggc

SEQ ID NO: 6426 - DNA, 20 bp, Artificial
  CRISPR gRNA sequence
tttgtttgccagaggctggt

SEQ ID NO: 6427 - DNA, 20 bp, Artificial
  CRISPR gRNA sequence
ggctggttggttcaaaccca

SEQ ID NO: 6428 - DNA, 20 bp, Artificial
  CRISPR gRNA sequence
gctggttggttcaaacccaa

SEQ ID NO: 6429 - DNA, 20 bp, Artificial
  CRISPR gRNA sequence
ctggttggttcaaacccaaa

SEQ ID NO: 6430 - DNA, 20 bp, Artificial
  CRISPR gRNA sequence
gttggttcaaacccaaaggg

SEQ ID NO: 6431 - DNA, 20 bp, Artificial
  CRISPR gRNA sequence
ttggttcaaacccaaagggc

SEQ ID NO: 6432 - DNA, 20 bp, Artificial
  CRISPR gRNA sequence
tggttcaaacccaaagggca

SEQ ID NO: 6433 - DNA, 20 bp, Artificial
  CRISPR gRNA sequence
gttcaaacccaaagggcagg

SEQ ID NO: 6434 - DNA, 20 bp, Artificial
  CRISPR gRNA sequence
caaagggcagggagctgcaa

SEQ ID NO: 6435 - DNA, 20 bp, Artificial
  CRISPR gRNA sequence
tgcaatggaaatccattcaa

SEQ ID NO: 6436 - DNA, 20 bp, Artificial
  CRISPR gRNA sequence
ggaaatccattcaacggtgc

SEQ ID NO: 6437 - DNA, 20 bp, Artificial
  CRISPR gRNA sequence
ccattcaacggtgctggaat

SEQ ID NO: 6438 - DNA, 20 bp, Artificial
  CRISPR gRNA sequence
cattcaacggtgctggaatt

SEQ ID NO: 6439 - DNA, 20 bp, Artificial
  CRISPR gRNA sequence
caacggtgctggaattggga

SEQ ID NO: 6440 - DNA, 20 bp, Artificial
  CRISPR gRNA sequence
gctggaattgggatggcaaa

SEQ ID NO: 6441 - DNA, 20 bp, Artificial
  CRISPR gRNA sequence
ctggaattgggatggcaaaa

SEQ ID NO: 6442 - DNA, 20 bp, Artificial
  CRISPR gRNA sequence
ggaattgggatggcaaaaag

SEQ ID NO: 6443 - DNA, 20 bp, Artificial
  CRISPR gRNA sequence
attgggatggcaaaaaggag

SEQ ID NO: 6444 - DNA, 20 bp, Artificial
  CRISPR gRNA sequence
gggatggcaaaaaggagcag

SEQ ID NO: 6445 - DNA, 20 bp, Artificial
  CRISPR gRNA sequence
ggatggcaaaaaggagcagc

SEQ ID NO: 6446 - DNA, 20 bp, Artificial
  CRISPR gRNA sequence
tggcaaaaaggagcagcagg

SEQ ID NO: 6447 - DNA, 20 bp, Artificial
  CRISPR gRNA sequence
ggcaaaaaggagcagcaggc

SEQ ID NO: 6448 - DNA, 20 bp, Artificial
  CRISPR gRNA sequence
aaggagcagcaggcaggtgt

SEQ ID NO: 6449 - DNA, 20 bp, Artificial
  CRISPR gRNA sequence
gagcagcaggcaggtgtcag

SEQ ID NO: 6450 - DNA, 20 bp, Artificial
  CRISPR gRNA sequence
agcagcaggcaggtgtcagc

SEQ ID NO: 6451 - DNA, 20 bp, Artificial
  CRISPR gRNA sequence
gcagcaggcaggtgtcagca

SEQ ID NO: 6452 - DNA, 20 bp, Artificial
  CRISPR gRNA sequence
agcaggcaggtgtcagcagg

SEQ ID NO: 6453 - DNA, 20 bp, Artificial
  CRISPR gRNA sequence
aggcaggtgtcagcagggag

SEQ ID NO: 6454 - DNA, 20 bp, Artificial
  CRISPR gRNA sequence
gagcagctctttgcatccca

SEQ ID NO: 6455 - DNA, 20 bp, Artificial
  CRISPR gRNA sequence
tctttgcatcccacagttcc

SEQ ID NO: 6456 - DNA, 20 bp, Artificial
  CRISPR gRNA sequence
ctttgcatcccacagttccc

SEQ ID NO: 6457 - DNA, 20 bp, Artificial
  CRISPR gRNA sequence
tttgcatcccacagttccca

SEQ ID NO: 6458 - DNA, 20 bp, Artificial
  CRISPR gRNA sequence
tgcatcccacagttcccagg

SEQ ID NO: 6459 - DNA, 20 bp, Artificial
  CRISPR gRNA sequence
tcattcatcctttcatttat

SEQ ID NO: 6460 - DNA, 20 bp, Artificial
  CRISPR gRNA sequence
atcctttcatttatgagaca

SEQ ID NO: 6461 - DNA, 20 bp, Artificial
  CRISPR gRNA sequence
caaagtctcactctgttgcc

SEQ ID NO: 6462 - DNA, 20 bp, Artificial
  CRISPR gRNA sequence
aaagtctcactctgttgccc

SEQ ID NO: 6463 - DNA, 20 bp, Artificial
  CRISPR gRNA sequence
tctcactctgttgcccaggt

SEQ ID NO: 6464 - DNA, 20 bp, Artificial
  CRISPR gRNA sequence
tcactctgttgcccaggttg

SEQ ID NO: 6465 - DNA, 20 bp, Artificial
  CRISPR gRNA sequence
ctgttgcccaggttggagtg

SEQ ID NO: 6466 - DNA, 20 bp, Artificial
  CRISPR gRNA sequence
ttgcccaggttggagtgcag

SEQ ID NO: 6467 - DNA, 20 bp, Artificial
  CRISPR gRNA sequence
caggttggagtgcagtggca

SEQ ID NO: 6468 - DNA, 20 bp, Artificial
  CRISPR gRNA sequence
ggcacagtcattgctcactg

SEQ ID NO: 6469 - DNA, 20 bp, Artificial
  CRISPR gRNA sequence
tcattgctcactgcagcctc

SEQ ID NO: 6470 - DNA, 20 bp, Artificial
  CRISPR gRNA sequence
cactgcagcctcaagctcct

SEQ ID NO: 6471 - DNA, 20 bp, Artificial
  CRISPR gRNA sequence
agcctcaagctcctgagctc

SEQ ID NO: 6472 - DNA, 20 bp, Artificial
  CRISPR gRNA sequence
ctcaagccatcctcctgcct

SEQ ID NO: 6473 - DNA, 20 bp, Artificial
  CRISPR gRNA sequence
tcctcctgcctcagcctccc

SEQ ID NO: 6474 - DNA, 20 bp, Artificial
  CRISPR gRNA sequence
tcctgcctcagcctcccaag

SEQ ID NO: 6475 - DNA, 20 bp, Artificial
  CRISPR gRNA sequence
cctcagcctcccaagtagcc

SEQ ID NO: 6476 - DNA, 20 bp, Artificial
  CRISPR gRNA sequence
tcccaagtagccgagactac

SEQ ID NO: 6477 - DNA, 20 bp, Artificial
  CRISPR gRNA sequence
cccaagtagccgagactaca

SEQ ID NO: 6478 - DNA, 20 bp, Artificial
  CRISPR gRNA sequence
ccaagtagccgagactacaa

SEQ ID NO: 6479 - DNA, 20 bp, Artificial
  CRISPR gRNA sequence
caagggcactccaccacacc

SEQ ID NO: 6480 - DNA, 20 bp, Artificial
  CRISPR gRNA sequence
ttttgtatcttttatttctg

SEQ ID NO: 6481 - DNA, 20 bp, Artificial
  CRISPR gRNA sequence
ttgtatcttttatttctgaa

SEQ ID NO: 6482 - DNA, 20 bp, Artificial
  CRISPR gRNA sequence
atcttttatttctgaagaga

SEQ ID NO: 6483 - DNA, 20 bp, Artificial
  CRISPR gRNA sequence
tcttttatttctgaagagat

SEQ ID NO: 6484 - DNA, 20 bp, Artificial
  CRISPR gRNA sequence
cttttatttctgaagagatg

SEQ ID NO: 6485 - DNA, 20 bp, Artificial
  CRISPR gRNA sequence
tggggtttcactatgttgcc

SEQ ID NO: 6486 - DNA, 20 bp, Artificial
  CRISPR gRNA sequence
ggggtttcactatgttgccc

SEQ ID NO: 6487 - DNA, 20 bp, Artificial
  CRISPR gRNA sequence
tttcactatgttgcccaggc

SEQ ID NO: 6488 - DNA, 20 bp, Artificial
  CRISPR gRNA sequence
ccaggctggtctcaaactcc

SEQ ID NO: 6489 - DNA, 20 bp, Artificial
  CRISPR gRNA sequence
ggtctcaaactcctggcctc

SEQ ID NO: 6490 - DNA, 20 bp, Artificial
  CRISPR gRNA sequence
ctcaagtcatcctccctcct

SEQ ID NO: 6491 - DNA, 20 bp, Artificial
  CRISPR gRNA sequence
cctccctcctcagcctccca

SEQ ID NO: 6492 - DNA, 20 bp, Artificial
  CRISPR gRNA sequence
tcctcagcctcccaaagtgc

SEQ ID NO: 6493 - DNA, 20 bp, Artificial
  CRISPR gRNA sequence
cctcagcctcccaaagtgct

SEQ ID NO: 6494 - DNA, 20 bp, Artificial
  CRISPR gRNA sequence
ctcccaaagtgctgggatta

SEQ ID NO: 6495 - DNA, 20 bp, Artificial
  CRISPR gRNA sequence
tcccaaagtgctgggattac

SEQ ID NO: 6496 - DNA, 20 bp, Artificial
  CRISPR gRNA sequence
tgggattacaggtgtgatct

SEQ ID NO: 6497 - DNA, 20 bp, Artificial
  CRISPR gRNA sequence
attacaggtgtgatctcaga

SEQ ID NO: 6498 - DNA, 20 bp, Artificial
  CRISPR gRNA sequence
tcttaatcacctttccatct

SEQ ID NO: 6499 - DNA, 20 bp, Artificial
  CRISPR gRNA sequence
aatcacctttccatctgagc

SEQ ID NO: 6500 - DNA, 20 bp, Artificial
  CRISPR gRNA sequence
cacctttccatctgagctgg

SEQ ID NO: 6501 - DNA, 20 bp, Artificial
  CRISPR gRNA sequence
ctttccatctgagctggcag

SEQ ID NO: 6502 - DNA, 20 bp, Artificial
  CRISPR gRNA sequence
ttccatctgagctggcagca

SEQ ID NO: 6503 - DNA, 20 bp, Artificial
  CRISPR gRNA sequence
atctgagctggcagcagagc

SEQ ID NO: 6504 - DNA, 20 bp, Artificial
  CRISPR gRNA sequence
tctgagctggcagcagagct

SEQ ID NO: 6505 - DNA, 20 bp, Artificial
  CRISPR gRNA sequence
agctggcagcagagctggga

SEQ ID NO: 6506 - DNA, 20 bp, Artificial
  CRISPR gRNA sequence
ggaaagtgcacccaacaccc

SEQ ID NO: 6507 - DNA, 20 bp, Artificial
  CRISPR gRNA sequence
caccccagatgctgcaactt

SEQ ID NO: 6508 - DNA, 20 bp, Artificial
  CRISPR gRNA sequence
cttcctgctccttctctgtg

SEQ ID NO: 6509 - DNA, 20 bp, Artificial
  CRISPR gRNA sequence
gctccttctctgtgtggaac

SEQ ID NO: 6510 - DNA, 20 bp, Artificial
  CRISPR gRNA sequence
ctgtgtggaactggcctgtt

SEQ ID NO: 6511 - DNA, 20 bp, Artificial
  CRISPR gRNA sequence
tgtgtggaactggcctgttt

SEQ ID NO: 6512 - DNA, 20 bp, Artificial
  CRISPR gRNA sequence
aactggcctgtttgggtacc

SEQ ID NO: 6513 - DNA, 20 bp, Artificial
  CRISPR gRNA sequence
actggcctgtttgggtaccc

SEQ ID NO: 6514 - DNA, 20 bp, Artificial
  CRISPR gRNA sequence
ctggcctgtttgggtaccca

SEQ ID NO: 6515 - DNA, 20 bp, Artificial
  CRISPR gRNA sequence
cctgtttgggtacccagggc

SEQ ID NO: 6516 - DNA, 20 bp, Artificial
  CRISPR gRNA sequence
acccagggccagtcccctcc

SEQ ID NO: 6517 - DNA, 20 bp, Artificial
  CRISPR gRNA sequence
gtcccctccaagaccctctg

SEQ ID NO: 6518 - DNA, 20 bp, Artificial
  CRISPR gRNA sequence
tccaagaccctctgtagaaa

SEQ ID NO: 6519 - DNA, 20 bp, Artificial
  CRISPR gRNA sequence
tgtacacctcaattccattg

SEQ ID NO: 6520 - DNA, 20 bp, Artificial
  CRISPR gRNA sequence
gtacacctcaattccattgc

SEQ ID NO: 6521 - DNA, 20 bp, Artificial
  CRISPR gRNA sequence
acctcaattccattgcagga

SEQ ID NO: 6522 - DNA, 20 bp, Artificial
  CRISPR gRNA sequence
cctcaattccattgcaggac

SEQ ID NO: 6523 - DNA, 20 bp, Artificial
  CRISPR gRNA sequence
aatcctgcctctccctgccc

SEQ ID NO: 6524 - DNA, 20 bp, Artificial
  CRISPR gRNA sequence
cccagtcacccatccctccc

SEQ ID NO: 6525 - DNA, 20 bp, Artificial
  CRISPR gRNA sequence
tccctcccaagccattatct

SEQ ID NO: 6526 - DNA, 20 bp, Artificial
  CRISPR gRNA sequence
ccctcccaagccattatctt

SEQ ID NO: 6527 - DNA, 20 bp, Artificial
  CRISPR gRNA sequence
gccattatcttgggacctgc

SEQ ID NO: 6528 - DNA, 20 bp, Artificial
  CRISPR gRNA sequence
ccattatcttgggacctgca

SEQ ID NO: 6529 - DNA, 20 bp, Artificial
  CRISPR gRNA sequence
cattatcttgggacctgcaa

SEQ ID NO: 6530 - DNA, 20 bp, Artificial
  CRISPR gRNA sequence
tgggacctgcaagggcctcc

SEQ ID NO: 6531 - DNA, 20 bp, Artificial
  CRISPR gRNA sequence
cctgcaagggcctccaagcc

SEQ ID NO: 6532 - DNA, 20 bp, Artificial
  CRISPR gRNA sequence
ctgcaagggcctccaagcca

SEQ ID NO: 6533 - DNA, 20 bp, Artificial
  CRISPR gRNA sequence
tgcaagggcctccaagccaa

SEQ ID NO: 6534 - DNA, 20 bp, Artificial
  CRISPR gRNA sequence
aagggcctccaagccaaggg

SEQ ID NO: 6535 - DNA, 20 bp, Artificial
  CRISPR gRNA sequence
ggtggcaaatccaaatacca

SEQ ID NO: 6536 - DNA, 20 bp, Artificial
  CRISPR gRNA sequence
gtggcaaatccaaataccaa

SEQ ID NO: 6537 - DNA, 20 bp, Artificial
  CRISPR gRNA sequence
tggcaaatccaaataccaaa

SEQ ID NO: 6538 - DNA, 20 bp, Artificial
  CRISPR gRNA sequence
ggcaaatccaaataccaaag

SEQ ID NO: 6539 - DNA, 20 bp, Artificial
  CRISPR gRNA sequence
ataatgatgtaaaatgtgtc

SEQ ID NO: 6540 - DNA, 20 bp, Artificial
  CRISPR gRNA sequence
taatgatgtaaaatgtgtcc

SEQ ID NO: 6541 - DNA, 20 bp, Artificial
  CRISPR gRNA sequence
tgatgtaaaatgtgtccagg

SEQ ID NO: 6542 - DNA, 20 bp, Artificial
  CRISPR gRNA sequence
tgtaaaatgtgtccaggcag

SEQ ID NO: 6543 - DNA, 20 bp, Artificial
  CRISPR gRNA sequence
gtaaaatgtgtccaggcaga

SEQ ID NO: 6544 - DNA, 20 bp, Artificial
  CRISPR gRNA sequence
tgtgtccaggcagaaggcaa

SEQ ID NO: 6545 - DNA, 20 bp, Artificial
  CRISPR gRNA sequence
gtgtccaggcagaaggcaat

SEQ ID NO: 6546 - DNA, 20 bp, Artificial
  CRISPR gRNA sequence
tgtccaggcagaaggcaata

SEQ ID NO: 6547 - DNA, 20 bp, Artificial
  CRISPR gRNA sequence
tccaggcagaaggcaatagg

SEQ ID NO: 6548 - DNA, 20 bp, Artificial
  CRISPR gRNA sequence
aggcagaaggcaatagggag

SEQ ID NO: 6549 - DNA, 20 bp, Artificial
  CRISPR gRNA sequence
cagaaggcaatagggagtag

SEQ ID NO: 6550 - DNA, 20 bp, Artificial
  CRISPR gRNA sequence
agaaggcaatagggagtagt

SEQ ID NO: 6551 - DNA, 20 bp, Artificial
  CRISPR gRNA sequence
gaaggcaatagggagtagtg

SEQ ID NO: 6552 - DNA, 20 bp, Artificial
  CRISPR gRNA sequence
atagggagtagtggggcctc

SEQ ID NO: 6553 - DNA, 20 bp, Artificial
  CRISPR gRNA sequence
acaattgtgtgtactctata

SEQ ID NO: 6554 - DNA, 20 bp, Artificial
  CRISPR gRNA sequence
aattgtgtgtactctatata

SEQ ID NO: 6555 - DNA, 20 bp, Artificial
  CRISPR gRNA sequence
tctatatagagacattgtga

SEQ ID NO: 6556 - DNA, 20 bp, Artificial
  CRISPR gRNA sequence
gagacattgtgatggtgatt

SEQ ID NO: 6557 - DNA, 20 bp, Artificial
  CRISPR gRNA sequence
agacacacacacacttatat

SEQ ID NO: 6558 - DNA, 20 bp, Artificial
  CRISPR gRNA sequence
cacacacacttatattggct

SEQ ID NO: 6559 - DNA, 20 bp, Artificial
  CRISPR gRNA sequence
acacacacttatattggctt

SEQ ID NO: 6560 - DNA, 20 bp, Artificial
  CRISPR gRNA sequence
ggcttgggaaacaaaacaaa

SEQ ID NO: 6561 - DNA, 20 bp, Artificial
  CRISPR gRNA sequence
gcttgggaaacaaaacaaat

SEQ ID NO: 6562 - DNA, 20 bp, Artificial
  CRISPR gRNA sequence
aaacaaataggcctatcgac

SEQ ID NO: 6563 - DNA, 20 bp, Artificial
  CRISPR gRNA sequence
ggattcaacttttgattttg

SEQ ID NO: 6564 - DNA, 20 bp, Artificial
  CRISPR gRNA sequence
caacttttgattttgcagcc

SEQ ID NO: 6565 - DNA, 20 bp, Artificial
  CRISPR gRNA sequence
attttgcagccaagcccctg

SEQ ID NO: 6566 - DNA, 20 bp, Artificial
  CRISPR gRNA sequence
gcagccaagcccctgtggca

SEQ ID NO: 6567 - DNA, 20 bp, Artificial
  CRISPR gRNA sequence
caagcccctgtggcacagct

SEQ ID NO: 6568 - DNA, 20 bp, Artificial
  CRISPR gRNA sequence
aagcccctgtggcacagctg

SEQ ID NO: 6569 - DNA, 20 bp, Artificial
  CRISPR gRNA sequence
gcccctgtggcacagctgag

SEQ ID NO: 6570 - DNA, 20 bp, Artificial
  CRISPR gRNA sequence
tggcacagctgaggagcttg

SEQ ID NO: 6571 - DNA, 20 bp, Artificial
  CRISPR gRNA sequence
ggcacagctgaggagcttgc

SEQ ID NO: 6572 - DNA, 20 bp, Artificial
  CRISPR gRNA sequence
cagctgaggagcttgcaggt

SEQ ID NO: 6573 - DNA, 20 bp, Artificial
  CRISPR gRNA sequence
tgaggagcttgcaggtcaga

SEQ ID NO: 6574 - DNA, 20 bp, Artificial
  CRISPR gRNA sequence
gaggagcttgcaggtcagaa

SEQ ID NO: 6575 - DNA, 20 bp, Artificial
  CRISPR gRNA sequence
aggagcttgcaggtcagaaa

SEQ ID NO: 6576 - DNA, 20 bp, Artificial
  CRISPR gRNA sequence
ggagcttgcaggtcagaaag

SEQ ID NO: 6577 - DNA, 20 bp, Artificial
  CRISPR gRNA sequence
tgcaggtcagaaaggggatt

SEQ ID NO: 6578 - DNA, 20 bp, Artificial
  CRISPR gRNA sequence
caggtcagaaaggggattta

SEQ ID NO: 6579 - DNA, 20 bp, Artificial
  CRISPR gRNA sequence
ggggatttagagccaaccaa

SEQ ID NO: 6580 - DNA, 20 bp, Artificial
  CRISPR gRNA sequence
ccaaccaatagcaatatctc

SEQ ID NO: 6581 - DNA, 20 bp, Artificial
  CRISPR gRNA sequence
tccagacctctcctgacacg

SEQ ID NO: 6582 - DNA, 20 bp, Artificial
  CRISPR gRNA sequence
cacatgcacacacatgcatg

SEQ ID NO: 6583 - DNA, 20 bp, Artificial
  CRISPR gRNA sequence
acatgcacacacatgcatgc

SEQ ID NO: 6584 - DNA, 20 bp, Artificial
  CRISPR gRNA sequence
gcacatgcacgcacgtcttc

SEQ ID NO: 6585 - DNA, 20 bp, Artificial
  CRISPR gRNA sequence
tcttctagtctccctgcctt

SEQ ID NO: 6586 - DNA, 20 bp, Artificial
  CRISPR gRNA sequence
cttctagtctccctgccttg

SEQ ID NO: 6587 - DNA, 20 bp, Artificial
  CRISPR gRNA sequence
ctgccttgaggacaaatgat

SEQ ID NO: 6588 - DNA, 20 bp, Artificial
  CRISPR gRNA sequence
tcagatcctgcaactgtttc

SEQ ID NO: 6589 - DNA, 20 bp, Artificial
  CRISPR gRNA sequence
cagatcctgcaactgtttcc

SEQ ID NO: 6590 - DNA, 20 bp, Artificial
  CRISPR gRNA sequence
gcaactgtttccaggcccat

SEQ ID NO: 6591 - DNA, 20 bp, Artificial
  CRISPR gRNA sequence
ttccaggcccataagcccct

SEQ ID NO: 6592 - DNA, 20 bp, Artificial
  CRISPR gRNA sequence
ccataagcccctgagcattg

SEQ ID NO: 6593 - DNA, 20 bp, Artificial
  CRISPR gRNA sequence
tgcagtgttgctacatgcct

SEQ ID NO: 6594 - DNA, 20 bp, Artificial
  CRISPR gRNA sequence
gtgacctcctcgtgccactc

SEQ ID NO: 6595 - DNA, 20 bp, Artificial
  CRISPR gRNA sequence
tgacctcctcgtgccactcc

SEQ ID NO: 6596 - DNA, 20 bp, Artificial
  CRISPR gRNA sequence
cctcctcgtgccactccagg

SEQ ID NO: 6597 - DNA, 20 bp, Artificial
  CRISPR gRNA sequence
cgtgccactccaggaagtga

SEQ ID NO: 6598 - DNA, 20 bp, Artificial
  CRISPR gRNA sequence
ctccaggaagtgaaagtctt

SEQ ID NO: 6599 - DNA, 20 bp, Artificial
  CRISPR gRNA sequence
aggaagtgaaagtcttgagt

SEQ ID NO: 6600 - DNA, 20 bp, Artificial
  CRISPR gRNA sequence
gtgaaagtcttgagtgagac

SEQ ID NO: 6601 - DNA, 20 bp, Artificial
  CRISPR gRNA sequence
aaagtcttgagtgagaccag

SEQ ID NO: 6602 - DNA, 20 bp, Artificial
  CRISPR gRNA sequence
tgagaccagtagtttctctt

SEQ ID NO: 6603 - DNA, 20 bp, Artificial
  CRISPR gRNA sequence
ctctctctgtctcgttctcc

SEQ ID NO: 6604 - DNA, 20 bp, Artificial
  CRISPR gRNA sequence
tctctctgtctcgttctcct

SEQ ID NO: 6605 - DNA, 20 bp, Artificial
  CRISPR gRNA sequence
tctcctgggatatctacact

SEQ ID NO: 6606 - DNA, 20 bp, Artificial
  CRISPR gRNA sequence
atctacacttggtttgcaaa

SEQ ID NO: 6607 - DNA, 20 bp, Artificial
  CRISPR gRNA sequence
tacacttggtttgcaaacag

SEQ ID NO: 6608 - DNA, 20 bp, Artificial
  CRISPR gRNA sequence
acacttggtttgcaaacagc

SEQ ID NO: 6609 - DNA, 20 bp, Artificial
  CRISPR gRNA sequence
ttggtttgcaaacagcaggc

SEQ ID NO: 6610 - DNA, 20 bp, Artificial
  CRISPR gRNA sequence
ggtttgcaaacagcaggctg

SEQ ID NO: 6611 - DNA, 20 bp, Artificial
  CRISPR gRNA sequence
tttgcaaacagcaggctgga

SEQ ID NO: 6612 - DNA, 20 bp, Artificial
  CRISPR gRNA sequence
caaacagcaggctggagagt

SEQ ID NO: 6613 - DNA, 20 bp, Artificial
  CRISPR gRNA sequence
aaacagcaggctggagagtg

SEQ ID NO: 6614 - DNA, 20 bp, Artificial
  CRISPR gRNA sequence
aacagcaggctggagagtga

SEQ ID NO: 6615 - DNA, 20 bp, Artificial
  CRISPR gRNA sequence
acagcaggctggagagtgag

SEQ ID NO: 6616 - DNA, 20 bp, Artificial
  CRISPR gRNA sequence
ggggcttcttcctctacatc

SEQ ID NO: 6617 - DNA, 20 bp, Artificial
  CRISPR gRNA sequence
ctcctcccccatcctgctcc

SEQ ID NO: 6618 - DNA, 20 bp, Artificial
  CRISPR gRNA sequence
cccccatcctgctccaagtc

SEQ ID NO: 6619 - DNA, 20 bp, Artificial
  CRISPR gRNA sequence
gcatgttcctatctcttccc

SEQ ID NO: 6620 - DNA, 20 bp, Artificial
  CRISPR gRNA sequence
catgttcctatctcttcccc

SEQ ID NO: 6621 - DNA, 20 bp, Artificial
  CRISPR gRNA sequence
ctatctcttccccaggaccc

SEQ ID NO: 6622 - DNA, 20 bp, Artificial
  CRISPR gRNA sequence
tatctcttccccaggaccct

SEQ ID NO: 6623 - DNA, 20 bp, Artificial
  CRISPR gRNA sequence
tccccaggaccctgggctct

SEQ ID NO: 6624 - DNA, 20 bp, Artificial
  CRISPR gRNA sequence
ccccaggaccctgggctctt

SEQ ID NO: 6625 - DNA, 20 bp, Artificial
  CRISPR gRNA sequence
tgggctcttgggcacaaatc

SEQ ID NO: 6626 - DNA, 20 bp, Artificial
  CRISPR gRNA sequence
ggcacaaatcaagccatcac

SEQ ID NO: 6627 - DNA, 20 bp, Artificial
  CRISPR gRNA sequence
caaatcaagccatcaccaga

SEQ ID NO: 6628 - DNA, 20 bp, Artificial
  CRISPR gRNA sequence
agccatcaccagacagcctg

SEQ ID NO: 6629 - DNA, 20 bp, Artificial
  CRISPR gRNA sequence
gccatcaccagacagcctgt

SEQ ID NO: 6630 - DNA, 20 bp, Artificial
  CRISPR gRNA sequence
ccatcaccagacagcctgtg

SEQ ID NO: 6631 - DNA, 20 bp, Artificial
  CRISPR gRNA sequence
tcaccagacagcctgtgggg

SEQ ID NO: 6632 - DNA, 20 bp, Artificial
  CRISPR gRNA sequence
cagacagcctgtggggtggc

SEQ ID NO: 6633 - DNA, 20 bp, Artificial
  CRISPR gRNA sequence
gacagcctgtggggtggcaa

SEQ ID NO: 6634 - DNA, 20 bp, Artificial
  CRISPR gRNA sequence
agcctgtggggtggcaagag

SEQ ID NO: 6635 - DNA, 20 bp, Artificial
  CRISPR gRNA sequence
cctgtggggtggcaagagca

SEQ ID NO: 6636 - DNA, 20 bp, Artificial
  CRISPR gRNA sequence
ctgtggggtggcaagagcag

SEQ ID NO: 6637 - DNA, 20 bp, Artificial
  CRISPR gRNA sequence
tgtttctttgtgaacatcta

SEQ ID NO: 6638 - DNA, 20 bp, Artificial
  CRISPR gRNA sequence
gtttctttgtgaacatctat

SEQ ID NO: 6639 - DNA, 20 bp, Artificial
  CRISPR gRNA sequence
ttgtgaacatctataggtac

SEQ ID NO: 6640 - DNA, 20 bp, Artificial
  CRISPR gRNA sequence
tgtgaacatctataggtacc

SEQ ID NO: 6641 - DNA, 20 bp, Artificial
  CRISPR gRNA sequence
tataggtaccaggctctgtg

SEQ ID NO: 6642 - DNA, 20 bp, Artificial
  CRISPR gRNA sequence
ataggtaccaggctctgtgc

SEQ ID NO: 6643 - DNA, 20 bp, Artificial
  CRISPR gRNA sequence
ctctgtgcaggccctattgt

SEQ ID NO: 6644 - DNA, 20 bp, Artificial
  CRISPR gRNA sequence
gtgcaggccctattgttggt

SEQ ID NO: 6645 - DNA, 20 bp, Artificial
  CRISPR gRNA sequence
gccctattgttggtgagcca

SEQ ID NO: 6646 - DNA, 20 bp, Artificial
  CRISPR gRNA sequence
cctattgttggtgagccata

SEQ ID NO: 6647 - DNA, 20 bp, Artificial
  CRISPR gRNA sequence
ctattgttggtgagccatag

SEQ ID NO: 6648 - DNA, 20 bp, Artificial
  CRISPR gRNA sequence
tttcttttcttttcaacccc

SEQ ID NO: 6649 - DNA, 20 bp, Artificial
  CRISPR gRNA sequence
ttcttttcttttcaacccct

SEQ ID NO: 6650 - DNA, 20 bp, Artificial
  CRISPR gRNA sequence
taaaccttcgattaactgcc

SEQ ID NO: 6651 - DNA, 20 bp, Artificial
  CRISPR gRNA sequence
cttcgattaactgcccagtg

SEQ ID NO: 6652 - DNA, 20 bp, Artificial
  CRISPR gRNA sequence
attaactgcccagtgcagcc

SEQ ID NO: 6653 - DNA, 20 bp, Artificial
  CRISPR gRNA sequence
ttaactgcccagtgcagccc

SEQ ID NO: 6654 - DNA, 20 bp, Artificial
  CRISPR gRNA sequence
gcccagtgcagcccaggtca

SEQ ID NO: 6655 - DNA, 20 bp, Artificial
  CRISPR gRNA sequence
tcatggtacactatgatctt

SEQ ID NO: 6656 - DNA, 20 bp, Artificial
  CRISPR gRNA sequence
ctatgatctttggttcacat

SEQ ID NO: 6657 - DNA, 20 bp, Artificial
  CRISPR gRNA sequence
tatgatctttggttcacatg

SEQ ID NO: 6658 - DNA, 20 bp, Artificial
  CRISPR gRNA sequence
atgatctttggttcacatga

SEQ ID NO: 6659 - DNA, 20 bp, Artificial
  CRISPR gRNA sequence
aatgtccctatttcccatac

SEQ ID NO: 6660 - DNA, 20 bp, Artificial
  CRISPR gRNA sequence
atgtccctatttcccatact

SEQ ID NO: 6661 - DNA, 20 bp, Artificial
  CRISPR gRNA sequence
gtgcccattctaatgcattt

SEQ ID NO: 6662 - DNA, 20 bp, Artificial
  CRISPR gRNA sequence
tgcccattctaatgcatttc

SEQ ID NO: 6663 - DNA, 20 bp, Artificial
  CRISPR gRNA sequence
ttgccttttttttttttttt

SEQ ID NO: 6664 - DNA, 20 bp, Artificial
  CRISPR gRNA sequence
cttttttttttttttttaga

SEQ ID NO: 6665 - DNA, 20 bp, Artificial
  CRISPR gRNA sequence
tttttttttttttttagatg

SEQ ID NO: 6666 - DNA, 20 bp, Artificial
  CRISPR gRNA sequence
tggagtctcactctgtcacc

SEQ ID NO: 6667 - DNA, 20 bp, Artificial
  CRISPR gRNA sequence
ggagtctcactctgtcaccc

SEQ ID NO: 6668 - DNA, 20 bp, Artificial
  CRISPR gRNA sequence
ctcactctgtcacccaggct

SEQ ID NO: 6669 - DNA, 20 bp, Artificial
  CRISPR gRNA sequence
caggctgagttttctatttt

SEQ ID NO: 6670 - DNA, 20 bp, Artificial
  CRISPR gRNA sequence
gctgagttttctatttttag

SEQ ID NO: 6671 - DNA, 20 bp, Artificial
  CRISPR gRNA sequence
tgagttttctatttttagta

SEQ ID NO: 6672 - DNA, 20 bp, Artificial
  CRISPR gRNA sequence
ttttctatttttagtagaga

SEQ ID NO: 6673 - DNA, 20 bp, Artificial
  CRISPR gRNA sequence
tttctatttttagtagagat

SEQ ID NO: 6674 - DNA, 20 bp, Artificial
  CRISPR gRNA sequence
ttctatttttagtagagatg

SEQ ID NO: 6675 - DNA, 20 bp, Artificial
  CRISPR gRNA sequence
gagatggggttttaccacct

SEQ ID NO: 6676 - DNA, 20 bp, Artificial
  CRISPR gRNA sequence
tggggttttaccaccttggc

SEQ ID NO: 6677 - DNA, 20 bp, Artificial
  CRISPR gRNA sequence
ggggttttaccaccttggcc

SEQ ID NO: 6678 - DNA, 20 bp, Artificial
  CRISPR gRNA sequence
ttttaccaccttggccaggc

SEQ ID NO: 6679 - DNA, 20 bp, Artificial
  CRISPR gRNA sequence
tggtctcaaactcctgacct

SEQ ID NO: 6680 - DNA, 20 bp, Artificial
  CRISPR gRNA sequence
ggtctcaaactcctgacctc

SEQ ID NO: 6681 - DNA, 20 bp, Artificial
  CRISPR gRNA sequence
ctcaggtgatccacccgcct

SEQ ID NO: 6682 - DNA, 20 bp, Artificial
  CRISPR gRNA sequence
ccacccgcctcggcctccca

SEQ ID NO: 6683 - DNA, 20 bp, Artificial
  CRISPR gRNA sequence
gcctcggcctcccaaagtgc

SEQ ID NO: 6684 - DNA, 20 bp, Artificial
  CRISPR gRNA sequence
ctcccaaagtgctggaatta

SEQ ID NO: 6685 - DNA, 20 bp, Artificial
  CRISPR gRNA sequence
tcccaaagtgctggaattac

SEQ ID NO: 6686 - DNA, 20 bp, Artificial
  CRISPR gRNA sequence
agtgctggaattacaggtgc

SEQ ID NO: 6687 - DNA, 20 bp, Artificial
  CRISPR gRNA sequence
caggtgcgagtcaccacgcc

SEQ ID NO: 6688 - DNA, 20 bp, Artificial
  CRISPR gRNA sequence
cgagtcaccacgcctggcca

SEQ ID NO: 6689 - DNA, 20 bp, Artificial
  CRISPR gRNA sequence
tgcattctgtactatgtttt

SEQ ID NO: 6690 - DNA, 20 bp, Artificial
  CRISPR gRNA sequence
gcattctgtactatgttttt

SEQ ID NO: 6691 - DNA, 20 bp, Artificial
  CRISPR gRNA sequence
ttgatctttgcttctaatca

SEQ ID NO: 6692 - DNA, 20 bp, Artificial
  CRISPR gRNA sequence
atcacggacattgttctcta

SEQ ID NO: 6693 - DNA, 20 bp, Artificial
  CRISPR gRNA sequence
cacggacattgttctctatg

SEQ ID NO: 6694 - DNA, 20 bp, Artificial
  CRISPR gRNA sequence
acattgttctctatggagtg

SEQ ID NO: 6695 - DNA, 20 bp, Artificial
  CRISPR gRNA sequence
cattgttctctatggagtgc

SEQ ID NO: 6696 - DNA, 20 bp, Artificial
  CRISPR gRNA sequence
attgttctctatggagtgca

SEQ ID NO: 6697 - DNA, 20 bp, Artificial
  CRISPR gRNA sequence
ttgttctctatggagtgcag

SEQ ID NO: 6698 - DNA, 20 bp, Artificial
  CRISPR gRNA sequence
ttttcacctgtccacacccc

SEQ ID NO: 6699 - DNA, 20 bp, Artificial
  CRISPR gRNA sequence
cctgtccacacccccagtga

SEQ ID NO: 6700 - DNA, 20 bp, Artificial
  CRISPR gRNA sequence
cacccccagtgatggacacc

SEQ ID NO: 6701 - DNA, 20 bp, Artificial
  CRISPR gRNA sequence
acccccagtgatggacacct

SEQ ID NO: 6702 - DNA, 20 bp, Artificial
  CRISPR gRNA sequence
ctctgtcaccacaaataaca

SEQ ID NO: 6703 - DNA, 20 bp, Artificial
  CRISPR gRNA sequence
tgtcaccacaaataacacag

SEQ ID NO: 6704 - DNA, 20 bp, Artificial
  CRISPR gRNA sequence
aacacagcagtaaccatcct

SEQ ID NO: 6705 - DNA, 20 bp, Artificial
  CRISPR gRNA sequence
cagcagtaaccatcctcaga

SEQ ID NO: 6706 - DNA, 20 bp, Artificial
  CRISPR gRNA sequence
agcagtaaccatcctcagat

SEQ ID NO: 6707 - DNA, 20 bp, Artificial
  CRISPR gRNA sequence
catcctcagatgggttctcc

SEQ ID NO: 6708 - DNA, 20 bp, Artificial
  CRISPR gRNA sequence
atcctcagatgggttctcct

SEQ ID NO: 6709 - DNA, 20 bp, Artificial
  CRISPR gRNA sequence
tcctcagatgggttctcctg

SEQ ID NO: 6710 - DNA, 20 bp, Artificial
  CRISPR gRNA sequence
ctcagatgggttctcctggg

SEQ ID NO: 6711 - DNA, 20 bp, Artificial
  CRISPR gRNA sequence
tgggttctcctggggagttg

SEQ ID NO: 6712 - DNA, 20 bp, Artificial
  CRISPR gRNA sequence
gggttctcctggggagttgt

SEQ ID NO: 6713 - DNA, 20 bp, Artificial
  CRISPR gRNA sequence
gagttgtgggaacatttctt

SEQ ID NO: 6714 - DNA, 20 bp, Artificial
  CRISPR gRNA sequence
agttgtgggaacatttcttc

SEQ ID NO: 6715 - DNA, 20 bp, Artificial
  CRISPR gRNA sequence
gaacatttcttcaggatata

SEQ ID NO: 6716 - DNA, 20 bp, Artificial
  CRISPR gRNA sequence
tcttcaggatatatagaccc

SEQ ID NO: 6717 - DNA, 20 bp, Artificial
  CRISPR gRNA sequence
ttcaggatatatagacccaa

SEQ ID NO: 6718 - DNA, 20 bp, Artificial
  CRISPR gRNA sequence
agacccaagagctgaattgc

SEQ ID NO: 6719 - DNA, 20 bp, Artificial
  CRISPR gRNA sequence
gacccaagagctgaattgcc

SEQ ID NO: 6720 - DNA, 20 bp, Artificial
  CRISPR gRNA sequence
ccaagagctgaattgccagg

SEQ ID NO: 6721 - DNA, 20 bp, Artificial
  CRISPR gRNA sequence
agagctgaattgccaggtgg

SEQ ID NO: 6722 - DNA, 20 bp, Artificial
  CRISPR gRNA sequence
gagctgaattgccaggtggt

SEQ ID NO: 6723 - DNA, 20 bp, Artificial
  CRISPR gRNA sequence
tggtaggatctacatatcct

SEQ ID NO: 6724 - DNA, 20 bp, Artificial
  CRISPR gRNA sequence
ttagatattctacatgatgc

SEQ ID NO: 6725 - DNA, 20 bp, Artificial
  CRISPR gRNA sequence
tagatattctacatgatgcc

SEQ ID NO: 6726 - DNA, 20 bp, Artificial
  CRISPR gRNA sequence
catgatgccaggtcgttctc

SEQ ID NO: 6727 - DNA, 20 bp, Artificial
  CRISPR gRNA sequence
tgatgccaggtcgttctcca

SEQ ID NO: 6728 - DNA, 20 bp, Artificial
  CRISPR gRNA sequence
tgccaggtcgttctccagag

SEQ ID NO: 6729 - DNA, 20 bp, Artificial
  CRISPR gRNA sequence
aaacccgtgtaaccaacact

SEQ ID NO: 6730 - DNA, 20 bp, Artificial
  CRISPR gRNA sequence
aaccaacacttggcatttcc

SEQ ID NO: 6731 - DNA, 20 bp, Artificial
  CRISPR gRNA sequence
cccagatgtctaacttttgc

SEQ ID NO: 6732 - DNA, 20 bp, Artificial
  CRISPR gRNA sequence
tctaacttttgccagttgta

SEQ ID NO: 6733 - DNA, 20 bp, Artificial
  CRISPR gRNA sequence
tttgccagttgtacagtatc

SEQ ID NO: 6734 - DNA, 20 bp, Artificial
  CRISPR gRNA sequence
tcactttgctgttttatttt

SEQ ID NO: 6735 - DNA, 20 bp, Artificial
  CRISPR gRNA sequence
actttgctgttttatttttg

SEQ ID NO: 6736 - DNA, 20 bp, Artificial
  CRISPR gRNA sequence
tatttttggagtttacatct

SEQ ID NO: 6737 - DNA, 20 bp, Artificial
  CRISPR gRNA sequence
cttagtaccacttactcgct

SEQ ID NO: 6738 - DNA, 20 bp, Artificial
  CRISPR gRNA sequence
acttactcgctaagtcactt

SEQ ID NO: 6739 - DNA, 20 bp, Artificial
  CRISPR gRNA sequence
cttactcgctaagtcacttt

SEQ ID NO: 6740 - DNA, 20 bp, Artificial
  CRISPR gRNA sequence
ctcgctaagtcactttaggt

SEQ ID NO: 6741 - DNA, 20 bp, Artificial
  CRISPR gRNA sequence
ttaggtaagtcacaacaacc

SEQ ID NO: 6742 - DNA, 20 bp, Artificial
  CRISPR gRNA sequence
tcacaacaacccagtgacat

SEQ ID NO: 6743 - DNA, 20 bp, Artificial
  CRISPR gRNA sequence
agcactgtgccaacaaaatg

SEQ ID NO: 6744 - DNA, 20 bp, Artificial
  CRISPR gRNA sequence
atgcagtcgattctgtgact

SEQ ID NO: 6745 - DNA, 20 bp, Artificial
  CRISPR gRNA sequence
gcagtcgattctgtgactca

SEQ ID NO: 6746 - DNA, 20 bp, Artificial
  CRISPR gRNA sequence
agtcgattctgtgactcaga

SEQ ID NO: 6747 - DNA, 20 bp, Artificial
  CRISPR gRNA sequence
gtcgattctgtgactcagag

SEQ ID NO: 6748 - DNA, 20 bp, Artificial
  CRISPR gRNA sequence
ttctgtgactcagagaggtt

SEQ ID NO: 6749 - DNA, 20 bp, Artificial
  CRISPR gRNA sequence
gaggttgagtaacatttgca

SEQ ID NO: 6750 - DNA, 20 bp, Artificial
  CRISPR gRNA sequence
gtaacatttgcaaagtcaca

SEQ ID NO: 6751 - DNA, 20 bp, Artificial
  CRISPR gRNA sequence
catttgcaaagtcacacagc

SEQ ID NO: 6752 - DNA, 20 bp, Artificial
  CRISPR gRNA sequence
gcaaagtcacacagcaagtg

SEQ ID NO: 6753 - DNA, 20 bp, Artificial
  CRISPR gRNA sequence
cacacagcaagtgtggaact

SEQ ID NO: 6754 - DNA, 20 bp, Artificial
  CRISPR gRNA sequence
gtggaactaagatttgaacc

SEQ ID NO: 6755 - DNA, 20 bp, Artificial
  CRISPR gRNA sequence
ggaactaagatttgaaccca

SEQ ID NO: 6756 - DNA, 20 bp, Artificial
  CRISPR gRNA sequence
ctctctcctaaaatatcatc

SEQ ID NO: 6757 - DNA, 20 bp, Artificial
  CRISPR gRNA sequence
tctctcctaaaatatcatct

SEQ ID NO: 6758 - DNA, 20 bp, Artificial
  CRISPR gRNA sequence
atcatctgggtctacattgc

SEQ ID NO: 6759 - DNA, 20 bp, Artificial
  CRISPR gRNA sequence
gtctacattgcaagcctctt

SEQ ID NO: 6760 - DNA, 20 bp, Artificial
  CRISPR gRNA sequence
tacattgcaagcctctttgg

SEQ ID NO: 6761 - DNA, 20 bp, Artificial
  CRISPR gRNA sequence
acattgcaagcctctttggc

SEQ ID NO: 6762 - DNA, 20 bp, Artificial
  CRISPR gRNA sequence
cattgcaagcctctttggca

SEQ ID NO: 6763 - DNA, 20 bp, Artificial
  CRISPR gRNA sequence
cctctttggcagggactgtg

SEQ ID NO: 6764 - DNA, 20 bp, Artificial
  CRISPR gRNA sequence
gactgtgtggtaaacctctt

SEQ ID NO: 6765 - DNA, 20 bp, Artificial
  CRISPR gRNA sequence
actgtgtggtaaacctcttt

SEQ ID NO: 6766 - DNA, 20 bp, Artificial
  CRISPR gRNA sequence
ctgtgtggtaaacctctttg

SEQ ID NO: 6767 - DNA, 20 bp, Artificial
  CRISPR gRNA sequence
gtggtaaacctctttggggc

SEQ ID NO: 6768 - DNA, 20 bp, Artificial
  CRISPR gRNA sequence
taaacctctttggggccagt

SEQ ID NO: 6769 - DNA, 20 bp, Artificial
  CRISPR gRNA sequence
aaacctctttggggccagta

SEQ ID NO: 6770 - DNA, 20 bp, Artificial
  CRISPR gRNA sequence
tttggggccagtaaggaact

SEQ ID NO: 6771 - DNA, 20 bp, Artificial
  CRISPR gRNA sequence
ggccagtaaggaactgagct

SEQ ID NO: 6772 - DNA, 20 bp, Artificial
  CRISPR gRNA sequence
tgagctcagtgactttctta

SEQ ID NO: 6773 - DNA, 20 bp, Artificial
  CRISPR gRNA sequence
gagctcagtgactttcttac

SEQ ID NO: 6774 - DNA, 20 bp, Artificial
  CRISPR gRNA sequence
agctcagtgactttcttacg

SEQ ID NO: 6775 - DNA, 20 bp, Artificial
  CRISPR gRNA sequence
tgactttcttacggggtgct

SEQ ID NO: 6776 - DNA, 20 bp, Artificial
  CRISPR gRNA sequence
ctcagtgaatcattgtttta

SEQ ID NO: 6777 - DNA, 20 bp, Artificial
  CRISPR gRNA sequence
gaatcattgttttacagctt

SEQ ID NO: 6778 - DNA, 20 bp, Artificial
  CRISPR gRNA sequence
atcattgttttacagcttta

SEQ ID NO: 6779 - DNA, 20 bp, Artificial
  CRISPR gRNA sequence
tcattgttttacagctttag

SEQ ID NO: 6780 - DNA, 20 bp, Artificial
  CRISPR gRNA sequence
cattgttttacagctttaga

SEQ ID NO: 6781 - DNA, 20 bp, Artificial
  CRISPR gRNA sequence
attgttttacagctttagag

SEQ ID NO: 6782 - DNA, 20 bp, Artificial
  CRISPR gRNA sequence
tttacagctttagaggggaa

SEQ ID NO: 6783 - DNA, 20 bp, Artificial
  CRISPR gRNA sequence
cagctttagaggggaaaagt

SEQ ID NO: 6784 - DNA, 20 bp, Artificial
  CRISPR gRNA sequence
gctttagaggggaaaagtga

SEQ ID NO: 6785 - DNA, 20 bp, Artificial
  CRISPR gRNA sequence
gaaaagtgagagatgtttct

SEQ ID NO: 6786 - DNA, 20 bp, Artificial
  CRISPR gRNA sequence
aaagtgagagatgtttctta

SEQ ID NO: 6787 - DNA, 20 bp, Artificial
  CRISPR gRNA sequence
gatgtttcttagagtttatc

SEQ ID NO: 6788 - DNA, 20 bp, Artificial
  CRISPR gRNA sequence
tgtttcttagagtttatctg

SEQ ID NO: 6789 - DNA, 20 bp, Artificial
  CRISPR gRNA sequence
gtttcttagagtttatctgg

SEQ ID NO: 6790 - DNA, 20 bp, Artificial
  CRISPR gRNA sequence
agagtttatctggaggacta

SEQ ID NO: 6791 - DNA, 20 bp, Artificial
  CRISPR gRNA sequence
gagtttatctggaggactac

SEQ ID NO: 6792 - DNA, 20 bp, Artificial
  CRISPR gRNA sequence
agtttatctggaggactaca

SEQ ID NO: 6793 - DNA, 20 bp, Artificial
  CRISPR gRNA sequence
tggaggactacagggtgcat

SEQ ID NO: 6794 - DNA, 20 bp, Artificial
  CRISPR gRNA sequence
actacagggtgcatgagcaa

SEQ ID NO: 6795 - DNA, 20 bp, Artificial
  CRISPR gRNA sequence
acagggtgcatgagcaaaag

SEQ ID NO: 6796 - DNA, 20 bp, Artificial
  CRISPR gRNA sequence
agcaaaagcggaactcattt

SEQ ID NO: 6797 - DNA, 20 bp, Artificial
  CRISPR gRNA sequence
tttgagctactacccccaca

SEQ ID NO: 6798 - DNA, 20 bp, Artificial
  CRISPR gRNA sequence
gagctactacccccacaaag

SEQ ID NO: 6799 - DNA, 20 bp, Artificial
  CRISPR gRNA sequence
acccccacaaagaagctgtt

SEQ ID NO: 6800 - DNA, 20 bp, Artificial
  CRISPR gRNA sequence
cccccacaaagaagctgttt

SEQ ID NO: 6801 - DNA, 20 bp, Artificial
  CRISPR gRNA sequence
ccccacaaagaagctgtttg

SEQ ID NO: 6802 - DNA, 20 bp, Artificial
  CRISPR gRNA sequence
caaagaagctgtttggggtc

SEQ ID NO: 6803 - DNA, 20 bp, Artificial
  CRISPR gRNA sequence
agctgtttggggtctggtca

SEQ ID NO: 6804 - DNA, 20 bp, Artificial
  CRISPR gRNA sequence
tgtttggggtctggtcatgg

SEQ ID NO: 6805 - DNA, 20 bp, Artificial
  CRISPR gRNA sequence
tggggtctggtcatggtaga

SEQ ID NO: 6806 - DNA, 20 bp, Artificial
  CRISPR gRNA sequence
ggggtctggtcatggtagat

SEQ ID NO: 6807 - DNA, 20 bp, Artificial
  CRISPR gRNA sequence
tcatggtagataggcattcc

SEQ ID NO: 6808 - DNA, 20 bp, Artificial
  CRISPR gRNA sequence
catggtagataggcattcct

SEQ ID NO: 6809 - DNA, 20 bp, Artificial
  CRISPR gRNA sequence
gataggcattcctaggcccc

SEQ ID NO: 6810 - DNA, 20 bp, Artificial
  CRISPR gRNA sequence
cctggcttcccaacaccatt

SEQ ID NO: 6811 - DNA, 20 bp, Artificial
  CRISPR gRNA sequence
tcccaacaccatttggcccc

SEQ ID NO: 6812 - DNA, 20 bp, Artificial
  CRISPR gRNA sequence
caacaccatttggcccccgg

SEQ ID NO: 6813 - DNA, 20 bp, Artificial
  CRISPR gRNA sequence
caccatttggcccccggaag

SEQ ID NO: 6814 - DNA, 20 bp, Artificial
  CRISPR gRNA sequence
ccccggaagcagcttgtcat

SEQ ID NO: 6815 - DNA, 20 bp, Artificial
  CRISPR gRNA sequence
cccggaagcagcttgtcatg

SEQ ID NO: 6816 - DNA, 20 bp, Artificial
  CRISPR gRNA sequence
gaagcagcttgtcatgaggt

SEQ ID NO: 6817 - DNA, 20 bp, Artificial
  CRISPR gRNA sequence
aagcagcttgtcatgaggtt

SEQ ID NO: 6818 - DNA, 20 bp, Artificial
  CRISPR gRNA sequence
agcagcttgtcatgaggttg

SEQ ID NO: 6819 - DNA, 20 bp, Artificial
  CRISPR gRNA sequence
cagcttgtcatgaggttggg

SEQ ID NO: 6820 - DNA, 20 bp, Artificial
  CRISPR gRNA sequence
cttgtcatgaggttggggag

SEQ ID NO: 6821 - DNA, 20 bp, Artificial
  CRISPR gRNA sequence
ttgtcatgaggttggggagc

SEQ ID NO: 6822 - DNA, 20 bp, Artificial
  CRISPR gRNA sequence
catgaggttggggagcaggt

SEQ ID NO: 6823 - DNA, 20 bp, Artificial
  CRISPR gRNA sequence
gttggggagcaggttggtgt

SEQ ID NO: 6824 - DNA, 20 bp, Artificial
  CRISPR gRNA sequence
ttggggagcaggttggtgtt

SEQ ID NO: 6825 - DNA, 20 bp, Artificial
  CRISPR gRNA sequence
tggggagcaggttggtgttg

SEQ ID NO: 6826 - DNA, 20 bp, Artificial
  CRISPR gRNA sequence
ggggagcaggttggtgttgg

SEQ ID NO: 6827 - DNA, 20 bp, Artificial
  CRISPR gRNA sequence
gggagcaggttggtgttggg

SEQ ID NO: 6828 - DNA, 20 bp, Artificial
  CRISPR gRNA sequence
ggagcaggttggtgttgggg

SEQ ID NO: 6829 - DNA, 20 bp, Artificial
  CRISPR gRNA sequence
gagcaggttggtgttggggg

SEQ ID NO: 6830 - DNA, 20 bp, Artificial
  CRISPR gRNA sequence
gttggtgttggggggggcct

SEQ ID NO: 6831 - DNA, 20 bp, Artificial
  CRISPR gRNA sequence
ttggtgttggggggggcctt

SEQ ID NO: 6832 - DNA, 20 bp, Artificial
  CRISPR gRNA sequence
tggtgttggggggggccttg

SEQ ID NO: 6833 - DNA, 20 bp, Artificial
  CRISPR gRNA sequence
ggtgttggggggggccttgg

SEQ ID NO: 6834 - DNA, 20 bp, Artificial
  CRISPR gRNA sequence
ttggggggggccttggggga

SEQ ID NO: 6835 - DNA, 20 bp, Artificial
  CRISPR gRNA sequence
tggggggggccttgggggaa

SEQ ID NO: 6836 - DNA, 20 bp, Artificial
  CRISPR gRNA sequence
ggggccttgggggaaaggaa

SEQ ID NO: 6837 - DNA, 20 bp, Artificial
  CRISPR gRNA sequence
gggccttgggggaaaggaaa

SEQ ID NO: 6838 - DNA, 20 bp, Artificial
  CRISPR gRNA sequence
gccttgggggaaaggaaaag

SEQ ID NO: 6839 - DNA, 20 bp, Artificial
  CRISPR gRNA sequence
ttgggggaaaggaaaaggag

SEQ ID NO: 6840 - DNA, 20 bp, Artificial
  CRISPR gRNA sequence
aaggaaaaggagaagactgc

SEQ ID NO: 6841 - DNA, 20 bp, Artificial
  CRISPR gRNA sequence
aggaaaaggagaagactgcc

SEQ ID NO: 6842 - DNA, 20 bp, Artificial
  CRISPR gRNA sequence
ggagaagactgccaggcaac

SEQ ID NO: 6843 - DNA, 20 bp, Artificial
  CRISPR gRNA sequence
gagaagactgccaggcaacg

SEQ ID NO: 6844 - DNA, 20 bp, Artificial
  CRISPR gRNA sequence
actgccaggcaacgaggaat

SEQ ID NO: 6845 - DNA, 20 bp, Artificial
  CRISPR gRNA sequence
cgaggaatcagaatctcaaa

SEQ ID NO: 6846 - DNA, 20 bp, Artificial
  CRISPR gRNA sequence
atctcaaaaagactcaattg

SEQ ID NO: 6847 - DNA, 20 bp, Artificial
  CRISPR gRNA sequence
tctcaaaaagactcaattga

SEQ ID NO: 6848 - DNA, 20 bp, Artificial
  CRISPR gRNA sequence
ctcaaaaagactcaattgaa

SEQ ID NO: 6849 - DNA, 20 bp, Artificial
  CRISPR gRNA sequence
tcaaaaagactcaattgaag

SEQ ID NO: 6850 - DNA, 20 bp, Artificial
  CRISPR gRNA sequence
ggctccaacactcgttgaaa

SEQ ID NO: 6851 - DNA, 20 bp, Artificial
  CRISPR gRNA sequence
ctccaacactcgttgaaacg

SEQ ID NO: 6852 - DNA, 20 bp, Artificial
  CRISPR gRNA sequence
tccaacactcgttgaaacgg

SEQ ID NO: 6853 - DNA, 20 bp, Artificial
  CRISPR gRNA sequence
cactcgttgaaacggaggct

SEQ ID NO: 6854 - DNA, 20 bp, Artificial
  CRISPR gRNA sequence
ctcgttgaaacggaggctca

SEQ ID NO: 6855 - DNA, 20 bp, Artificial
  CRISPR gRNA sequence
tcgttgaaacggaggctcag

SEQ ID NO: 6856 - DNA, 20 bp, Artificial
  CRISPR gRNA sequence
cgttgaaacggaggctcaga

SEQ ID NO: 6857 - DNA, 20 bp, Artificial
  CRISPR gRNA sequence
aaacggaggctcagagggct

SEQ ID NO: 6858 - DNA, 20 bp, Artificial
  CRISPR gRNA sequence
aacggaggctcagagggcta

SEQ ID NO: 6859 - DNA, 20 bp, Artificial
  CRISPR gRNA sequence
gagggctaaggtaatgtact

SEQ ID NO: 6860 - DNA, 20 bp, Artificial
  CRISPR gRNA sequence
agggctaaggtaatgtactc

SEQ ID NO: 6861 - DNA, 20 bp, Artificial
  CRISPR gRNA sequence
aggtaatgtactcaggatca

SEQ ID NO: 6862 - DNA, 20 bp, Artificial
  CRISPR gRNA sequence
ggtaatgtactcaggatcaa

SEQ ID NO: 6863 - DNA, 20 bp, Artificial
  CRISPR gRNA sequence
aatgtactcaggatcaaagg

SEQ ID NO: 6864 - DNA, 20 bp, Artificial
  CRISPR gRNA sequence
tgtactcaggatcaaaggca

SEQ ID NO: 6865 - DNA, 20 bp, Artificial
  CRISPR gRNA sequence
actcaggatcaaaggcagag

SEQ ID NO: 6866 - DNA, 20 bp, Artificial
  CRISPR gRNA sequence
agaaactcaaaccatgtctc

SEQ ID NO: 6867 - DNA, 20 bp, Artificial
  CRISPR gRNA sequence
gaaactcaaaccatgtctct

SEQ ID NO: 6868 - DNA, 20 bp, Artificial
  CRISPR gRNA sequence
aaaccatgtctctaggcaca

SEQ ID NO: 6869 - DNA, 20 bp, Artificial
  CRISPR gRNA sequence
atgtctctaggcacacagtt

SEQ ID NO: 6870 - DNA, 20 bp, Artificial
  CRISPR gRNA sequence
gtctctaggcacacagttca

SEQ ID NO: 6871 - DNA, 20 bp, Artificial
  CRISPR gRNA sequence
tctctaggcacacagttcag

SEQ ID NO: 6872 - DNA, 20 bp, Artificial
  CRISPR gRNA sequence
gaggtcttcccattattcct

SEQ ID NO: 6873 - DNA, 20 bp, Artificial
  CRISPR gRNA sequence
aggtcttcccattattcctc

SEQ ID NO: 6874 - DNA, 20 bp, Artificial
  CRISPR gRNA sequence
gtcttcccattattcctcag

SEQ ID NO: 6875 - DNA, 20 bp, Artificial
  CRISPR gRNA sequence
tcttcccattattcctcagg

SEQ ID NO: 6876 - DNA, 20 bp, Artificial
  CRISPR gRNA sequence
ttcccattattcctcaggag

SEQ ID NO: 6877 - DNA, 20 bp, Artificial
  CRISPR gRNA sequence
ccattattcctcaggaggag

SEQ ID NO: 6878 - DNA, 20 bp, Artificial
  CRISPR gRNA sequence
tcctcaggaggagaagttca

SEQ ID NO: 6879 - DNA, 20 bp, Artificial
  CRISPR gRNA sequence
aggaggagaagttcatggtc

SEQ ID NO: 6880 - DNA, 20 bp, Artificial
  CRISPR gRNA sequence
gaggagaagttcatggtcaa

SEQ ID NO: 6881 - DNA, 20 bp, Artificial
  CRISPR gRNA sequence
gagaagttcatggtcaagag

SEQ ID NO: 6882 - DNA, 20 bp, Artificial
  CRISPR gRNA sequence
agaagttcatggtcaagagt

SEQ ID NO: 6883 - DNA, 20 bp, Artificial
  CRISPR gRNA sequence
gaagttcatggtcaagagta

SEQ ID NO: 6884 - DNA, 20 bp, Artificial
  CRISPR gRNA sequence
gttcatggtcaagagtaggg

SEQ ID NO: 6885 - DNA, 20 bp, Artificial
  CRISPR gRNA sequence
gtagggaagtattccttctc

SEQ ID NO: 6886 - DNA, 20 bp, Artificial
  CRISPR gRNA sequence
agctttttttttttttgtct

SEQ ID NO: 6887 - DNA, 20 bp, Artificial
  CRISPR gRNA sequence
ttttttttttttgtctgaga

SEQ ID NO: 6888 - DNA, 20 bp, Artificial
  CRISPR gRNA sequence
ttttttttttgtctgagaca

SEQ ID NO: 6889 - DNA, 20 bp, Artificial
  CRISPR gRNA sequence
cagagtcttgctctgtcacc

SEQ ID NO: 6890 - DNA, 20 bp, Artificial
  CRISPR gRNA sequence
agagtcttgctctgtcaccg

SEQ ID NO: 6891 - DNA, 20 bp, Artificial
  CRISPR gRNA sequence
tcttgctctgtcaccgaggc

SEQ ID NO: 6892 - DNA, 20 bp, Artificial
  CRISPR gRNA sequence
ttgctctgtcaccgaggctg

SEQ ID NO: 6893 - DNA, 20 bp, Artificial
  CRISPR gRNA sequence
ctgtcaccgaggctggagtg

SEQ ID NO: 6894 - DNA, 20 bp, Artificial
  CRISPR gRNA sequence
tcaccgaggctggagtgcag

SEQ ID NO: 6895 - DNA, 20 bp, Artificial
  CRISPR gRNA sequence
ggagtgcagtggcgtgatct

SEQ ID NO: 6896 - DNA, 20 bp, Artificial
  CRISPR gRNA sequence
tcactgcaacctccgcctcc

SEQ ID NO: 6897 - DNA, 20 bp, Artificial
  CRISPR gRNA sequence
cactgcaacctccgcctccc

SEQ ID NO: 6898 - DNA, 20 bp, Artificial
  CRISPR gRNA sequence
aacctccgcctcccaggttc

SEQ ID NO: 6899 - DNA, 20 bp, Artificial
  CRISPR gRNA sequence
ttcaagcaattttcctgcct

SEQ ID NO: 6900 - DNA, 20 bp, Artificial
  CRISPR gRNA sequence
ttttcctgcctcagcctccc

SEQ ID NO: 6901 - DNA, 20 bp, Artificial
  CRISPR gRNA sequence
tcctgcctcagcctcccaag

SEQ ID NO: 6902 - DNA, 20 bp, Artificial
  CRISPR gRNA sequence
gcctcagcctcccaagtagc

SEQ ID NO: 6903 - DNA, 20 bp, Artificial
  CRISPR gRNA sequence
cctcagcctcccaagtagct

SEQ ID NO: 6904 - DNA, 20 bp, Artificial
  CRISPR gRNA sequence
ctcccaagtagctgggatta

SEQ ID NO: 6905 - DNA, 20 bp, Artificial
  CRISPR gRNA sequence
tcccaagtagctgggattat

SEQ ID NO: 6906 - DNA, 20 bp, Artificial
  CRISPR gRNA sequence
taggcacccaccaccacgcc

SEQ ID NO: 6907 - DNA, 20 bp, Artificial
  CRISPR gRNA sequence
agctcatttttgtatttttg

SEQ ID NO: 6908 - DNA, 20 bp, Artificial
  CRISPR gRNA sequence
ctcatttttgtatttttgca

SEQ ID NO: 6909 - DNA, 20 bp, Artificial
  CRISPR gRNA sequence
tttttgtatttttgcagaga

SEQ ID NO: 6910 - DNA, 20 bp, Artificial
  CRISPR gRNA sequence
ttttgtatttttgcagagac

SEQ ID NO: 6911 - DNA, 20 bp, Artificial
  CRISPR gRNA sequence
tttgtatttttgcagagacg

SEQ ID NO: 6912 - DNA, 20 bp, Artificial
  CRISPR gRNA sequence
gagacggggtttcaccatgc

SEQ ID NO: 6913 - DNA, 20 bp, Artificial
  CRISPR gRNA sequence
cggggtttcaccatgctggt

SEQ ID NO: 6914 - DNA, 20 bp, Artificial
  CRISPR gRNA sequence
ggggtttcaccatgctggtc

SEQ ID NO: 6915 - DNA, 20 bp, Artificial
  CRISPR gRNA sequence
tttcaccatgctggtcaggc

SEQ ID NO: 6916 - DNA, 20 bp, Artificial
  CRISPR gRNA sequence
ggtcttgaactcctgacctc

SEQ ID NO: 6917 - DNA, 20 bp, Artificial
  CRISPR gRNA sequence
cctgacctcaagtaatccgc

SEQ ID NO: 6918 - DNA, 20 bp, Artificial
  CRISPR gRNA sequence
ctcaagtaatccgccagcct

SEQ ID NO: 6919 - DNA, 20 bp, Artificial
  CRISPR gRNA sequence
ccgccagcctcggcctctca

SEQ ID NO: 6920 - DNA, 20 bp, Artificial
  CRISPR gRNA sequence
gcctcggcctctcaaagtgc

SEQ ID NO: 6921 - DNA, 20 bp, Artificial
  CRISPR gRNA sequence
cctcggcctctcaaagtgct

SEQ ID NO: 6922 - DNA, 20 bp, Artificial
  CRISPR gRNA sequence
ctctcaaagtgctaggatta

SEQ ID NO: 6923 - DNA, 20 bp, Artificial
  CRISPR gRNA sequence
tctcaaagtgctaggattat

SEQ ID NO: 6924 - DNA, 20 bp, Artificial
  CRISPR gRNA sequence
agtgctaggattataggcgt

SEQ ID NO: 6925 - DNA, 20 bp, Artificial
  CRISPR gRNA sequence
taggcgtgagccaccacccc

SEQ ID NO: 6926 - DNA, 20 bp, Artificial
  CRISPR gRNA sequence
cttctcatgctctttaatca

SEQ ID NO: 6927 - DNA, 20 bp, Artificial
  CRISPR gRNA sequence
catgctctttaatcacagtt

SEQ ID NO: 6928 - DNA, 20 bp, Artificial
  CRISPR gRNA sequence
tgctctttaatcacagttca

SEQ ID NO: 6929 - DNA, 20 bp, Artificial
  CRISPR gRNA sequence
tctttaatcacagttcagag

SEQ ID NO: 6930 - DNA, 20 bp, Artificial
  CRISPR gRNA sequence
atcacagttcagagcagtgc

SEQ ID NO: 6931 - DNA, 20 bp, Artificial
  CRISPR gRNA sequence
cacagttcagagcagtgctg

SEQ ID NO: 6932 - DNA, 20 bp, Artificial
  CRISPR gRNA sequence
acagttcagagcagtgctgg

SEQ ID NO: 6933 - DNA, 20 bp, Artificial
  CRISPR gRNA sequence
agagcagtgctggaggcttt

SEQ ID NO: 6934 - DNA, 20 bp, Artificial
  CRISPR gRNA sequence
gagcagtgctggaggctttt

SEQ ID NO: 6935 - DNA, 20 bp, Artificial
  CRISPR gRNA sequence
agcagtgctggaggctttta

SEQ ID NO: 6936 - DNA, 20 bp, Artificial
  CRISPR gRNA sequence
gcagtgctggaggcttttag

SEQ ID NO: 6937 - DNA, 20 bp, Artificial
  CRISPR gRNA sequence
gtgctggaggcttttagggg

SEQ ID NO: 6938 - DNA, 20 bp, Artificial
  CRISPR gRNA sequence
gaggcttttaggggtagcaa

SEQ ID NO: 6939 - DNA, 20 bp, Artificial
  CRISPR gRNA sequence
ggcttttaggggtagcaaaa

SEQ ID NO: 6940 - DNA, 20 bp, Artificial
  CRISPR gRNA sequence
aagagccttcttctcccttt

SEQ ID NO: 6941 - DNA, 20 bp, Artificial
  CRISPR gRNA sequence
tctccctttcagtgcctcct

SEQ ID NO: 6942 - DNA, 20 bp, Artificial
  CRISPR gRNA sequence
agtgcctccttagaccctca

SEQ ID NO: 6943 - DNA, 20 bp, Artificial
  CRISPR gRNA sequence
cctccttagaccctcaaaga

SEQ ID NO: 6944 - DNA, 20 bp, Artificial
  CRISPR gRNA sequence
aaagatagactccccgcctc

SEQ ID NO: 6945 - DNA, 20 bp, Artificial
  CRISPR gRNA sequence
aagatagactccccgcctct

SEQ ID NO: 6946 - DNA, 20 bp, Artificial
  CRISPR gRNA sequence
atagactccccgcctctggg

SEQ ID NO: 6947 - DNA, 20 bp, Artificial
  CRISPR gRNA sequence
gaagaaaacatctaatgaac

SEQ ID NO: 6948 - DNA, 20 bp, Artificial
  CRISPR gRNA sequence
taatgaactggacgtaatct

SEQ ID NO: 6949 - DNA, 20 bp, Artificial
  CRISPR gRNA sequence
cagcgcctgcgtctgtaaaa

SEQ ID NO: 6950 - DNA, 20 bp, Artificial
  CRISPR gRNA sequence
ctataataacaacaatctcc

SEQ ID NO: 6951 - DNA, 20 bp, Artificial
  CRISPR gRNA sequence
ataataacaacaatctccca

SEQ ID NO: 6952 - DNA, 20 bp, Artificial
  CRISPR gRNA sequence
tctcccagagttgccgttaa

SEQ ID NO: 6953 - DNA, 20 bp, Artificial
  CRISPR gRNA sequence
gttgccgttaacagttgaaa

SEQ ID NO: 6954 - DNA, 20 bp, Artificial
  CRISPR gRNA sequence
cgttaacagttgaaacagaa

SEQ ID NO: 6955 - DNA, 20 bp, Artificial
  CRISPR gRNA sequence
tgaaacagaatagtaaatgc

SEQ ID NO: 6956 - DNA, 20 bp, Artificial
  CRISPR gRNA sequence
gaaacagaatagtaaatgca

SEQ ID NO: 6957 - DNA, 20 bp, Artificial
  CRISPR gRNA sequence
aatagtaaatgcaaggcatc

SEQ ID NO: 6958 - DNA, 20 bp, Artificial
  CRISPR gRNA sequence
taaatgcaaggcatctagca

SEQ ID NO: 6959 - DNA, 20 bp, Artificial
  CRISPR gRNA sequence
caaggcatctagcacagccc

SEQ ID NO: 6960 - DNA, 20 bp, Artificial
  CRISPR gRNA sequence
atctagcacagccccagaca

SEQ ID NO: 6961 - DNA, 20 bp, Artificial
  CRISPR gRNA sequence
ctagcacagccccagacaca

SEQ ID NO: 6962 - DNA, 20 bp, Artificial
  CRISPR gRNA sequence
agacacagagaaatctcccc

SEQ ID NO: 6963 - DNA, 20 bp, Artificial
  CRISPR gRNA sequence
atctcccctggtcactctca

SEQ ID NO: 6964 - DNA, 20 bp, Artificial
  CRISPR gRNA sequence
ctcccctggtcactctcaca

SEQ ID NO: 6965 - DNA, 20 bp, Artificial
  CRISPR gRNA sequence
tcccctggtcactctcacag

SEQ ID NO: 6966 - DNA, 20 bp, Artificial
  CRISPR gRNA sequence
ctggtcactctcacagaggt

SEQ ID NO: 6967 - DNA, 20 bp, Artificial
  CRISPR gRNA sequence
gtcactctcacagaggtaag

SEQ ID NO: 6968 - DNA, 20 bp, Artificial
  CRISPR gRNA sequence
aagcacattaataataaaaa

SEQ ID NO: 6969 - DNA, 20 bp, Artificial
  CRISPR gRNA sequence
cgcatattgtactcaccatg

SEQ ID NO: 6970 - DNA, 20 bp, Artificial
  CRISPR gRNA sequence
atattgtactcaccatgcag

SEQ ID NO: 6971 - DNA, 20 bp, Artificial
  CRISPR gRNA sequence
tgcagaagttgtgctgcctt

SEQ ID NO: 6972 - DNA, 20 bp, Artificial
  CRISPR gRNA sequence
gccttaagctactgttcatt

SEQ ID NO: 6973 - DNA, 20 bp, Artificial
  CRISPR gRNA sequence
actgttcattgagcacttac

SEQ ID NO: 6974 - DNA, 20 bp, Artificial
  CRISPR gRNA sequence
attgagcacttactggtcgc

SEQ ID NO: 6975 - DNA, 20 bp, Artificial
  CRISPR gRNA sequence
tggtcgccagtcccctttct

SEQ ID NO: 6976 - DNA, 20 bp, Artificial
  CRISPR gRNA sequence
ggtcgccagtcccctttcta

SEQ ID NO: 6977 - DNA, 20 bp, Artificial
  CRISPR gRNA sequence
gtcgccagtcccctttctaa

SEQ ID NO: 6978 - DNA, 20 bp, Artificial
  CRISPR gRNA sequence
cttaactcccctaatcctat

SEQ ID NO: 6979 - DNA, 20 bp, Artificial
  CRISPR gRNA sequence
aattattatcccccacttta

SEQ ID NO: 6980 - DNA, 20 bp, Artificial
  CRISPR gRNA sequence
ttatcccccactttacagat

SEQ ID NO: 6981 - DNA, 20 bp, Artificial
  CRISPR gRNA sequence
tatcccccactttacagata

SEQ ID NO: 6982 - DNA, 20 bp, Artificial
  CRISPR gRNA sequence
actttacagataaggaaact

SEQ ID NO: 6983 - DNA, 20 bp, Artificial
  CRISPR gRNA sequence
ctttacagataaggaaactg

SEQ ID NO: 6984 - DNA, 20 bp, Artificial
  CRISPR gRNA sequence
gataaggaaactgaggctcc

SEQ ID NO: 6985 - DNA, 20 bp, Artificial
  CRISPR gRNA sequence
aaggaaactgaggctccaag

SEQ ID NO: 6986 - DNA, 20 bp, Artificial
  CRISPR gRNA sequence
gtttaaaaaatgaacttacc

SEQ ID NO: 6987 - DNA, 20 bp, Artificial
  CRISPR gRNA sequence
aaatgaacttacccagattg

SEQ ID NO: 6988 - DNA, 20 bp, Artificial
  CRISPR gRNA sequence
ttacccagattgtagtgcgt

SEQ ID NO: 6989 - DNA, 20 bp, Artificial
  CRISPR gRNA sequence
cccagattgtagtgcgttgg

SEQ ID NO: 6990 - DNA, 20 bp, Artificial
  CRISPR gRNA sequence
ccagattgtagtgcgttggt

SEQ ID NO: 6991 - DNA, 20 bp, Artificial
  CRISPR gRNA sequence
gattgtagtgcgttggtagg

SEQ ID NO: 6992 - DNA, 20 bp, Artificial
  CRISPR gRNA sequence
attgtagtgcgttggtaggt

SEQ ID NO: 6993 - DNA, 20 bp, Artificial
  CRISPR gRNA sequence
ttgtagtgcgttggtaggta

SEQ ID NO: 6994 - DNA, 20 bp, Artificial
  CRISPR gRNA sequence
ggtaggtagggataacctga

SEQ ID NO: 6995 - DNA, 20 bp, Artificial
  CRISPR gRNA sequence
ggtagggataacctgaaagt

SEQ ID NO: 6996 - DNA, 20 bp, Artificial
  CRISPR gRNA sequence
gtagggataacctgaaagtt

SEQ ID NO: 6997 - DNA, 20 bp, Artificial
  CRISPR gRNA sequence
agttgggaaatttcacccca

SEQ ID NO: 6998 - DNA, 20 bp, Artificial
  CRISPR gRNA sequence
caccccaaagctcaccatct

SEQ ID NO: 6999 - DNA, 20 bp, Artificial
  CRISPR gRNA sequence
gagctccattcatctcccac

SEQ ID NO: 7000 - DNA, 20 bp, Artificial
  CRISPR gRNA sequence
ccattcatctcccaccagct

SEQ ID NO: 7001 - DNA, 20 bp, Artificial
  CRISPR gRNA sequence
tcatctcccaccagctgaga

SEQ ID NO: 7002 - DNA, 20 bp, Artificial
  CRISPR gRNA sequence
atggaacgttatgctgttcc

SEQ ID NO: 7003 - DNA, 20 bp, Artificial
  CRISPR gRNA sequence
gaacgttatgctgttcccag

SEQ ID NO: 7004 - DNA, 20 bp, Artificial
  CRISPR gRNA sequence
acgttatgctgttcccagaa

SEQ ID NO: 7005 - DNA, 20 bp, Artificial
  CRISPR gRNA sequence
gagatgcatgcactgatctt

SEQ ID NO: 7006 - DNA, 20 bp, Artificial
  CRISPR gRNA sequence
tgcatgcactgatcttcaga

SEQ ID NO: 7007 - DNA, 20 bp, Artificial
  CRISPR gRNA sequence
cactgatcttcagatagttt

SEQ ID NO: 7008 - DNA, 20 bp, Artificial
  CRISPR gRNA sequence
tcttcagatagtttaagtct

SEQ ID NO: 7009 - DNA, 20 bp, Artificial
  CRISPR gRNA sequence
cagatagtttaagtctgagt

SEQ ID NO: 7010 - DNA, 20 bp, Artificial
  CRISPR gRNA sequence
aagtctgagttagaacattg

SEQ ID NO: 7011 - DNA, 20 bp, Artificial
  CRISPR gRNA sequence
tggcgacacctgatttccct

SEQ ID NO: 7012 - DNA, 20 bp, Artificial
  CRISPR gRNA sequence
ggcgacacctgatttccctc

SEQ ID NO: 7013 - DNA, 20 bp, Artificial
  CRISPR gRNA sequence
gcgacacctgatttccctcg

SEQ ID NO: 7014 - DNA, 20 bp, Artificial
  CRISPR gRNA sequence
cgacacctgatttccctcgg

SEQ ID NO: 7015 - DNA, 20 bp, Artificial
  CRISPR gRNA sequence
acacctgatttccctcgggg

SEQ ID NO: 7016 - DNA, 20 bp, Artificial
  CRISPR gRNA sequence
acctgatttccctcggggga

SEQ ID NO: 7017 - DNA, 20 bp, Artificial
  CRISPR gRNA sequence
ctgatttccctcgggggaga

SEQ ID NO: 7018 - DNA, 20 bp, Artificial
  CRISPR gRNA sequence
gatttccctcgggggagaga

SEQ ID NO: 7019 - DNA, 20 bp, Artificial
  CRISPR gRNA sequence
atttccctcgggggagagag

SEQ ID NO: 7020 - DNA, 20 bp, Artificial
  CRISPR gRNA sequence
agagaggtgaattgttattt

SEQ ID NO: 7021 - DNA, 20 bp, Artificial
  CRISPR gRNA sequence
tgttatttcagacacctgtt

SEQ ID NO: 7022 - DNA, 20 bp, Artificial
  CRISPR gRNA sequence
acctgtttagtgtctacact

SEQ ID NO: 7023 - DNA, 20 bp, Artificial
  CRISPR gRNA sequence
agcctttcaaatcctgcatg

SEQ ID NO: 7024 - DNA, 20 bp, Artificial
  CRISPR gRNA sequence
caaatcctgcatgcagtgtg

SEQ ID NO: 7025 - DNA, 20 bp, Artificial
  CRISPR gRNA sequence
atcctgcatgcagtgtgaag

SEQ ID NO: 7026 - DNA, 20 bp, Artificial
  CRISPR gRNA sequence
tcctgcatgcagtgtgaagt

SEQ ID NO: 7027 - DNA, 20 bp, Artificial
  CRISPR gRNA sequence
cctgcatgcagtgtgaagtg

SEQ ID NO: 7028 - DNA, 20 bp, Artificial
  CRISPR gRNA sequence
ggatgaaaataaaccccaaa

SEQ ID NO: 7029 - DNA, 20 bp, Artificial
  CRISPR gRNA sequence
gatgaaaataaaccccaaaa

SEQ ID NO: 7030 - DNA, 20 bp, Artificial
  CRISPR gRNA sequence
accccaaaaaggacttttga

SEQ ID NO: 7031 - DNA, 20 bp, Artificial
  CRISPR gRNA sequence
aaaggacttttgatggcaaa

SEQ ID NO: 7032 - DNA, 20 bp, Artificial
  CRISPR gRNA sequence
acttttgatggcaaaaagat

SEQ ID NO: 7033 - DNA, 20 bp, Artificial
  CRISPR gRNA sequence
cttttgatggcaaaaagatc

SEQ ID NO: 7034 - DNA, 20 bp, Artificial
  CRISPR gRNA sequence
aagatcaggaatattttctc

SEQ ID NO: 7035 - DNA, 20 bp, Artificial
  CRISPR gRNA sequence
tcaggaatattttctcgagt

SEQ ID NO: 7036 - DNA, 20 bp, Artificial
  CRISPR gRNA sequence
atattttctcgagttggatg

SEQ ID NO: 7037 - DNA, 20 bp, Artificial
  CRISPR gRNA sequence
ttttctcgagttggatgtgg

SEQ ID NO: 7038 - DNA, 20 bp, Artificial
  CRISPR gRNA sequence
tttctcgagttggatgtgga

SEQ ID NO: 7039 - DNA, 20 bp, Artificial
  CRISPR gRNA sequence
ctcgagttggatgtggaagg

SEQ ID NO: 7040 - DNA, 20 bp, Artificial
  CRISPR gRNA sequence
gagttggatgtggaaggtgg

SEQ ID NO: 7041 - DNA, 20 bp, Artificial
  CRISPR gRNA sequence
ggatgtggaaggtggtggcc

SEQ ID NO: 7042 - DNA, 20 bp, Artificial
  CRISPR gRNA sequence
gatgtggaaggtggtggccc

SEQ ID NO: 7043 - DNA, 20 bp, Artificial
  CRISPR gRNA sequence
atgtggaaggtggtggccca

SEQ ID NO: 7044 - DNA, 20 bp, Artificial
  CRISPR gRNA sequence
tgtggaaggtggtggcccag

SEQ ID NO: 7045 - DNA, 20 bp, Artificial
  CRISPR gRNA sequence
gtggaaggtggtggcccagg

SEQ ID NO: 7046 - DNA, 20 bp, Artificial
  CRISPR gRNA sequence
gaaggtggtggcccaggggg

SEQ ID NO: 7047 - DNA, 20 bp, Artificial
  CRISPR gRNA sequence
tggtggcccagggggaagca

SEQ ID NO: 7048 - DNA, 20 bp, Artificial
  CRISPR gRNA sequence
cagggggaagcacagtttca

SEQ ID NO: 7049 - DNA, 20 bp, Artificial
  CRISPR gRNA sequence
gggggaagcacagtttcaaa

SEQ ID NO: 7050 - DNA, 20 bp, Artificial
  CRISPR gRNA sequence
ggggaagcacagtttcaaag

SEQ ID NO: 7051 - DNA, 20 bp, Artificial
  CRISPR gRNA sequence
aatactgcccatttaccaaa

SEQ ID NO: 7052 - DNA, 20 bp, Artificial
  CRISPR gRNA sequence
gcccatttaccaaaaagaca

SEQ ID NO: 7053 - DNA, 20 bp, Artificial
  CRISPR gRNA sequence
gcctctgccctgcccccaca

SEQ ID NO: 7054 - DNA, 20 bp, Artificial
  CRISPR gRNA sequence
gcccccacatggctcctcaa

SEQ ID NO: 7055 - DNA, 20 bp, Artificial
  CRISPR gRNA sequence
cccccacatggctcctcaaa

SEQ ID NO: 7056 - DNA, 20 bp, Artificial
  CRISPR gRNA sequence
cccacatggctcctcaaaag

SEQ ID NO: 7057 - DNA, 20 bp, Artificial
  CRISPR gRNA sequence
ccacccacgccttccctcgc

SEQ ID NO: 7058 - DNA, 20 bp, Artificial
  CRISPR gRNA sequence
cacccacgccttccctcgcc

SEQ ID NO: 7059 - DNA, 20 bp, Artificial
  CRISPR gRNA sequence
acccacgccttccctcgccg

SEQ ID NO: 7060 - DNA, 20 bp, Artificial
  CRISPR gRNA sequence
gccttccctcgccggggtgc

SEQ ID NO: 7061 - DNA, 20 bp, Artificial
  CRISPR gRNA sequence
ccttccctcgccggggtgct

SEQ ID NO: 7062 - DNA, 20 bp, Artificial
  CRISPR gRNA sequence
cttccctcgccggggtgctg

SEQ ID NO: 7063 - DNA, 20 bp, Artificial
  CRISPR gRNA sequence
ttccctcgccggggtgctgg

SEQ ID NO: 7064 - DNA, 20 bp, Artificial
  CRISPR gRNA sequence
tccctcgccggggtgctggg

SEQ ID NO: 7065 - DNA, 20 bp, Artificial
  CRISPR gRNA sequence
ccggggtgctggggggccaa

SEQ ID NO: 7066 - DNA, 20 bp, Artificial
  CRISPR gRNA sequence
ggggccaacagcaattcaaa

SEQ ID NO: 7067 - DNA, 20 bp, Artificial
  CRISPR gRNA sequence
gggccaacagcaattcaaaa

SEQ ID NO: 7068 - DNA, 20 bp, Artificial
  CRISPR gRNA sequence
acagcaattcaaaaaggcta

SEQ ID NO: 7069 - DNA, 20 bp, Artificial
  CRISPR gRNA sequence
agcaattcaaaaaggctata

SEQ ID NO: 7070 - DNA, 20 bp, Artificial
  CRISPR gRNA sequence
aattcaaaaaggctatagag

SEQ ID NO: 7071 - DNA, 20 bp, Artificial
  CRISPR gRNA sequence
attcaaaaaggctatagagt

SEQ ID NO: 7072 - DNA, 20 bp, Artificial
  CRISPR gRNA sequence
aaaaggctatagagtgggct

SEQ ID NO: 7073 - DNA, 20 bp, Artificial
  CRISPR gRNA sequence
tatagagtgggctgagactt

SEQ ID NO: 7074 - DNA, 20 bp, Artificial
  CRISPR gRNA sequence
tagagtgggctgagactttg

SEQ ID NO: 7075 - DNA, 20 bp, Artificial
  CRISPR gRNA sequence
gtgggctgagactttggaga

SEQ ID NO: 7076 - DNA, 20 bp, Artificial
  CRISPR gRNA sequence
tgggctgagactttggagat

SEQ ID NO: 7077 - DNA, 20 bp, Artificial
  CRISPR gRNA sequence
gctgagactttggagatggg

SEQ ID NO: 7078 - DNA, 20 bp, Artificial
  CRISPR gRNA sequence
gactttggagatgggtagtt

SEQ ID NO: 7079 - DNA, 20 bp, Artificial
  CRISPR gRNA sequence
gggtagtttggttcaaatct

SEQ ID NO: 7080 - DNA, 20 bp, Artificial
  CRISPR gRNA sequence
ctcagcccactaatccctct

SEQ ID NO: 7081 - DNA, 20 bp, Artificial
  CRISPR gRNA sequence
ctgtctcttcatctgaaaaa

SEQ ID NO: 7082 - DNA, 20 bp, Artificial
  CRISPR gRNA sequence
tgtctcttcatctgaaaaac

SEQ ID NO: 7083 - DNA, 20 bp, Artificial
  CRISPR gRNA sequence
ctgaaaaacaggaatacaaa

SEQ ID NO: 7084 - DNA, 20 bp, Artificial
  CRISPR gRNA sequence
aatacaaatagctgatgtgt

SEQ ID NO: 7085 - DNA, 20 bp, Artificial
  CRISPR gRNA sequence
caaatagctgatgtgtaagt

SEQ ID NO: 7086 - DNA, 20 bp, Artificial
  CRISPR gRNA sequence
gatgtgtaagttagaccaaa

SEQ ID NO: 7087 - DNA, 20 bp, Artificial
  CRISPR gRNA sequence
atgtgtaagttagaccaaat

SEQ ID NO: 7088 - DNA, 20 bp, Artificial
  CRISPR gRNA sequence
tgtgtaagttagaccaaatg

SEQ ID NO: 7089 - DNA, 20 bp, Artificial
  CRISPR gRNA sequence
ccaaatggggtaatgcctac

SEQ ID NO: 7090 - DNA, 20 bp, Artificial
  CRISPR gRNA sequence
tgcctacgagtcatgtcatt

SEQ ID NO: 7091 - DNA, 20 bp, Artificial
  CRISPR gRNA sequence
gagtcatgtcatttggtacc

SEQ ID NO: 7092 - DNA, 20 bp, Artificial
  CRISPR gRNA sequence
atttggtacctggcacttgc

SEQ ID NO: 7093 - DNA, 20 bp, Artificial
  CRISPR gRNA sequence
ttgctggacactgtgaattc

SEQ ID NO: 7094 - DNA, 20 bp, Artificial
  CRISPR gRNA sequence
ctagttctatatcattgcca

SEQ ID NO: 7095 - DNA, 20 bp, Artificial
  CRISPR gRNA sequence
ctatatcattgccacggatg

SEQ ID NO: 7096 - DNA, 20 bp, Artificial
  CRISPR gRNA sequence
atatcattgccacggatgaa

SEQ ID NO: 7097 - DNA, 20 bp, Artificial
  CRISPR gRNA sequence
atcattgccacggatgaaga

SEQ ID NO: 7098 - DNA, 20 bp, Artificial
  CRISPR gRNA sequence
tcattgccacggatgaagag

SEQ ID NO: 7099 - DNA, 20 bp, Artificial
  CRISPR gRNA sequence
tgaagagaggctgccatgcg

SEQ ID NO: 7100 - DNA, 20 bp, Artificial
  CRISPR gRNA sequence
gccatgcgcagaaacatgct

SEQ ID NO: 7101 - DNA, 20 bp, Artificial
  CRISPR gRNA sequence
catgcgcagaaacatgctga

SEQ ID NO: 7102 - DNA, 20 bp, Artificial
  CRISPR gRNA sequence
cgcagaaacatgctgagagc

SEQ ID NO: 7103 - DNA, 20 bp, Artificial
  CRISPR gRNA sequence
gcagaaacatgctgagagct

SEQ ID NO: 7104 - DNA, 20 bp, Artificial
  CRISPR gRNA sequence
agaaacatgctgagagctgg

SEQ ID NO: 7105 - DNA, 20 bp, Artificial
  CRISPR gRNA sequence
aacatgctgagagctgggag

SEQ ID NO: 7106 - DNA, 20 bp, Artificial
  CRISPR gRNA sequence
acatgctgagagctgggaga

SEQ ID NO: 7107 - DNA, 20 bp, Artificial
  CRISPR gRNA sequence
gctgagagctgggagaaggt

SEQ ID NO: 7108 - DNA, 20 bp, Artificial
  CRISPR gRNA sequence
agagctgggagaaggtgagc

SEQ ID NO: 7109 - DNA, 20 bp, Artificial
  CRISPR gRNA sequence
agctgggagaaggtgagcta

SEQ ID NO: 7110 - DNA, 20 bp, Artificial
  CRISPR gRNA sequence
gctgggagaaggtgagctag

SEQ ID NO: 7111 - DNA, 20 bp, Artificial
  CRISPR gRNA sequence
ctgggagaaggtgagctaga

SEQ ID NO: 7112 - DNA, 20 bp, Artificial
  CRISPR gRNA sequence
gaaggtgagctagagggata

SEQ ID NO: 7113 - DNA, 20 bp, Artificial
  CRISPR gRNA sequence
agggatacagtccctgccct

SEQ ID NO: 7114 - DNA, 20 bp, Artificial
  CRISPR gRNA sequence
gggatacagtccctgccctc

SEQ ID NO: 7115 - DNA, 20 bp, Artificial
  CRISPR gRNA sequence
ggatacagtccctgccctca

SEQ ID NO: 7116 - DNA, 20 bp, Artificial
  CRISPR gRNA sequence
atacagtccctgccctcagg

SEQ ID NO: 7117 - DNA, 20 bp, Artificial
  CRISPR gRNA sequence
acagtccctgccctcaggga

SEQ ID NO: 7118 - DNA, 20 bp, Artificial
  CRISPR gRNA sequence
cctgccctcagggagagctg

SEQ ID NO: 7119 - DNA, 20 bp, Artificial
  CRISPR gRNA sequence
ctgccctcagggagagctga

SEQ ID NO: 7120 - DNA, 20 bp, Artificial
  CRISPR gRNA sequence
tgccctcagggagagctgaa

SEQ ID NO: 7121 - DNA, 20 bp, Artificial
  CRISPR gRNA sequence
aagggctctctctcctgcca

SEQ ID NO: 7122 - DNA, 20 bp, Artificial
  CRISPR gRNA sequence
agggctctctctcctgccac

SEQ ID NO: 7123 - DNA, 20 bp, Artificial
  CRISPR gRNA sequence
ctctcctgccacgggatgat

SEQ ID NO: 7124 - DNA, 20 bp, Artificial
  CRISPR gRNA sequence
tctcctgccacgggatgatc

SEQ ID NO: 7125 - DNA, 20 bp, Artificial
  CRISPR gRNA sequence
ctcctgccacgggatgatca

SEQ ID NO: 7126 - DNA, 20 bp, Artificial
  CRISPR gRNA sequence
cttttccctccatcccgctc

SEQ ID NO: 7127 - DNA, 20 bp, Artificial
  CRISPR gRNA sequence
tccatcccgctctggcaatg

SEQ ID NO: 7128 - DNA, 20 bp, Artificial
  CRISPR gRNA sequence
cccgctctggcaatgtggtt

SEQ ID NO: 7129 - DNA, 20 bp, Artificial
  CRISPR gRNA sequence
cgctctggcaatgtggtttg

SEQ ID NO: 7130 - DNA, 20 bp, Artificial
  CRISPR gRNA sequence
ggcaatgtggtttggagaaa

SEQ ID NO: 7131 - DNA, 20 bp, Artificial
  CRISPR gRNA sequence
tttggagaaacagtccaatg

SEQ ID NO: 7132 - DNA, 20 bp, Artificial
  CRISPR gRNA sequence
ttggagaaacagtccaatga

SEQ ID NO: 7133 - DNA, 20 bp, Artificial
  CRISPR gRNA sequence
tggagaaacagtccaatgaa

SEQ ID NO: 7134 - DNA, 20 bp, Artificial
  CRISPR gRNA sequence
ggagaaacagtccaatgaag

SEQ ID NO: 7135 - DNA, 20 bp, Artificial
  CRISPR gRNA sequence
gtccaatgaaggggcctttg

SEQ ID NO: 7136 - DNA, 20 bp, Artificial
  CRISPR gRNA sequence
gggcctttgaagcacttcct

SEQ ID NO: 7137 - DNA, 20 bp, Artificial
  CRISPR gRNA sequence
aagcacttcctaagcatcta

SEQ ID NO: 7138 - DNA, 20 bp, Artificial
  CRISPR gRNA sequence
ttcctaagcatctatagaca

SEQ ID NO: 7139 - DNA, 20 bp, Artificial
  CRISPR gRNA sequence
tcctaagcatctatagacat

SEQ ID NO: 7140 - DNA, 20 bp, Artificial
  CRISPR gRNA sequence
atctatagacataggaaact

SEQ ID NO: 7141 - DNA, 20 bp, Artificial
  CRISPR gRNA sequence
agacataggaaacttggctc

SEQ ID NO: 7142 - DNA, 20 bp, Artificial
  CRISPR gRNA sequence
gacataggaaacttggctct

SEQ ID NO: 7143 - DNA, 20 bp, Artificial
  CRISPR gRNA sequence
acataggaaacttggctctg

SEQ ID NO: 7144 - DNA, 20 bp, Artificial
  CRISPR gRNA sequence
aggaaacttggctctgggga

SEQ ID NO: 7145 - DNA, 20 bp, Artificial
  CRISPR gRNA sequence
gaaacttggctctggggata

SEQ ID NO: 7146 - DNA, 20 bp, Artificial
  CRISPR gRNA sequence
aaacttggctctggggatag

SEQ ID NO: 7147 - DNA, 20 bp, Artificial
  CRISPR gRNA sequence
cttggctctggggatagagg

SEQ ID NO: 7148 - DNA, 20 bp, Artificial
  CRISPR gRNA sequence
ttggctctggggatagagga

SEQ ID NO: 7149 - DNA, 20 bp, Artificial
  CRISPR gRNA sequence
atagaggaaggtcccatgcc

SEQ ID NO: 7150 - DNA, 20 bp, Artificial
  CRISPR gRNA sequence
aaggtcccatgccaagattc

SEQ ID NO: 7151 - DNA, 20 bp, Artificial
  CRISPR gRNA sequence
gtcccatgccaagattcaag

SEQ ID NO: 7152 - DNA, 20 bp, Artificial
  CRISPR gRNA sequence
gccaagattcaagtagatct

SEQ ID NO: 7153 - DNA, 20 bp, Artificial
  CRISPR gRNA sequence
caagtagatcttggtgtgac

SEQ ID NO: 7154 - DNA, 20 bp, Artificial
  CRISPR gRNA sequence
aagtagatcttggtgtgact

SEQ ID NO: 7155 - DNA, 20 bp, Artificial
  CRISPR gRNA sequence
gtagatcttggtgtgactgg

SEQ ID NO: 7156 - DNA, 20 bp, Artificial
  CRISPR gRNA sequence
tagatcttggtgtgactggg

SEQ ID NO: 7157 - DNA, 20 bp, Artificial
  CRISPR gRNA sequence
atcttggtgtgactgggagg

SEQ ID NO: 7158 - DNA, 20 bp, Artificial
  CRISPR gRNA sequence
gtgtgactgggaggcagctg

SEQ ID NO: 7159 - DNA, 20 bp, Artificial
  CRISPR gRNA sequence
gggaggcagctgtggcgttg

SEQ ID NO: 7160 - DNA, 20 bp, Artificial
  CRISPR gRNA sequence
ggaggcagctgtggcgttgt

SEQ ID NO: 7161 - DNA, 20 bp, Artificial
  CRISPR gRNA sequence
gaggcagctgtggcgttgtg

SEQ ID NO: 7162 - DNA, 20 bp, Artificial
  CRISPR gRNA sequence
tgtggcgttgtggggaaacc

SEQ ID NO: 7163 - DNA, 20 bp, Artificial
  CRISPR gRNA sequence
tggcgttgtggggaaaccta

SEQ ID NO: 7164 - DNA, 20 bp, Artificial
  CRISPR gRNA sequence
tgtggggaaacctagagtct

SEQ ID NO: 7165 - DNA, 20 bp, Artificial
  CRISPR gRNA sequence
gtggggaaacctagagtctt

SEQ ID NO: 7166 - DNA, 20 bp, Artificial
  CRISPR gRNA sequence
agagtcttgggcctgaattt

SEQ ID NO: 7167 - DNA, 20 bp, Artificial
  CRISPR gRNA sequence
tttgacaccctctaatgtaa

SEQ ID NO: 7168 - DNA, 20 bp, Artificial
  CRISPR gRNA sequence
ttgacaccctctaatgtaat

SEQ ID NO: 7169 - DNA, 20 bp, Artificial
  CRISPR gRNA sequence
taatgggcttcctttgactg

SEQ ID NO: 7170 - DNA, 20 bp, Artificial
  CRISPR gRNA sequence
aatgggcttcctttgactgt

SEQ ID NO: 7171 - DNA, 20 bp, Artificial
  CRISPR gRNA sequence
ttgactgtaggcttcccaca

SEQ ID NO: 7172 - DNA, 20 bp, Artificial
  CRISPR gRNA sequence
ctgtaggcttcccacatagc

SEQ ID NO: 7173 - DNA, 20 bp, Artificial
  CRISPR gRNA sequence
cacatagctggcaccccaca

SEQ ID NO: 7174 - DNA, 20 bp, Artificial
  CRISPR gRNA sequence
caccccacacagaactccct

SEQ ID NO: 7175 - DNA, 20 bp, Artificial
  CRISPR gRNA sequence
ttggccttctgatgatcctg

SEQ ID NO: 7176 - DNA, 20 bp, Artificial
  CRISPR gRNA sequence
tggccttctgatgatcctgc

SEQ ID NO: 7177 - DNA, 20 bp, Artificial
  CRISPR gRNA sequence
ttgttttttgtttttttttt

SEQ ID NO: 7178 - DNA, 20 bp, Artificial
  CRISPR gRNA sequence
tttttgttttttttttgaga

SEQ ID NO: 7179 - DNA, 20 bp, Artificial
  CRISPR gRNA sequence
tggtatctcactttgtcgcc

SEQ ID NO: 7180 - DNA, 20 bp, Artificial
  CRISPR gRNA sequence
ggtatctcactttgtcgccc

SEQ ID NO: 7181 - DNA, 20 bp, Artificial
  CRISPR gRNA sequence
tctcactttgtcgcccaggc

SEQ ID NO: 7182 - DNA, 20 bp, Artificial
  CRISPR gRNA sequence
tcactttgtcgcccaggctg

SEQ ID NO: 7183 - DNA, 20 bp, Artificial
  CRISPR gRNA sequence
ttgtcgcccaggctggagtg

SEQ ID NO: 7184 - DNA, 20 bp, Artificial
  CRISPR gRNA sequence
tcgcccaggctggagtgcag

SEQ ID NO: 7185 - DNA, 20 bp, Artificial
  CRISPR gRNA sequence
caggctggagtgcagtggcg

SEQ ID NO: 7186 - DNA, 20 bp, Artificial
  CRISPR gRNA sequence
ggagtgcagtggcgcagtct

SEQ ID NO: 7187 - DNA, 20 bp, Artificial
  CRISPR gRNA sequence
ggcgcagtcttggttcactg

SEQ ID NO: 7188 - DNA, 20 bp, Artificial
  CRISPR gRNA sequence
tcactgcagcctctgcctcc

SEQ ID NO: 7189 - DNA, 20 bp, Artificial
  CRISPR gRNA sequence
cactgcagcctctgcctccc

SEQ ID NO: 7190 - DNA, 20 bp, Artificial
  CRISPR gRNA sequence
agcctctgcctcccaggttc

SEQ ID NO: 7191 - DNA, 20 bp, Artificial
  CRISPR gRNA sequence
ttcaagcgattctcctgcct

SEQ ID NO: 7192 - DNA, 20 bp, Artificial
  CRISPR gRNA sequence
ttctcctgcctcagcctccc

SEQ ID NO: 7193 - DNA, 20 bp, Artificial
  CRISPR gRNA sequence
tcctgcctcagcctcccaag

SEQ ID NO: 7194 - DNA, 20 bp, Artificial
  CRISPR gRNA sequence
gcctcagcctcccaagtagc

SEQ ID NO: 7195 - DNA, 20 bp, Artificial
  CRISPR gRNA sequence
cctcagcctcccaagtagct

SEQ ID NO: 7196 - DNA, 20 bp, Artificial
  CRISPR gRNA sequence
ctcccaagtagctgggatta

SEQ ID NO: 7197 - DNA, 20 bp, Artificial
  CRISPR gRNA sequence
ccaagtagctgggattacag

SEQ ID NO: 7198 - DNA, 20 bp, Artificial
  CRISPR gRNA sequence
cagaagcacgccaccatgcc

SEQ ID NO: 7199 - DNA, 20 bp, Artificial
  CRISPR gRNA sequence
cctggctaattttgtatttt

SEQ ID NO: 7200 - DNA, 20 bp, Artificial
  CRISPR gRNA sequence
ggctaattttgtatttttag

SEQ ID NO: 7201 - DNA, 20 bp, Artificial
  CRISPR gRNA sequence
ctaattttgtatttttagta

SEQ ID NO: 7202 - DNA, 20 bp, Artificial
  CRISPR gRNA sequence
ttttgtatttttagtagaga

SEQ ID NO: 7203 - DNA, 20 bp, Artificial
  CRISPR gRNA sequence
tttgtatttttagtagagac

SEQ ID NO: 7204 - DNA, 20 bp, Artificial
  CRISPR gRNA sequence
cgggatttcaccatgttgcc

SEQ ID NO: 7205 - DNA, 20 bp, Artificial
  CRISPR gRNA sequence
gggatttcaccatgttgccc

SEQ ID NO: 7206 - DNA, 20 bp, Artificial
  CRISPR gRNA sequence
tttcaccatgttgcccgggc

SEQ ID NO: 7207 - DNA, 20 bp, Artificial
  CRISPR gRNA sequence
ggtctcaaactcctgacctc

SEQ ID NO: 7208 - DNA, 20 bp, Artificial
  CRISPR gRNA sequence
ctcaagtgatctgcctgcct

SEQ ID NO: 7209 - DNA, 20 bp, Artificial
  CRISPR gRNA sequence
ctgcctgcctcggcctccca

SEQ ID NO: 7210 - DNA, 20 bp, Artificial
  CRISPR gRNA sequence
cctgcctcggcctcccacag

SEQ ID NO: 7211 - DNA, 20 bp, Artificial
  CRISPR gRNA sequence
gcctcggcctcccacagtgg

SEQ ID NO: 7212 - DNA, 20 bp, Artificial
  CRISPR gRNA sequence
cctcggcctcccacagtggt

SEQ ID NO: 7213 - DNA, 20 bp, Artificial
  CRISPR gRNA sequence
ctcccacagtggtgggctgc

SEQ ID NO: 7214 - DNA, 20 bp, Artificial
  CRISPR gRNA sequence
tcccacagtggtgggctgca

SEQ ID NO: 7215 - DNA, 20 bp, Artificial
  CRISPR gRNA sequence
gcaaggcaatcttcattctc

SEQ ID NO: 7216 - DNA, 20 bp, Artificial
  CRISPR gRNA sequence
tcattctccagaactaatat

SEQ ID NO: 7217 - DNA, 20 bp, Artificial
  CRISPR gRNA sequence
cattctccagaactaatatt

SEQ ID NO: 7218 - DNA, 20 bp, Artificial
  CRISPR gRNA sequence
atattgggaaaactgatgtt

SEQ ID NO: 7219 - DNA, 20 bp, Artificial
  CRISPR gRNA sequence
attgggaaaactgatgttca

SEQ ID NO: 7220 - DNA, 20 bp, Artificial
  CRISPR gRNA sequence
tgggaaaactgatgttcaga

SEQ ID NO: 7221 - DNA, 20 bp, Artificial
  CRISPR gRNA sequence
gggaaaactgatgttcagag

SEQ ID NO: 7222 - DNA, 20 bp, Artificial
  CRISPR gRNA sequence
aactgatgttcagagaggtc

SEQ ID NO: 7223 - DNA, 20 bp, Artificial
  CRISPR gRNA sequence
ttcagagaggtcaagtgact

SEQ ID NO: 7224 - DNA, 20 bp, Artificial
  CRISPR gRNA sequence
agaggtcaagtgacttggct

SEQ ID NO: 7225 - DNA, 20 bp, Artificial
  CRISPR gRNA sequence
gaggtcaagtgacttggcta

SEQ ID NO: 7226 - DNA, 20 bp, Artificial
  CRISPR gRNA sequence
gtgacttggctaaggcatca

SEQ ID NO: 7227 - DNA, 20 bp, Artificial
  CRISPR gRNA sequence
cttggctaaggcatcacagc

SEQ ID NO: 7228 - DNA, 20 bp, Artificial
  CRISPR gRNA sequence
aaggcatcacagccagaatt

SEQ ID NO: 7229 - DNA, 20 bp, Artificial
  CRISPR gRNA sequence
cacagccagaattcagatgc

SEQ ID NO: 7230 - DNA, 20 bp, Artificial
  CRISPR gRNA sequence
gctcctaaaccacatgacct

SEQ ID NO: 7231 - DNA, 20 bp, Artificial
  CRISPR gRNA sequence
taaaccacatgaccttggac

SEQ ID NO: 7232 - DNA, 20 bp, Artificial
  CRISPR gRNA sequence
cttggacaagccatttcact

SEQ ID NO: 7233 - DNA, 20 bp, Artificial
  CRISPR gRNA sequence
ttggacaagccatttcactg

SEQ ID NO: 7234 - DNA, 20 bp, Artificial
  CRISPR gRNA sequence
gaggcgtgtgaacctcctct

SEQ ID NO: 7235 - DNA, 20 bp, Artificial
  CRISPR gRNA sequence
gaacctcctctaagctcaaa

SEQ ID NO: 7236 - DNA, 20 bp, Artificial
  CRISPR gRNA sequence
aacctcctctaagctcaaat

SEQ ID NO: 7237 - DNA, 20 bp, Artificial
  CRISPR gRNA sequence
actctaccctgccttttccc

SEQ ID NO: 7238 - DNA, 20 bp, Artificial
  CRISPR gRNA sequence
tctaccctgccttttcccca

SEQ ID NO: 7239 - DNA, 20 bp, Artificial
  CRISPR gRNA sequence
gccttttccccagagctttt

SEQ ID NO: 7240 - DNA, 20 bp, Artificial
  CRISPR gRNA sequence
ccttttccccagagcttttt

SEQ ID NO: 7241 - DNA, 20 bp, Artificial
  CRISPR gRNA sequence
cccagagctttttgggaact

SEQ ID NO: 7242 - DNA, 20 bp, Artificial
  CRISPR gRNA sequence
gagctttttgggaactcaga

SEQ ID NO: 7243 - DNA, 20 bp, Artificial
  CRISPR gRNA sequence
ttttgggaactcagatggtg

SEQ ID NO: 7244 - DNA, 20 bp, Artificial
  CRISPR gRNA sequence
ttgggaactcagatggtgtg

SEQ ID NO: 7245 - DNA, 20 bp, Artificial
  CRISPR gRNA sequence
tgggaactcagatggtgtgg

SEQ ID NO: 7246 - DNA, 20 bp, Artificial
  CRISPR gRNA sequence
aactcagatggtgtggagga

SEQ ID NO: 7247 - DNA, 20 bp, Artificial
  CRISPR gRNA sequence
ctcagatggtgtggaggatg

SEQ ID NO: 7248 - DNA, 20 bp, Artificial
  CRISPR gRNA sequence
tcagatggtgtggaggatgg

SEQ ID NO: 7249 - DNA, 20 bp, Artificial
  CRISPR gRNA sequence
gatggtgtggaggatggagg

SEQ ID NO: 7250 - DNA, 20 bp, Artificial
  CRISPR gRNA sequence
ggtgtggaggatggaggcag

SEQ ID NO: 7251 - DNA, 20 bp, Artificial
  CRISPR gRNA sequence
tggaggcagaagtccactgt

SEQ ID NO: 7252 - DNA, 20 bp, Artificial
  CRISPR gRNA sequence
ctgcaaatccttgatcaccc

SEQ ID NO: 7253 - DNA, 20 bp, Artificial
  CRISPR gRNA sequence
gcaaatccttgatcacccaa

SEQ ID NO: 7254 - DNA, 20 bp, Artificial
  CRISPR gRNA sequence
caaatccttgatcacccaag

SEQ ID NO: 7255 - DNA, 20 bp, Artificial
  CRISPR gRNA sequence
atccttgatcacccaagagg

SEQ ID NO: 7256 - DNA, 20 bp, Artificial
  CRISPR gRNA sequence
tcacccaagaggaagtgctt

SEQ ID NO: 7257 - DNA, 20 bp, Artificial
  CRISPR gRNA sequence
cacccaagaggaagtgctta

SEQ ID NO: 7258 - DNA, 20 bp, Artificial
  CRISPR gRNA sequence
aagaggaagtgcttaaggtg

SEQ ID NO: 7259 - DNA, 20 bp, Artificial
  CRISPR gRNA sequence
agaggaagtgcttaaggtgc

SEQ ID NO: 7260 - DNA, 20 bp, Artificial
  CRISPR gRNA sequence
agtgcttaaggtgcaggctt

SEQ ID NO: 7261 - DNA, 20 bp, Artificial
  CRISPR gRNA sequence
taaggtgcaggcttcagtct

SEQ ID NO: 7262 - DNA, 20 bp, Artificial
  CRISPR gRNA sequence
aaggtgcaggcttcagtctt

SEQ ID NO: 7263 - DNA, 20 bp, Artificial
  CRISPR gRNA sequence
aggtgcaggcttcagtctta

SEQ ID NO: 7264 - DNA, 20 bp, Artificial
  CRISPR gRNA sequence
tgcaggcttcagtcttaggg

SEQ ID NO: 7265 - DNA, 20 bp, Artificial
  CRISPR gRNA sequence
aggcttcagtcttagggaag

SEQ ID NO: 7266 - DNA, 20 bp, Artificial
  CRISPR gRNA sequence
ggcttcagtcttagggaagc

SEQ ID NO: 7267 - DNA, 20 bp, Artificial
  CRISPR gRNA sequence
ttcagtcttagggaagcagg

SEQ ID NO: 7268 - DNA, 20 bp, Artificial
  CRISPR gRNA sequence
agtcttagggaagcaggaag

SEQ ID NO: 7269 - DNA, 20 bp, Artificial
  CRISPR gRNA sequence
gtcttagggaagcaggaagt

SEQ ID NO: 7270 - DNA, 20 bp, Artificial
  CRISPR gRNA sequence
tcttagggaagcaggaagtg

SEQ ID NO: 7271 - DNA, 20 bp, Artificial
  CRISPR gRNA sequence
tggggcgctgaaatgtgtat

SEQ ID NO: 7272 - DNA, 20 bp, Artificial
  CRISPR gRNA sequence
ggggcgctgaaatgtgtatt

SEQ ID NO: 7273 - DNA, 20 bp, Artificial
  CRISPR gRNA sequence
gggcgctgaaatgtgtattg

SEQ ID NO: 7274 - DNA, 20 bp, Artificial
  CRISPR gRNA sequence
ggcgctgaaatgtgtattgg

SEQ ID NO: 7275 - DNA, 20 bp, Artificial
  CRISPR gRNA sequence
aaatgtgtattgggggcttc

SEQ ID NO: 7276 - DNA, 20 bp, Artificial
  CRISPR gRNA sequence
aatgtgtattgggggcttct

SEQ ID NO: 7277 - DNA, 20 bp, Artificial
  CRISPR gRNA sequence
tgtgtattgggggcttctgg

SEQ ID NO: 7278 - DNA, 20 bp, Artificial
  CRISPR gRNA sequence
gtgtattgggggcttctggg

SEQ ID NO: 7279 - DNA, 20 bp, Artificial
  CRISPR gRNA sequence
tgtattgggggcttctggga

SEQ ID NO: 7280 - DNA, 20 bp, Artificial
  CRISPR gRNA sequence
gtattgggggcttctgggag

SEQ ID NO: 7281 - DNA, 20 bp, Artificial
  CRISPR gRNA sequence
tattgggggcttctgggagg

SEQ ID NO: 7282 - DNA, 20 bp, Artificial
  CRISPR gRNA sequence
ggagggggtttcttcttgtc

SEQ ID NO: 7283 - DNA, 20 bp, Artificial
  CRISPR gRNA sequence
gagggggtttcttcttgtcc

SEQ ID NO: 7284 - DNA, 20 bp, Artificial
  CRISPR gRNA sequence
ggtttcttcttgtccaggtt

SEQ ID NO: 7285 - DNA, 20 bp, Artificial
  CRISPR gRNA sequence
tccaggttgagccaatgacg

SEQ ID NO: 7286 - DNA, 20 bp, Artificial
  CRISPR gRNA sequence
tgagccaatgacgcagatct

SEQ ID NO: 7287 - DNA, 20 bp, Artificial
  CRISPR gRNA sequence
gagccaatgacgcagatctt

SEQ ID NO: 7288 - DNA, 20 bp, Artificial
  CRISPR gRNA sequence
gacgcagatcttaggccctc

SEQ ID NO: 7289 - DNA, 20 bp, Artificial
  CRISPR gRNA sequence
ccctctggtgactttttgcc

SEQ ID NO: 7290 - DNA, 20 bp, Artificial
  CRISPR gRNA sequence
cctctggtgactttttgccc

SEQ ID NO: 7291 - DNA, 20 bp, Artificial
  CRISPR gRNA sequence
tttttgcccaggcaacttct

SEQ ID NO: 7292 - DNA, 20 bp, Artificial
  CRISPR gRNA sequence
ttgcccaggcaacttctcag

SEQ ID NO: 7293 - DNA, 20 bp, Artificial
  CRISPR gRNA sequence
cccaggcaacttctcagtgg

SEQ ID NO: 7294 - DNA, 20 bp, Artificial
  CRISPR gRNA sequence
caacttctcagtggtggtga

SEQ ID NO: 7295 - DNA, 20 bp, Artificial
  CRISPR gRNA sequence
aacttctcagtggtggtgat

SEQ ID NO: 7296 - DNA, 20 bp, Artificial
  CRISPR gRNA sequence
acttctcagtggtggtgatg

SEQ ID NO: 7297 - DNA, 20 bp, Artificial
  CRISPR gRNA sequence
ttctcagtggtggtgatggg

SEQ ID NO: 7298 - DNA, 20 bp, Artificial
  CRISPR gRNA sequence
agtggtggtgatggggagcg

SEQ ID NO: 7299 - DNA, 20 bp, Artificial
  CRISPR gRNA sequence
gtggtgatggggagcgtggc

SEQ ID NO: 7300 - DNA, 20 bp, Artificial
  CRISPR gRNA sequence
ggagcgtggccagaccatcc

SEQ ID NO: 7301 - DNA, 20 bp, Artificial
  CRISPR gRNA sequence
gaccatccaagctgccctgc

SEQ ID NO: 7302 - DNA, 20 bp, Artificial
  CRISPR gRNA sequence
ccaagctgccctgctggctg

SEQ ID NO: 7303 - DNA, 20 bp, Artificial
  CRISPR gRNA sequence
caagctgccctgctggctgt

SEQ ID NO: 7304 - DNA, 20 bp, Artificial
  CRISPR gRNA sequence
aagctgccctgctggctgtg

SEQ ID NO: 7305 - DNA, 20 bp, Artificial
  CRISPR gRNA sequence
agctgccctgctggctgtgg

SEQ ID NO: 7306 - DNA, 20 bp, Artificial
  CRISPR gRNA sequence
ggggccttttttttttttct

SEQ ID NO: 7307 - DNA, 20 bp, Artificial
  CRISPR gRNA sequence
ttttttttttttctgagaca

SEQ ID NO: 7308 - DNA, 20 bp, Artificial
  CRISPR gRNA sequence
tttttttctgagacacagtc

SEQ ID NO: 7309 - DNA, 20 bp, Artificial
  CRISPR gRNA sequence
cacagtctggctctatcacc

SEQ ID NO: 7310 - DNA, 20 bp, Artificial
  CRISPR gRNA sequence
acagtctggctctatcaccc

SEQ ID NO: 7311 - DNA, 20 bp, Artificial
  CRISPR gRNA sequence
tctggctctatcacccaggc

SEQ ID NO: 7312 - DNA, 20 bp, Artificial
  CRISPR gRNA sequence
tggctctatcacccaggctg

SEQ ID NO: 7313 - DNA, 20 bp, Artificial
  CRISPR gRNA sequence
ctatcacccaggctggagtg

SEQ ID NO: 7314 - DNA, 20 bp, Artificial
  CRISPR gRNA sequence
tcacccaggctggagtgcag

SEQ ID NO: 7315 - DNA, 20 bp, Artificial
  CRISPR gRNA sequence
ggagtgcagtggtgcaatct

SEQ ID NO: 7316 - DNA, 20 bp, Artificial
  CRISPR gRNA sequence
ggtgcaatctcagttcactg

SEQ ID NO: 7317 - DNA, 20 bp, Artificial
  CRISPR gRNA sequence
ctgcagccttgacacctccc

SEQ ID NO: 7318 - DNA, 20 bp, Artificial
  CRISPR gRNA sequence
tgcagccttgacacctcccc

SEQ ID NO: 7319 - DNA, 20 bp, Artificial
  CRISPR gRNA sequence
cttgacacctccccaggctc

SEQ ID NO: 7320 - DNA, 20 bp, Artificial
  CRISPR gRNA sequence
ctcaagctatcctcccacct

SEQ ID NO: 7321 - DNA, 20 bp, Artificial
  CRISPR gRNA sequence
tcctcccacctcagcctcct

SEQ ID NO: 7322 - DNA, 20 bp, Artificial
  CRISPR gRNA sequence
tcccacctcagcctcctgag

SEQ ID NO: 7323 - DNA, 20 bp, Artificial
  CRISPR gRNA sequence
acctcagcctcctgagtagc

SEQ ID NO: 7324 - DNA, 20 bp, Artificial
  CRISPR gRNA sequence
ctcctgagtagctggttcta

SEQ ID NO: 7325 - DNA, 20 bp, Artificial
  CRISPR gRNA sequence
cagatgcacatcaccacgcc

SEQ ID NO: 7326 - DNA, 20 bp, Artificial
  CRISPR gRNA sequence
gcacatcaccacgcccagct

SEQ ID NO: 7327 - DNA, 20 bp, Artificial
  CRISPR gRNA sequence
gctaagttttgtgttatttg

SEQ ID NO: 7328 - DNA, 20 bp, Artificial
  CRISPR gRNA sequence
taagttttgtgttatttgta

SEQ ID NO: 7329 - DNA, 20 bp, Artificial
  CRISPR gRNA sequence
ttttgtgttatttgtagaga

SEQ ID NO: 7330 - DNA, 20 bp, Artificial
  CRISPR gRNA sequence
tttgtgttatttgtagagat

SEQ ID NO: 7331 - DNA, 20 bp, Artificial
  CRISPR gRNA sequence
ttgtgttatttgtagagata

SEQ ID NO: 7332 - DNA, 20 bp, Artificial
  CRISPR gRNA sequence
tagggcttcaccatgttgcc

SEQ ID NO: 7333 - DNA, 20 bp, Artificial
  CRISPR gRNA sequence
agggcttcaccatgttgccc

SEQ ID NO: 7334 - DNA, 20 bp, Artificial
  CRISPR gRNA sequence
cttcaccatgttgcccaggc

SEQ ID NO: 7335 - DNA, 20 bp, Artificial
  CRISPR gRNA sequence
ccaggctggtctcaaactcc

SEQ ID NO: 7336 - DNA, 20 bp, Artificial
  CRISPR gRNA sequence
tggtctcaaactcctggact

SEQ ID NO: 7337 - DNA, 20 bp, Artificial
  CRISPR gRNA sequence
ggtctcaaactcctggactg

SEQ ID NO: 7338 - DNA, 20 bp, Artificial
  CRISPR gRNA sequence
ctgaggtgatactcctgcct

SEQ ID NO: 7339 - DNA, 20 bp, Artificial
  CRISPR gRNA sequence
actcctgccttggactccca

SEQ ID NO: 7340 - DNA, 20 bp, Artificial
  CRISPR gRNA sequence
gccttggactcccaaagtgc

SEQ ID NO: 7341 - DNA, 20 bp, Artificial
  CRISPR gRNA sequence
ccaaagtgctggaatttcta

SEQ ID NO: 7342 - DNA, 20 bp, Artificial
  CRISPR gRNA sequence
gctggaatttctacagatgt

SEQ ID NO: 7343 - DNA, 20 bp, Artificial
  CRISPR gRNA sequence
cagatgtgagccaccatgcc

SEQ ID NO: 7344 - DNA, 20 bp, Artificial
  CRISPR gRNA sequence
gagccaccatgcccggccta

SEQ ID NO: 7345 - DNA, 20 bp, Artificial
  CRISPR gRNA sequence
agccaccatgcccggcctat

SEQ ID NO: 7346 - DNA, 20 bp, Artificial
  CRISPR gRNA sequence
gccaccatgcccggcctatg

SEQ ID NO: 7347 - DNA, 20 bp, Artificial
  CRISPR gRNA sequence
gggcccttcttgttcctatg

SEQ ID NO: 7348 - DNA, 20 bp, Artificial
  CRISPR gRNA sequence
tcttgttcctatgaagtctg

SEQ ID NO: 7349 - DNA, 20 bp, Artificial
  CRISPR gRNA sequence
cttgttcctatgaagtctgc

SEQ ID NO: 7350 - DNA, 20 bp, Artificial
  CRISPR gRNA sequence
ttgttcctatgaagtctgca

SEQ ID NO: 7351 - DNA, 20 bp, Artificial
  CRISPR gRNA sequence
tgcagggtccccttatgcaa

SEQ ID NO: 7352 - DNA, 20 bp, Artificial
  CRISPR gRNA sequence
ggtccccttatgcaaaagaa

SEQ ID NO: 7353 - DNA, 20 bp, Artificial
  CRISPR gRNA sequence
cccttatgcaaaagaacaga

SEQ ID NO: 7354 - DNA, 20 bp, Artificial
  CRISPR gRNA sequence
atgcaaaagaacagaaagct

SEQ ID NO: 7355 - DNA, 20 bp, Artificial
  CRISPR gRNA sequence
acagaaagctcggcttcaca

SEQ ID NO: 7356 - DNA, 20 bp, Artificial
  CRISPR gRNA sequence
ggcttcacaaagtttgacct

SEQ ID NO: 7357 - DNA, 20 bp, Artificial
  CRISPR gRNA sequence
ttcacaaagtttgacctcgg

SEQ ID NO: 7358 - DNA, 20 bp, Artificial
  CRISPR gRNA sequence
aagtttgacctcggaagaaa

SEQ ID NO: 7359 - DNA, 20 bp, Artificial
  CRISPR gRNA sequence
tttgacctcggaagaaatgg

SEQ ID NO: 7360 - DNA, 20 bp, Artificial
  CRISPR gRNA sequence
ttgacctcggaagaaatgga

SEQ ID NO: 7361 - DNA, 20 bp, Artificial
  CRISPR gRNA sequence
tgacctcggaagaaatggaa

SEQ ID NO: 7362 - DNA, 20 bp, Artificial
  CRISPR gRNA sequence
ctcggaagaaatggaaggga

SEQ ID NO: 7363 - DNA, 20 bp, Artificial
  CRISPR gRNA sequence
tcggaagaaatggaagggaa

SEQ ID NO: 7364 - DNA, 20 bp, Artificial
  CRISPR gRNA sequence
cggaagaaatggaagggaaa

SEQ ID NO: 7365 - DNA, 20 bp, Artificial
  CRISPR gRNA sequence
tttgtcactctcacaaacgt

SEQ ID NO: 7366 - DNA, 20 bp, Artificial
  CRISPR gRNA sequence
gtcactctcacaaacgtaag

SEQ ID NO: 7367 - DNA, 20 bp, Artificial
  CRISPR gRNA sequence
aagaagcaaactaataatga

SEQ ID NO: 7368 - DNA, 20 bp, Artificial
  CRISPR gRNA sequence
cacatattatactcaccatg

SEQ ID NO: 7369 - DNA, 20 bp, Artificial
  CRISPR gRNA sequence
atattatactcaccatgtag

SEQ ID NO: 7370 - DNA, 20 bp, Artificial
  CRISPR gRNA sequence
gccttaaacttctgttcatt

SEQ ID NO: 7371 - DNA, 20 bp, Artificial
  CRISPR gRNA sequence
attcagcacttactgattgc

SEQ ID NO: 7372 - DNA, 20 bp, Artificial
  CRISPR gRNA sequence
tgattgccagtcccattgct

SEQ ID NO: 7373 - DNA, 20 bp, Artificial
  CRISPR gRNA sequence
gattgccagtcccattgcta

SEQ ID NO: 7374 - DNA, 20 bp, Artificial
  CRISPR gRNA sequence
attgccagtcccattgctaa

SEQ ID NO: 7375 - DNA, 20 bp, Artificial
  CRISPR gRNA sequence
ttaactcccctaatccttgt

SEQ ID NO: 7376 - DNA, 20 bp, Artificial
  CRISPR gRNA sequence
caattattattcgcatttta

SEQ ID NO: 7377 - DNA, 20 bp, Artificial
  CRISPR gRNA sequence
ttattcgcattttatagata

SEQ ID NO: 7378 - DNA, 20 bp, Artificial
  CRISPR gRNA sequence
attttatagatatggaaact

SEQ ID NO: 7379 - DNA, 20 bp, Artificial
  CRISPR gRNA sequence
ttttatagatatggaaactg

SEQ ID NO: 7380 - DNA, 20 bp, Artificial
  CRISPR gRNA sequence
gatatggaaactgaggctcc

SEQ ID NO: 7381 - DNA, 20 bp, Artificial
  CRISPR gRNA sequence
atggaaactgaggctccaag

SEQ ID NO: 7382 - DNA, 20 bp, Artificial
  CRISPR gRNA sequence
gtttaaaaaatgaacttgcc

SEQ ID NO: 7383 - DNA, 20 bp, Artificial
  CRISPR gRNA sequence
tttaaaaaatgaacttgccc

SEQ ID NO: 7384 - DNA, 20 bp, Artificial
  CRISPR gRNA sequence
aaatgaacttgcccaggtta

SEQ ID NO: 7385 - DNA, 20 bp, Artificial
  CRISPR gRNA sequence
ttgcccaggttacagtgtgt

SEQ ID NO: 7386 - DNA, 20 bp, Artificial
  CRISPR gRNA sequence
cccaggttacagtgtgttgg

SEQ ID NO: 7387 - DNA, 20 bp, Artificial
  CRISPR gRNA sequence
ccaggttacagtgtgttggt

SEQ ID NO: 7388 - DNA, 20 bp, Artificial
  CRISPR gRNA sequence
ggttacagtgtgttggtagg

SEQ ID NO: 7389 - DNA, 20 bp, Artificial
  CRISPR gRNA sequence
gttacagtgtgttggtaggt

SEQ ID NO: 7390 - DNA, 20 bp, Artificial
  CRISPR gRNA sequence
ttacagtgtgttggtaggta

SEQ ID NO: 7391 - DNA, 20 bp, Artificial
  CRISPR gRNA sequence
tacagtgtgttggtaggtag

SEQ ID NO: 7392 - DNA, 20 bp, Artificial
  CRISPR gRNA sequence
agtgtgttggtaggtagggg

SEQ ID NO: 7393 - DNA, 20 bp, Artificial
  CRISPR gRNA sequence
ggtaggtaggggtagtctca

SEQ ID NO: 7394 - DNA, 20 bp, Artificial
  CRISPR gRNA sequence
ggtaggggtagtctcaaagt

SEQ ID NO: 7395 - DNA, 20 bp, Artificial
  CRISPR gRNA sequence
agttggtaaattttacgcca

SEQ ID NO: 7396 - DNA, 20 bp, Artificial
  CRISPR gRNA sequence
tgactgtgtgcttaaccaca

SEQ ID NO: 7397 - DNA, 20 bp, Artificial
  CRISPR gRNA sequence
ctgtgtgcttaaccacacag

SEQ ID NO: 7398 - DNA, 20 bp, Artificial
  CRISPR gRNA sequence
aaccacacagcagtgtcatc

SEQ ID NO: 7399 - DNA, 20 bp, Artificial
  CRISPR gRNA sequence
ccacacagcagtgtcatcca

SEQ ID NO: 7400 - DNA, 20 bp, Artificial
  CRISPR gRNA sequence
gcagtgtcatccagagtttg

SEQ ID NO: 7401 - DNA, 20 bp, Artificial
  CRISPR gRNA sequence
gtgtcatccagagtttgaag

SEQ ID NO: 7402 - DNA, 20 bp, Artificial
  CRISPR gRNA sequence
gtcatccagagtttgaagca

SEQ ID NO: 7403 - DNA, 20 bp, Artificial
  CRISPR gRNA sequence
ttgaagcagagctcatcaat

SEQ ID NO: 7404 - DNA, 20 bp, Artificial
  CRISPR gRNA sequence
aagcagagctcatcaataag

SEQ ID NO: 7405 - DNA, 20 bp, Artificial
  CRISPR gRNA sequence
agcagagctcatcaataagt

SEQ ID NO: 7406 - DNA, 20 bp, Artificial
  CRISPR gRNA sequence
gcagagctcatcaataagtg

SEQ ID NO: 7407 - DNA, 20 bp, Artificial
  CRISPR gRNA sequence
cagagctcatcaataagtgg

SEQ ID NO: 7408 - DNA, 20 bp, Artificial
  CRISPR gRNA sequence
agctcatcaataagtggggg

SEQ ID NO: 7409 - DNA, 20 bp, Artificial
  CRISPR gRNA sequence
gctcatcaataagtgggggt

SEQ ID NO: 7410 - DNA, 20 bp, Artificial
  CRISPR gRNA sequence
gggggtgggctaaatgtctc

SEQ ID NO: 7411 - DNA, 20 bp, Artificial
  CRISPR gRNA sequence
ggggtgggctaaatgtctcc

SEQ ID NO: 7412 - DNA, 20 bp, Artificial
  CRISPR gRNA sequence
tgtctccaggctcctccctg

SEQ ID NO: 7413 - DNA, 20 bp, Artificial
  CRISPR gRNA sequence
ccacctgtgtctctatgctt

SEQ ID NO: 7414 - DNA, 20 bp, Artificial
  CRISPR gRNA sequence
tgtgtctctatgcttgagcc

SEQ ID NO: 7415 - DNA, 20 bp, Artificial
  CRISPR gRNA sequence
tctctatgcttgagcccaga

SEQ ID NO: 7416 - DNA, 20 bp, Artificial
  CRISPR gRNA sequence
ctctatgcttgagcccagac

SEQ ID NO: 7417 - DNA, 20 bp, Artificial
  CRISPR gRNA sequence
tgcttgagcccagacaggac

SEQ ID NO: 7418 - DNA, 20 bp, Artificial
  CRISPR gRNA sequence
gcttgagcccagacaggaca

SEQ ID NO: 7419 - DNA, 20 bp, Artificial
  CRISPR gRNA sequence
cttgagcccagacaggacaa

SEQ ID NO: 7420 - DNA, 20 bp, Artificial
  CRISPR gRNA sequence
gacaagggtgatcatttcat

SEQ ID NO: 7421 - DNA, 20 bp, Artificial
  CRISPR gRNA sequence
acaagggtgatcatttcatt

SEQ ID NO: 7422 - DNA, 20 bp, Artificial
  CRISPR gRNA sequence
ttcattgggaacattttgac

SEQ ID NO: 7423 - DNA, 20 bp, Artificial
  CRISPR gRNA sequence
tcattgggaacattttgact

SEQ ID NO: 7424 - DNA, 20 bp, Artificial
  CRISPR gRNA sequence
cattgggaacattttgactg

SEQ ID NO: 7425 - DNA, 20 bp, Artificial
  CRISPR gRNA sequence
attgggaacattttgactgg

SEQ ID NO: 7426 - DNA, 20 bp, Artificial
  CRISPR gRNA sequence
ttgggaacattttgactggg

SEQ ID NO: 7427 - DNA, 20 bp, Artificial
  CRISPR gRNA sequence
gaacattttgactgggggga

SEQ ID NO: 7428 - DNA, 20 bp, Artificial
  CRISPR gRNA sequence
acattttgactggggggaaa

SEQ ID NO: 7429 - DNA, 20 bp, Artificial
  CRISPR gRNA sequence
tgactggggggaaagagcac

SEQ ID NO: 7430 - DNA, 20 bp, Artificial
  CRISPR gRNA sequence
ggggggaaagagcaccagcc

SEQ ID NO: 7431 - DNA, 20 bp, Artificial
  CRISPR gRNA sequence
gggggaaagagcaccagcct

SEQ ID NO: 7432 - DNA, 20 bp, Artificial
  CRISPR gRNA sequence
gggaaagagcaccagcctgg

SEQ ID NO: 7433 - DNA, 20 bp, Artificial
  CRISPR gRNA sequence
gagcaccagcctgggagtct

SEQ ID NO: 7434 - DNA, 20 bp, Artificial
  CRISPR gRNA sequence
caccagcctgggagtcttgg

SEQ ID NO: 7435 - DNA, 20 bp, Artificial
  CRISPR gRNA sequence
accagcctgggagtcttggc

SEQ ID NO: 7436 - DNA, 20 bp, Artificial
  CRISPR gRNA sequence
ccagcctgggagtcttggca

SEQ ID NO: 7437 - DNA, 20 bp, Artificial
  CRISPR gRNA sequence
cagcctgggagtcttggcag

SEQ ID NO: 7438 - DNA, 20 bp, Artificial
  CRISPR gRNA sequence
agcctgggagtcttggcagg

SEQ ID NO: 7439 - DNA, 20 bp, Artificial
  CRISPR gRNA sequence
cctgggagtcttggcagggg

SEQ ID NO: 7440 - DNA, 20 bp, Artificial
  CRISPR gRNA sequence
gggagtcttggcagggggag

SEQ ID NO: 7441 - DNA, 20 bp, Artificial
  CRISPR gRNA sequence
ggagtcttggcagggggagt

SEQ ID NO: 7442 - DNA, 20 bp, Artificial
  CRISPR gRNA sequence
gagtcttggcagggggagtg

SEQ ID NO: 7443 - DNA, 20 bp, Artificial
  CRISPR gRNA sequence
agtcttggcagggggagtgg

SEQ ID NO: 7444 - DNA, 20 bp, Artificial
  CRISPR gRNA sequence
tcttggcagggggagtgggg

SEQ ID NO: 7445 - DNA, 20 bp, Artificial
  CRISPR gRNA sequence
tggcagggggagtgggggag

SEQ ID NO: 7446 - DNA, 20 bp, Artificial
  CRISPR gRNA sequence
ggcagggggagtgggggaga

SEQ ID NO: 7447 - DNA, 20 bp, Artificial
  CRISPR gRNA sequence
gcagggggagtgggggagaa

SEQ ID NO: 7448 - DNA, 20 bp, Artificial
  CRISPR gRNA sequence
cagggggagtgggggagaag

SEQ ID NO: 7449 - DNA, 20 bp, Artificial
  CRISPR gRNA sequence
ggggagtgggggagaagggg

SEQ ID NO: 7450 - DNA, 20 bp, Artificial
  CRISPR gRNA sequence
gggagtgggggagaaggggc

SEQ ID NO: 7451 - DNA, 20 bp, Artificial
  CRISPR gRNA sequence
ggagtgggggagaaggggca

SEQ ID NO: 7452 - DNA, 20 bp, Artificial
  CRISPR gRNA sequence
gagtgggggagaaggggcag

SEQ ID NO: 7453 - DNA, 20 bp, Artificial
  CRISPR gRNA sequence
tgggggagaaggggcagggg

SEQ ID NO: 7454 - DNA, 20 bp, Artificial
  CRISPR gRNA sequence
ggggcaggggcagccaccga

SEQ ID NO: 7455 - DNA, 20 bp, Artificial
  CRISPR gRNA sequence
gggcaggggcagccaccgac

SEQ ID NO: 7456 - DNA, 20 bp, Artificial
  CRISPR gRNA sequence
ggcagccaccgacaggctat

SEQ ID NO: 7457 - DNA, 20 bp, Artificial
  CRISPR gRNA sequence
gcagccaccgacaggctatg

SEQ ID NO: 7458 - DNA, 20 bp, Artificial
  CRISPR gRNA sequence
caggctatgaggtcttgtgc

SEQ ID NO: 7459 - DNA, 20 bp, Artificial
  CRISPR gRNA sequence
tgtgcaagtcacgtccttcc

SEQ ID NO: 7460 - DNA, 20 bp, Artificial
  CRISPR gRNA sequence
gtgcaagtcacgtccttccc

SEQ ID NO: 7461 - DNA, 20 bp, Artificial
  CRISPR gRNA sequence
tgcaagtcacgtccttcccg

SEQ ID NO: 7462 - DNA, 20 bp, Artificial
  CRISPR gRNA sequence
tcacgtccttcccggggtct

SEQ ID NO: 7463 - DNA, 20 bp, Artificial
  CRISPR gRNA sequence
ggtctcagtcttgtcatctg

SEQ ID NO: 7464 - DNA, 20 bp, Artificial
  CRISPR gRNA sequence
tctcagtcttgtcatctgca

SEQ ID NO: 7465 - DNA, 20 bp, Artificial
  CRISPR gRNA sequence
gtcttgtcatctgcagagtg

SEQ ID NO: 7466 - DNA, 20 bp, Artificial
  CRISPR gRNA sequence
tcttgtcatctgcagagtga

SEQ ID NO: 7467 - DNA, 20 bp, Artificial
  CRISPR gRNA sequence
gtcatctgcagagtgaagga

SEQ ID NO: 7468 - DNA, 20 bp, Artificial
  CRISPR gRNA sequence
catctgcagagtgaaggaaa

SEQ ID NO: 7469 - DNA, 20 bp, Artificial
  CRISPR gRNA sequence
atctgcagagtgaaggaaag

SEQ ID NO: 7470 - DNA, 20 bp, Artificial
  CRISPR gRNA sequence
cagagtgaaggaaagaggtc

SEQ ID NO: 7471 - DNA, 20 bp, Artificial
  CRISPR gRNA sequence
aaggaaagaggtcaagcttg

SEQ ID NO: 7472 - DNA, 20 bp, Artificial
  CRISPR gRNA sequence
aggaaagaggtcaagcttga

SEQ ID NO: 7473 - DNA, 20 bp, Artificial
  CRISPR gRNA sequence
aggtcaagcttgaaggtccc

SEQ ID NO: 7474 - DNA, 20 bp, Artificial
  CRISPR gRNA sequence
tcaagcttgaaggtccctgg

SEQ ID NO: 7475 - DNA, 20 bp, Artificial
  CRISPR gRNA sequence
tggcagacccaatgccctgt

SEQ ID NO: 7476 - DNA, 20 bp, Artificial
  CRISPR gRNA sequence
caatgccctgtgagaaaact

SEQ ID NO: 7477 - DNA, 20 bp, Artificial
  CRISPR gRNA sequence
ccctgtgagaaaactgagtt

SEQ ID NO: 7478 - DNA, 20 bp, Artificial
  CRISPR gRNA sequence
cctgtgagaaaactgagttt

SEQ ID NO: 7479 - DNA, 20 bp, Artificial
  CRISPR gRNA sequence
ttgggtaacttattatttta

SEQ ID NO: 7480 - DNA, 20 bp, Artificial
  CRISPR gRNA sequence
aacttattattttatagata

SEQ ID NO: 7481 - DNA, 20 bp, Artificial
  CRISPR gRNA sequence
atagatatggaattatctta

SEQ ID NO: 7482 - DNA, 20 bp, Artificial
  CRISPR gRNA sequence
attatcttatagaaatgtta

SEQ ID NO: 7483 - DNA, 20 bp, Artificial
  CRISPR gRNA sequence
ttatagaaatgttatagata

SEQ ID NO: 7484 - DNA, 20 bp, Artificial
  CRISPR gRNA sequence
atagatatggaatcatttta

SEQ ID NO: 7485 - DNA, 20 bp, Artificial
  CRISPR gRNA sequence
atggaatcattttatagata

SEQ ID NO: 7486 - DNA, 20 bp, Artificial
  CRISPR gRNA sequence
cattttatagatatggccca

SEQ ID NO: 7487 - DNA, 20 bp, Artificial
  CRISPR gRNA sequence
tagatatggcccaaagtcca

SEQ ID NO: 7488 - DNA, 20 bp, Artificial
  CRISPR gRNA sequence
aaagtcacacaactcattca

SEQ ID NO: 7489 - DNA, 20 bp, Artificial
  CRISPR gRNA sequence
agtcacacaactcattcacg

SEQ ID NO: 7490 - DNA, 20 bp, Artificial
  CRISPR gRNA sequence
caactcattcacggagttgc

SEQ ID NO: 7491 - DNA, 20 bp, Artificial
  CRISPR gRNA sequence
aactcattcacggagttgct

SEQ ID NO: 7492 - DNA, 20 bp, Artificial
  CRISPR gRNA sequence
attcacggagttgctaggat

SEQ ID NO: 7493 - DNA, 20 bp, Artificial
  CRISPR gRNA sequence
cggagttgctaggatcagtc

SEQ ID NO: 7494 - DNA, 20 bp, Artificial
  CRISPR gRNA sequence
gagttgctaggatcagtctg

SEQ ID NO: 7495 - DNA, 20 bp, Artificial
  CRISPR gRNA sequence
cagtctggagctcttgtcac

SEQ ID NO: 7496 - DNA, 20 bp, Artificial
  CRISPR gRNA sequence
cacgagatcacactgcctca

SEQ ID NO: 7497 - DNA, 20 bp, Artificial
  CRISPR gRNA sequence
cgagatcacactgcctcaaa

SEQ ID NO: 7498 - DNA, 20 bp, Artificial
  CRISPR gRNA sequence
gagatcacactgcctcaaag

SEQ ID NO: 7499 - DNA, 20 bp, Artificial
  CRISPR gRNA sequence
gatcacactgcctcaaagag

SEQ ID NO: 7500 - DNA, 20 bp, Artificial
  CRISPR gRNA sequence
atcacactgcctcaaagagg

SEQ ID NO: 7501 - DNA, 20 bp, Artificial
  CRISPR gRNA sequence
acactgcctcaaagaggagg

SEQ ID NO: 7502 - DNA, 20 bp, Artificial
  CRISPR gRNA sequence
ggaggcagattgctgcaatg

SEQ ID NO: 7503 - DNA, 20 bp, Artificial
  CRISPR gRNA sequence
gaggcagattgctgcaatgt

SEQ ID NO: 7504 - DNA, 20 bp, Artificial
  CRISPR gRNA sequence
tgcaatgtaggttcttaata

SEQ ID NO: 7505 - DNA, 20 bp, Artificial
  CRISPR gRNA sequence
caatgtaggttcttaataaa

SEQ ID NO: 7506 - DNA, 20 bp, Artificial
  CRISPR gRNA sequence
taggttcttaataaagagca

SEQ ID NO: 7507 - DNA, 20 bp, Artificial
  CRISPR gRNA sequence
aggttcttaataaagagcat

SEQ ID NO: 7508 - DNA, 20 bp, Artificial
  CRISPR gRNA sequence
ttcttaataaagagcatggg

SEQ ID NO: 7509 - DNA, 20 bp, Artificial
  CRISPR gRNA sequence
aataaagagcatgggtggaa

SEQ ID NO: 7510 - DNA, 20 bp, Artificial
  CRISPR gRNA sequence
ataaagagcatgggtggaat

SEQ ID NO: 7511 - DNA, 20 bp, Artificial
  CRISPR gRNA sequence
aaagagcatgggtggaatgg

SEQ ID NO: 7512 - DNA, 20 bp, Artificial
  CRISPR gRNA sequence
aagagcatgggtggaatggg

SEQ ID NO: 7513 - DNA, 20 bp, Artificial
  CRISPR gRNA sequence
agcatgggtggaatgggagg

SEQ ID NO: 7514 - DNA, 20 bp, Artificial
  CRISPR gRNA sequence
gcatgggtggaatgggaggc

SEQ ID NO: 7515 - DNA, 20 bp, Artificial
  CRISPR gRNA sequence
gtggaatgggaggcgggcat

SEQ ID NO: 7516 - DNA, 20 bp, Artificial
  CRISPR gRNA sequence
tggaatgggaggcgggcatc

SEQ ID NO: 7517 - DNA, 20 bp, Artificial
  CRISPR gRNA sequence
aatgggaggcgggcatcagg

SEQ ID NO: 7518 - DNA, 20 bp, Artificial
  CRISPR gRNA sequence
atgggaggcgggcatcaggc

SEQ ID NO: 7519 - DNA, 20 bp, Artificial
  CRISPR gRNA sequence
gggaggcgggcatcaggcag

SEQ ID NO: 7520 - DNA, 20 bp, Artificial
  CRISPR gRNA sequence
ggcgggcatcaggcaggagc

SEQ ID NO: 7521 - DNA, 20 bp, Artificial
  CRISPR gRNA sequence
gcgggcatcaggcaggagct

SEQ ID NO: 7522 - DNA, 20 bp, Artificial
  CRISPR gRNA sequence
cgggcatcaggcaggagctg

SEQ ID NO: 7523 - DNA, 20 bp, Artificial
  CRISPR gRNA sequence
atcaggcaggagctggggca

SEQ ID NO: 7524 - DNA, 20 bp, Artificial
  CRISPR gRNA sequence
tcaggcaggagctggggcaa

SEQ ID NO: 7525 - DNA, 20 bp, Artificial
  CRISPR gRNA sequence
gtgtcttttctcactgctct

SEQ ID NO: 7526 - DNA, 20 bp, Artificial
  CRISPR gRNA sequence
gtcttttctcactgctctga

SEQ ID NO: 7527 - DNA, 20 bp, Artificial
  CRISPR gRNA sequence
ttctcactgctctgagagaa

SEQ ID NO: 7528 - DNA, 20 bp, Artificial
  CRISPR gRNA sequence
ttgtgcctgtgtccctgacc

SEQ ID NO: 7529 - DNA, 20 bp, Artificial
  CRISPR gRNA sequence
tgtgcctgtgtccctgacca

SEQ ID NO: 7530 - DNA, 20 bp, Artificial
  CRISPR gRNA sequence
gtgcctgtgtccctgaccaa

SEQ ID NO: 7531 - DNA, 20 bp, Artificial
  CRISPR gRNA sequence
tgcctgtgtccctgaccaag

SEQ ID NO: 7532 - DNA, 20 bp, Artificial
  CRISPR gRNA sequence
tgtgtccctgaccaaggggc

SEQ ID NO: 7533 - DNA, 20 bp, Artificial
  CRISPR gRNA sequence
gtgtccctgaccaaggggct

SEQ ID NO: 7534 - DNA, 20 bp, Artificial
  CRISPR gRNA sequence
gtccctgaccaaggggctgg

SEQ ID NO: 7535 - DNA, 20 bp, Artificial
  CRISPR gRNA sequence
ccctgaccaaggggctggga

SEQ ID NO: 7536 - DNA, 20 bp, Artificial
  CRISPR gRNA sequence
cctgaccaaggggctgggag

SEQ ID NO: 7537 - DNA, 20 bp, Artificial
  CRISPR gRNA sequence
gaccaaggggctgggagagg

SEQ ID NO: 7538 - DNA, 20 bp, Artificial
  CRISPR gRNA sequence
ccaaggggctgggagaggtg

SEQ ID NO: 7539 - DNA, 20 bp, Artificial
  CRISPR gRNA sequence
tctcacccccaaccatctcc

SEQ ID NO: 7540 - DNA, 20 bp, Artificial
  CRISPR gRNA sequence
ccccaaccatctcccagctt

SEQ ID NO: 7541 - DNA, 20 bp, Artificial
  CRISPR gRNA sequence
tcccagctttggccctgctc

SEQ ID NO: 7542 - DNA, 20 bp, Artificial
  CRISPR gRNA sequence
cccagctttggccctgctcc

SEQ ID NO: 7543 - DNA, 20 bp, Artificial
  CRISPR gRNA sequence
ctttggccctgctccaggaa

SEQ ID NO: 7544 - DNA, 20 bp, Artificial
  CRISPR gRNA sequence
tttggccctgctccaggaaa

SEQ ID NO: 7545 - DNA, 20 bp, Artificial
  CRISPR gRNA sequence
ttggccctgctccaggaaaa

SEQ ID NO: 7546 - DNA, 20 bp, Artificial
  CRISPR gRNA sequence
gccctgctccaggaaaaggg

SEQ ID NO: 7547 - DNA, 20 bp, Artificial
  CRISPR gRNA sequence
ctgctccaggaaaagggcgg

SEQ ID NO: 7548 - DNA, 20 bp, Artificial
  CRISPR gRNA sequence
agggcggtggccccatcttt

SEQ ID NO: 7549 - DNA, 20 bp, Artificial
  CRISPR gRNA sequence
tctttcagttctgcttcctc

SEQ ID NO: 7550 - DNA, 20 bp, Artificial
  CRISPR gRNA sequence
agttctgcttcctctagtca

SEQ ID NO: 7551 - DNA, 20 bp, Artificial
  CRISPR gRNA sequence
ctgcttcctctagtcatggt

SEQ ID NO: 7552 - DNA, 20 bp, Artificial
  CRISPR gRNA sequence
ttcctctagtcatggttggc

SEQ ID NO: 7553 - DNA, 20 bp, Artificial
  CRISPR gRNA sequence
tcctctagtcatggttggct

SEQ ID NO: 7554 - DNA, 20 bp, Artificial
  CRISPR gRNA sequence
gttggctgggatctcgctgc

SEQ ID NO: 7555 - DNA, 20 bp, Artificial
  CRISPR gRNA sequence
gctgggatctcgctgcaagc

SEQ ID NO: 7556 - DNA, 20 bp, Artificial
  CRISPR gRNA sequence
cgctgcaagccggttatgtt

SEQ ID NO: 7557 - DNA, 20 bp, Artificial
  CRISPR gRNA sequence
gctgcaagccggttatgttt

SEQ ID NO: 7558 - DNA, 20 bp, Artificial
  CRISPR gRNA sequence
cggttatgtttgggttcctg

SEQ ID NO: 7559 - DNA, 20 bp, Artificial
  CRISPR gRNA sequence
cccgctcaaccgtcatgaac

SEQ ID NO: 7560 - DNA, 20 bp, Artificial
  CRISPR gRNA sequence
gctcaaccgtcatgaacaag

SEQ ID NO: 7561 - DNA, 20 bp, Artificial
  CRISPR gRNA sequence
ctcaaccgtcatgaacaagt

SEQ ID NO: 7562 - DNA, 20 bp, Artificial
  CRISPR gRNA sequence
ccgtcatgaacaagtgggcc

SEQ ID NO: 7563 - DNA, 20 bp, Artificial
  CRISPR gRNA sequence
catgaacaagtgggcccagc

SEQ ID NO: 7564 - DNA, 20 bp, Artificial
  CRISPR gRNA sequence
agtgggcccagccagtgccc

SEQ ID NO: 7565 - DNA, 20 bp, Artificial
  CRISPR gRNA sequence
gcccagccagtgccccagct

SEQ ID NO: 7566 - DNA, 20 bp, Artificial
  CRISPR gRNA sequence
gccagtgccccagcttggac

SEQ ID NO: 7567 - DNA, 20 bp, Artificial
  CRISPR gRNA sequence
gtgccccagcttggactgga

SEQ ID NO: 7568 - DNA, 20 bp, Artificial
  CRISPR gRNA sequence
agatcattctctgtgacatc

SEQ ID NO: 7569 - DNA, 20 bp, Artificial
  CRISPR gRNA sequence
gatcattctctgtgacatcc

SEQ ID NO: 7570 - DNA, 20 bp, Artificial
  CRISPR gRNA sequence
atcattctctgtgacatccg

SEQ ID NO: 7571 - DNA, 20 bp, Artificial
  CRISPR gRNA sequence
tcattctctgtgacatccgg

SEQ ID NO: 7572 - DNA, 20 bp, Artificial
  CRISPR gRNA sequence
gacatccgggggtctgtgct

SEQ ID NO: 7573 - DNA, 20 bp, Artificial
  CRISPR gRNA sequence
gtctgtgctgagcctctccc

SEQ ID NO: 7574 - DNA, 20 bp, Artificial
  CRISPR gRNA sequence
tctgtgctgagcctctcccc

SEQ ID NO: 7575 - DNA, 20 bp, Artificial
  CRISPR gRNA sequence
gtgctgagcctctccccagg

SEQ ID NO: 7576 - DNA, 20 bp, Artificial
  CRISPR gRNA sequence
agcctctccccaggcagtga

SEQ ID NO: 7577 - DNA, 20 bp, Artificial
  CRISPR gRNA sequence
tccccaggcagtgaaagctg

SEQ ID NO: 7578 - DNA, 20 bp, Artificial
  CRISPR gRNA sequence
tgaaagctgtggatgcgtga

SEQ ID NO: 7579 - DNA, 20 bp, Artificial
  CRISPR gRNA sequence
tgtggatgcgtgaaagaaaa

SEQ ID NO: 7580 - DNA, 20 bp, Artificial
  CRISPR gRNA sequence
gtggatgcgtgaaagaaaat

SEQ ID NO: 7581 - DNA, 20 bp, Artificial
  CRISPR gRNA sequence
cgtgaaagaaaatgggtctc

SEQ ID NO: 7582 - DNA, 20 bp, Artificial
  CRISPR gRNA sequence
gtgaaagaaaatgggtctct

SEQ ID NO: 7583 - DNA, 20 bp, Artificial
  CRISPR gRNA sequence
aagaaaatgggtctctgggc

SEQ ID NO: 7584 - DNA, 20 bp, Artificial
  CRISPR gRNA sequence
agaaaatgggtctctgggcc

SEQ ID NO: 7585 - DNA, 20 bp, Artificial
  CRISPR gRNA sequence
atgggtctctgggccgggtg

SEQ ID NO: 7586 - DNA, 20 bp, Artificial
  CRISPR gRNA sequence
ggtctctgggccgggtgtgg

SEQ ID NO: 7587 - DNA, 20 bp, Artificial
  CRISPR gRNA sequence
gtggctcacacctgtaatcc

SEQ ID NO: 7588 - DNA, 20 bp, Artificial
  CRISPR gRNA sequence
cacctgtaatcccagcactt

SEQ ID NO: 7589 - DNA, 20 bp, Artificial
  CRISPR gRNA sequence
acctgtaatcccagcacttt

SEQ ID NO: 7590 - DNA, 20 bp, Artificial
  CRISPR gRNA sequence
ctgtaatcccagcactttgg

SEQ ID NO: 7591 - DNA, 20 bp, Artificial
  CRISPR gRNA sequence
tgtaatcccagcactttggg

SEQ ID NO: 7592 - DNA, 20 bp, Artificial
  CRISPR gRNA sequence
tcccagcactttgggaggcc

SEQ ID NO: 7593 - DNA, 20 bp, Artificial
  CRISPR gRNA sequence
cccagcactttgggaggcca

SEQ ID NO: 7594 - DNA, 20 bp, Artificial
  CRISPR gRNA sequence
agcactttgggaggccaagg

SEQ ID NO: 7595 - DNA, 20 bp, Artificial
  CRISPR gRNA sequence
gcactttgggaggccaaggc

SEQ ID NO: 7596 - DNA, 20 bp, Artificial
  CRISPR gRNA sequence
ctttgggaggccaaggcggg

SEQ ID NO: 7597 - DNA, 20 bp, Artificial
  CRISPR gRNA sequence
ccaaggcgggtggatcacct

SEQ ID NO: 7598 - DNA, 20 bp, Artificial
  CRISPR gRNA sequence
caaggcgggtggatcacctg

SEQ ID NO: 7599 - DNA, 20 bp, Artificial
  CRISPR gRNA sequence
gcgggtggatcacctgaggt

SEQ ID NO: 7600 - DNA, 20 bp, Artificial
  CRISPR gRNA sequence
cgggtggatcacctgaggtc

SEQ ID NO: 7601 - DNA, 20 bp, Artificial
  CRISPR gRNA sequence
ggtggatcacctgaggtcgg

SEQ ID NO: 7602 - DNA, 20 bp, Artificial
  CRISPR gRNA sequence
tgaggtcgggagttcgaaac

SEQ ID NO: 7603 - DNA, 20 bp, Artificial
  CRISPR gRNA sequence
cgaaaccagcctgaccaaca

SEQ ID NO: 7604 - DNA, 20 bp, Artificial
  CRISPR gRNA sequence
tttactaaaaataaaaaaat

SEQ ID NO: 7605 - DNA, 20 bp, Artificial
  CRISPR gRNA sequence
ctaaaaataaaaaaattagc

SEQ ID NO: 7606 - DNA, 20 bp, Artificial
  CRISPR gRNA sequence
taaaaataaaaaaattagcc

SEQ ID NO: 7607 - DNA, 20 bp, Artificial
  CRISPR gRNA sequence
ataaaaaaattagccaggca

SEQ ID NO: 7608 - DNA, 20 bp, Artificial
  CRISPR gRNA sequence
aaaaaattagccaggcatgg

SEQ ID NO: 7609 - DNA, 20 bp, Artificial
  CRISPR gRNA sequence
aaattagccaggcatggtgg

SEQ ID NO: 7610 - DNA, 20 bp, Artificial
  CRISPR gRNA sequence
aattagccaggcatggtggc

SEQ ID NO: 7611 - DNA, 20 bp, Artificial
  CRISPR gRNA sequence
gtggcgggtgcctgtaatgc

SEQ ID NO: 7612 - DNA, 20 bp, Artificial
  CRISPR gRNA sequence
tgcctgtaatgccagctact

SEQ ID NO: 7613 - DNA, 20 bp, Artificial
  CRISPR gRNA sequence
gcctgtaatgccagctactt

SEQ ID NO: 7614 - DNA, 20 bp, Artificial
  CRISPR gRNA sequence
ctgtaatgccagctacttgg

SEQ ID NO: 7615 - DNA, 20 bp, Artificial
  CRISPR gRNA sequence
tgtaatgccagctacttggg

SEQ ID NO: 7616 - DNA, 20 bp, Artificial
  CRISPR gRNA sequence
gccagctacttgggaggttg

SEQ ID NO: 7617 - DNA, 20 bp, Artificial
  CRISPR gRNA sequence
agctacttgggaggttgaag

SEQ ID NO: 7618 - DNA, 20 bp, Artificial
  CRISPR gRNA sequence
gctacttgggaggttgaagc

SEQ ID NO: 7619 - DNA, 20 bp, Artificial
  CRISPR gRNA sequence
tacttgggaggttgaagcag

SEQ ID NO: 7620 - DNA, 20 bp, Artificial
  CRISPR gRNA sequence
gcaggagaattgcttgaatc

SEQ ID NO: 7621 - DNA, 20 bp, Artificial
  CRISPR gRNA sequence
caggagaattgcttgaatcc

SEQ ID NO: 7622 - DNA, 20 bp, Artificial
  CRISPR gRNA sequence
ggagaattgcttgaatccgg

SEQ ID NO: 7623 - DNA, 20 bp, Artificial
  CRISPR gRNA sequence
gagaattgcttgaatccggg

SEQ ID NO: 7624 - DNA, 20 bp, Artificial
  CRISPR gRNA sequence
aattgcttgaatccgggagg

SEQ ID NO: 7625 - DNA, 20 bp, Artificial
  CRISPR gRNA sequence
ttgcttgaatccgggaggca

SEQ ID NO: 7626 - DNA, 20 bp, Artificial
  CRISPR gRNA sequence
tgcttgaatccgggaggcag

SEQ ID NO: 7627 - DNA, 20 bp, Artificial
  CRISPR gRNA sequence
aatccgggaggcagaggttg

SEQ ID NO: 7628 - DNA, 20 bp, Artificial
  CRISPR gRNA sequence
cgggaggcagaggttgcagt

SEQ ID NO: 7629 - DNA, 20 bp, Artificial
  CRISPR gRNA sequence
ggcagaggttgcagtgagcc

SEQ ID NO: 7630 - DNA, 20 bp, Artificial
  CRISPR gRNA sequence
aagattgcaccactgcactc

SEQ ID NO: 7631 - DNA, 20 bp, Artificial
  CRISPR gRNA sequence
tgcaccactgcactccagcc

SEQ ID NO: 7632 - DNA, 20 bp, Artificial
  CRISPR gRNA sequence
gcaccactgcactccagcct

SEQ ID NO: 7633 - DNA, 20 bp, Artificial
  CRISPR gRNA sequence
ctgcactccagcctgggcga

SEQ ID NO: 7634 - DNA, 20 bp, Artificial
  CRISPR gRNA sequence
gcactccagcctgggcgaca

SEQ ID NO: 7635 - DNA, 20 bp, Artificial
  CRISPR gRNA sequence
tccagcctgggcgacagagt

SEQ ID NO: 7636 - DNA, 20 bp, Artificial
  CRISPR gRNA sequence
gactctgtctcaaaaaaaaa

SEQ ID NO: 7637 - DNA, 20 bp, Artificial
  CRISPR gRNA sequence
gtctcaaaaaaaaaaagaaa

SEQ ID NO: 7638 - DNA, 20 bp, Artificial
  CRISPR gRNA sequence
aaaaaaaagaaaaagaaaat

SEQ ID NO: 7639 - DNA, 20 bp, Artificial
  CRISPR gRNA sequence
aagaaaaagaaaatgagtct

SEQ ID NO: 7640 - DNA, 20 bp, Artificial
  CRISPR gRNA sequence
agaaaaagaaaatgagtctc

SEQ ID NO: 7641 - DNA, 20 bp, Artificial
  CRISPR gRNA sequence
aagaaaatgagtctcaggaa

SEQ ID NO: 7642 - DNA, 20 bp, Artificial
  CRISPR gRNA sequence
agaaaatgagtctcaggaat

SEQ ID NO: 7643 - DNA, 20 bp, Artificial
  CRISPR gRNA sequence
gaaaatgagtctcaggaatg

SEQ ID NO: 7644 - DNA, 20 bp, Artificial
  CRISPR gRNA sequence
aatgagtctcaggaatgggg

SEQ ID NO: 7645 - DNA, 20 bp, Artificial
  CRISPR gRNA sequence
agtctcaggaatggggtggc

SEQ ID NO: 7646 - DNA, 20 bp, Artificial
  CRISPR gRNA sequence
caggaatggggtggcaagtt

SEQ ID NO: 7647 - DNA, 20 bp, Artificial
  CRISPR gRNA sequence
ttgagtgtgtgttttctcat

SEQ ID NO: 7648 - DNA, 20 bp, Artificial
  CRISPR gRNA sequence
ctcttcaatgtattctcttc

SEQ ID NO: 7649 - DNA, 20 bp, Artificial
  CRISPR gRNA sequence
tcttcaatgtattctcttct

SEQ ID NO: 7650 - DNA, 20 bp, Artificial
  CRISPR gRNA sequence
aatgtattctcttctgggcc

SEQ ID NO: 7651 - DNA, 20 bp, Artificial
  CRISPR gRNA sequence
attctcttctgggcccagaa

SEQ ID NO: 7652 - DNA, 20 bp, Artificial
  CRISPR gRNA sequence
ttctcttctgggcccagaac

SEQ ID NO: 7653 - DNA, 20 bp, Artificial
  CRISPR gRNA sequence
tctcttctgggcccagaaca

SEQ ID NO: 7654 - DNA, 20 bp, Artificial
  CRISPR gRNA sequence
cttctgggcccagaacaggg

SEQ ID NO: 7655 - DNA, 20 bp, Artificial
  CRISPR gRNA sequence
ctgggcccagaacagggcag

SEQ ID NO: 7656 - DNA, 20 bp, Artificial
  CRISPR gRNA sequence
tgggcccagaacagggcagt

SEQ ID NO: 7657 - DNA, 20 bp, Artificial
  CRISPR gRNA sequence
ggcccagaacagggcagtag

SEQ ID NO: 7658 - DNA, 20 bp, Artificial
  CRISPR gRNA sequence
gggcagtaggagcctccctc

SEQ ID NO: 7659 - DNA, 20 bp, Artificial
  CRISPR gRNA sequence
ggagcctccctctggtcttc

SEQ ID NO: 7660 - DNA, 20 bp, Artificial
  CRISPR gRNA sequence
tccctctggtcttccagctt

SEQ ID NO: 7661 - DNA, 20 bp, Artificial
  CRISPR gRNA sequence
ccctctggtcttccagcttc

SEQ ID NO: 7662 - DNA, 20 bp, Artificial
  CRISPR gRNA sequence
cctctggtcttccagcttca

SEQ ID NO: 7663 - DNA, 20 bp, Artificial
  CRISPR gRNA sequence
tggtcttccagcttcagggc

SEQ ID NO: 7664 - DNA, 20 bp, Artificial
  CRISPR gRNA sequence
agctctcctcttacctcctc

SEQ ID NO: 7665 - DNA, 20 bp, Artificial
  CRISPR gRNA sequence
gctctcctcttacctcctcc

SEQ ID NO: 7666 - DNA, 20 bp, Artificial
  CRISPR gRNA sequence
ctcctcttacctcctccagg

SEQ ID NO: 7667 - DNA, 20 bp, Artificial
  CRISPR gRNA sequence
aagctccctctgtttctttc

SEQ ID NO: 7668 - DNA, 20 bp, Artificial
  CRISPR gRNA sequence
cttcatctgcatgtcatgtg

SEQ ID NO: 7669 - DNA, 20 bp, Artificial
  CRISPR gRNA sequence
catctgcatgtcatgtgtgg

SEQ ID NO: 7670 - DNA, 20 bp, Artificial
  CRISPR gRNA sequence
atctgcatgtcatgtgtggt

SEQ ID NO: 7671 - DNA, 20 bp, Artificial
  CRISPR gRNA sequence
tgtcatgtgtggtgggttga

SEQ ID NO: 7672 - DNA, 20 bp, Artificial
  CRISPR gRNA sequence
gtcatgtgtggtgggttgaa

SEQ ID NO: 7673 - DNA, 20 bp, Artificial
  CRISPR gRNA sequence
atgtgtggtgggttgaaagg

SEQ ID NO: 7674 - DNA, 20 bp, Artificial
  CRISPR gRNA sequence
gttgaaaggtggccccccaa

SEQ ID NO: 7675 - DNA, 20 bp, Artificial
  CRISPR gRNA sequence
atatgtccatgtcaaatccc

SEQ ID NO: 7676 - DNA, 20 bp, Artificial
  CRISPR gRNA sequence
gtcaaatccctggaacctgt

SEQ ID NO: 7677 - DNA, 20 bp, Artificial
  CRISPR gRNA sequence
cctgtcagtgtgactttatt

SEQ ID NO: 7678 - DNA, 20 bp, Artificial
  CRISPR gRNA sequence
ctgtcagtgtgactttattt

SEQ ID NO: 7679 - DNA, 20 bp, Artificial
  CRISPR gRNA sequence
agtgtgactttatttgggaa

SEQ ID NO: 7680 - DNA, 20 bp, Artificial
  CRISPR gRNA sequence
gtgtgactttatttgggaaa

SEQ ID NO: 7681 - DNA, 20 bp, Artificial
  CRISPR gRNA sequence
tgtgactttatttgggaaaa

SEQ ID NO: 7682 - DNA, 20 bp, Artificial
  CRISPR gRNA sequence
atttgggaaaagggtctttg

SEQ ID NO: 7683 - DNA, 20 bp, Artificial
  CRISPR gRNA sequence
gggaaaagggtctttgcaga

SEQ ID NO: 7684 - DNA, 20 bp, Artificial
  CRISPR gRNA sequence
gggtctttgcagatagaatt

SEQ ID NO: 7685 - DNA, 20 bp, Artificial
  CRISPR gRNA sequence
tttgcagatagaattaagtt

SEQ ID NO: 7686 - DNA, 20 bp, Artificial
  CRISPR gRNA sequence
ttgcagatagaattaagtta

SEQ ID NO: 7687 - DNA, 20 bp, Artificial
  CRISPR gRNA sequence
tgcagatagaattaagttaa

SEQ ID NO: 7688 - DNA, 20 bp, Artificial
  CRISPR gRNA sequence
gcagatagaattaagttaag

SEQ ID NO: 7689 - DNA, 20 bp, Artificial
  CRISPR gRNA sequence
atagaattaagttaaggggc

SEQ ID NO: 7690 - DNA, 20 bp, Artificial
  CRISPR gRNA sequence
tagaattaagttaaggggct

SEQ ID NO: 7691 - DNA, 20 bp, Artificial
  CRISPR gRNA sequence
ttaagttaaggggctgggtg

SEQ ID NO: 7692 - DNA, 20 bp, Artificial
  CRISPR gRNA sequence
agttaaggggctgggtgcag

SEQ ID NO: 7693 - DNA, 20 bp, Artificial
  CRISPR gRNA sequence
gtggctcatgcctgtaatcc

SEQ ID NO: 7694 - DNA, 20 bp, Artificial
  CRISPR gRNA sequence
tgcctgtaatcccagcactt

SEQ ID NO: 7695 - DNA, 20 bp, Artificial
  CRISPR gRNA sequence
gcctgtaatcccagcacttt

SEQ ID NO: 7696 - DNA, 20 bp, Artificial
  CRISPR gRNA sequence
tgtaatcccagcactttggg

SEQ ID NO: 7697 - DNA, 20 bp, Artificial
  CRISPR gRNA sequence
tcccagcactttgggaagct

SEQ ID NO: 7698 - DNA, 20 bp, Artificial
  CRISPR gRNA sequence
gcactttgggaagctgagat

SEQ ID NO: 7699 - DNA, 20 bp, Artificial
  CRISPR gRNA sequence
actttgggaagctgagattg

SEQ ID NO: 7700 - DNA, 20 bp, Artificial
  CRISPR gRNA sequence
ctttgggaagctgagattgg

SEQ ID NO: 7701 - DNA, 20 bp, Artificial
  CRISPR gRNA sequence
ctgagattggaggatcacct

SEQ ID NO: 7702 - DNA, 20 bp, Artificial
  CRISPR gRNA sequence
tgagattggaggatcacctg

SEQ ID NO: 7703 - DNA, 20 bp, Artificial
  CRISPR gRNA sequence
attggaggatcacctgaggt

SEQ ID NO: 7704 - DNA, 20 bp, Artificial
  CRISPR gRNA sequence
ttggaggatcacctgaggtc

SEQ ID NO: 7705 - DNA, 20 bp, Artificial
  CRISPR gRNA sequence
ggaggatcacctgaggtcag

SEQ ID NO: 7706 - DNA, 20 bp, Artificial
  CRISPR gRNA sequence
tcacctgaggtcaggagttc

SEQ ID NO: 7707 - DNA, 20 bp, Artificial
  CRISPR gRNA sequence
tgaggtcaggagttcaagac

SEQ ID NO: 7708 - DNA, 20 bp, Artificial
  CRISPR gRNA sequence
tcaggagttcaagaccagcg

SEQ ID NO: 7709 - DNA, 20 bp, Artificial
  CRISPR gRNA sequence
caagaccagcgtggccaaca

SEQ ID NO: 7710 - DNA, 20 bp, Artificial
  CRISPR gRNA sequence
tctactaaaaatacaaaaat

SEQ ID NO: 7711 - DNA, 20 bp, Artificial
  CRISPR gRNA sequence
ctaaaaatacaaaaattagc

SEQ ID NO: 7712 - DNA, 20 bp, Artificial
  CRISPR gRNA sequence
atacaaaaattagctggtca

SEQ ID NO: 7713 - DNA, 20 bp, Artificial
  CRISPR gRNA sequence
caaaaattagctggtcatgg

SEQ ID NO: 7714 - DNA, 20 bp, Artificial
  CRISPR gRNA sequence
aattagctggtcatggtggt

SEQ ID NO: 7715 - DNA, 20 bp, Artificial
  CRISPR gRNA sequence
gtggtgagcacctgtaatcc

SEQ ID NO: 7716 - DNA, 20 bp, Artificial
  CRISPR gRNA sequence
cacctgtaatcccagctact

SEQ ID NO: 7717 - DNA, 20 bp, Artificial
  CRISPR gRNA sequence
acctgtaatcccagctactc

SEQ ID NO: 7718 - DNA, 20 bp, Artificial
  CRISPR gRNA sequence
ctgtaatcccagctactcag

SEQ ID NO: 7719 - DNA, 20 bp, Artificial
  CRISPR gRNA sequence
atcccagctactcaggagac

SEQ ID NO: 7720 - DNA, 20 bp, Artificial
  CRISPR gRNA sequence
tcccagctactcaggagact

SEQ ID NO: 7721 - DNA, 20 bp, Artificial
  CRISPR gRNA sequence
cccagctactcaggagactg

SEQ ID NO: 7722 - DNA, 20 bp, Artificial
  CRISPR gRNA sequence
agctactcaggagactgggg

SEQ ID NO: 7723 - DNA, 20 bp, Artificial
  CRISPR gRNA sequence
gctactcaggagactggggc

SEQ ID NO: 7724 - DNA, 20 bp, Artificial
  CRISPR gRNA sequence
tactcaggagactggggcag

SEQ ID NO: 7725 - DNA, 20 bp, Artificial
  CRISPR gRNA sequence
ggcaggagaatcgcttgaac

SEQ ID NO: 7726 - DNA, 20 bp, Artificial
  CRISPR gRNA sequence
gcaggagaatcgcttgaact

SEQ ID NO: 7727 - DNA, 20 bp, Artificial
  CRISPR gRNA sequence
aggagaatcgcttgaactgg

SEQ ID NO: 7728 - DNA, 20 bp, Artificial
  CRISPR gRNA sequence
ggagaatcgcttgaactggg

SEQ ID NO: 7729 - DNA, 20 bp, Artificial
  CRISPR gRNA sequence
gaatcgcttgaactgggagg

SEQ ID NO: 7730 - DNA, 20 bp, Artificial
  CRISPR gRNA sequence
atcgcttgaactgggaggtg

SEQ ID NO: 7731 - DNA, 20 bp, Artificial
  CRISPR gRNA sequence
tcgcttgaactgggaggtgg

SEQ ID NO: 7732 - DNA, 20 bp, Artificial
  CRISPR gRNA sequence
gaactgggaggtggaggttg

SEQ ID NO: 7733 - DNA, 20 bp, Artificial
  CRISPR gRNA sequence
tgggaggtggaggttgcagt

SEQ ID NO: 7734 - DNA, 20 bp, Artificial
  CRISPR gRNA sequence
gaggttgcagtgagccgata

SEQ ID NO: 7735 - DNA, 20 bp, Artificial
  CRISPR gRNA sequence
gatacagcgccactgcattc

SEQ ID NO: 7736 - DNA, 20 bp, Artificial
  CRISPR gRNA sequence
agcgccactgcattccagcc

SEQ ID NO: 7737 - DNA, 20 bp, Artificial
  CRISPR gRNA sequence
gcgccactgcattccagcct

SEQ ID NO: 7738 - DNA, 20 bp, Artificial
  CRISPR gRNA sequence
ctgcattccagcctgggcaa

SEQ ID NO: 7739 - DNA, 20 bp, Artificial
  CRISPR gRNA sequence
gcattccagcctgggcaaca

SEQ ID NO: 7740 - DNA, 20 bp, Artificial
  CRISPR gRNA sequence
tccagcctgggcaacagagc

SEQ ID NO: 7741 - DNA, 20 bp, Artificial
  CRISPR gRNA sequence
agagcaagcctctgtctcaa

SEQ ID NO: 7742 - DNA, 20 bp, Artificial
  CRISPR gRNA sequence
gcaagcctctgtctcaaaag

SEQ ID NO: 7743 - DNA, 20 bp, Artificial
  CRISPR gRNA sequence
caagcctctgtctcaaaaga

SEQ ID NO: 7744 - DNA, 20 bp, Artificial
  CRISPR gRNA sequence
gtctcaaaagaaggcaaaaa

SEQ ID NO: 7745 - DNA, 20 bp, Artificial
  CRISPR gRNA sequence
agaaggcaaaaaaagaatta

SEQ ID NO: 7746 - DNA, 20 bp, Artificial
  CRISPR gRNA sequence
atcttgaaatgacatcatcc

SEQ ID NO: 7747 - DNA, 20 bp, Artificial
  CRISPR gRNA sequence
tgacatcatcctggattatc

SEQ ID NO: 7748 - DNA, 20 bp, Artificial
  CRISPR gRNA sequence
gacatcatcctggattatct

SEQ ID NO: 7749 - DNA, 20 bp, Artificial
  CRISPR gRNA sequence
atcatcctggattatctagg

SEQ ID NO: 7750 - DNA, 20 bp, Artificial
  CRISPR gRNA sequence
tcatcctggattatctaggt

SEQ ID NO: 7751 - DNA, 20 bp, Artificial
  CRISPR gRNA sequence
tgggtcctaaatccaatgac

SEQ ID NO: 7752 - DNA, 20 bp, Artificial
  CRISPR gRNA sequence
ccaatgacaagtgtctttat

SEQ ID NO: 7753 - DNA, 20 bp, Artificial
  CRISPR gRNA sequence
aatgacaagtgtctttataa

SEQ ID NO: 7754 - DNA, 20 bp, Artificial
  CRISPR gRNA sequence
acaagtgtctttataagaga

SEQ ID NO: 7755 - DNA, 20 bp, Artificial
  CRISPR gRNA sequence
aagtgtctttataagagaaa

SEQ ID NO: 7756 - DNA, 20 bp, Artificial
  CRISPR gRNA sequence
gagaaagagacttgctacat

SEQ ID NO: 7757 - DNA, 20 bp, Artificial
  CRISPR gRNA sequence
agaaagagacttgctacatg

SEQ ID NO: 7758 - DNA, 20 bp, Artificial
  CRISPR gRNA sequence
aaagagacttgctacatgag

SEQ ID NO: 7759 - DNA, 20 bp, Artificial
  CRISPR gRNA sequence
gagacttgctacatgaggag

SEQ ID NO: 7760 - DNA, 20 bp, Artificial
  CRISPR gRNA sequence
agacttgctacatgaggagt

SEQ ID NO: 7761 - DNA, 20 bp, Artificial
  CRISPR gRNA sequence
tacatgaggagtaggtgatg

SEQ ID NO: 7762 - DNA, 20 bp, Artificial
  CRISPR gRNA sequence
agtaggtgatgtggccacta

SEQ ID NO: 7763 - DNA, 20 bp, Artificial
  CRISPR gRNA sequence
gtgatgtggccactaaagct

SEQ ID NO: 7764 - DNA, 20 bp, Artificial
  CRISPR gRNA sequence
gtggccactaaagctgagtt

SEQ ID NO: 7765 - DNA, 20 bp, Artificial
  CRISPR gRNA sequence
ggccactaaagctgagttta

SEQ ID NO: 7766 - DNA, 20 bp, Artificial
  CRISPR gRNA sequence
aagctgagtttagagtgatg

SEQ ID NO: 7767 - DNA, 20 bp, Artificial
  CRISPR gRNA sequence
gtttagagtgatgcagccac

SEQ ID NO: 7768 - DNA, 20 bp, Artificial
  CRISPR gRNA sequence
tgatgcagccacaagaccac

SEQ ID NO: 7769 - DNA, 20 bp, Artificial
  CRISPR gRNA sequence
cagccacaagaccacaagtc

SEQ ID NO: 7770 - DNA, 20 bp, Artificial
  CRISPR gRNA sequence
agccacaagaccacaagtca

SEQ ID NO: 7771 - DNA, 20 bp, Artificial
  CRISPR gRNA sequence
gaccacaagtcaaggatcac

SEQ ID NO: 7772 - DNA, 20 bp, Artificial
  CRISPR gRNA sequence
cacaagtcaaggatcaccag

SEQ ID NO: 7773 - DNA, 20 bp, Artificial
  CRISPR gRNA sequence
caaggatcaccagtagttcc

SEQ ID NO: 7774 - DNA, 20 bp, Artificial
  CRISPR gRNA sequence
ggatcaccagtagttcccag

SEQ ID NO: 7775 - DNA, 20 bp, Artificial
  CRISPR gRNA sequence
caccagtagttcccagcagc

SEQ ID NO: 7776 - DNA, 20 bp, Artificial
  CRISPR gRNA sequence
ccagtagttcccagcagcta

SEQ ID NO: 7777 - DNA, 20 bp, Artificial
  CRISPR gRNA sequence
cagtagttcccagcagctag

SEQ ID NO: 7778 - DNA, 20 bp, Artificial
  CRISPR gRNA sequence
gtagttcccagcagctagag

SEQ ID NO: 7779 - DNA, 20 bp, Artificial
  CRISPR gRNA sequence
tagttcccagcagctagagg

SEQ ID NO: 7780 - DNA, 20 bp, Artificial
  CRISPR gRNA sequence
tcccagcagctagaggaggc

SEQ ID NO: 7781 - DNA, 20 bp, Artificial
  CRISPR gRNA sequence
cccagcagctagaggaggca

SEQ ID NO: 7782 - DNA, 20 bp, Artificial
  CRISPR gRNA sequence
agcagctagaggaggcaagg

SEQ ID NO: 7783 - DNA, 20 bp, Artificial
  CRISPR gRNA sequence
caaggaagcattctcccctc

SEQ ID NO: 7784 - DNA, 20 bp, Artificial
  CRISPR gRNA sequence
gcattctcccctcgagcctc

SEQ ID NO: 7785 - DNA, 20 bp, Artificial
  CRISPR gRNA sequence
attctcccctcgagcctcca

SEQ ID NO: 7786 - DNA, 20 bp, Artificial
  CRISPR gRNA sequence
ttctcccctcgagcctccag

SEQ ID NO: 7787 - DNA, 20 bp, Artificial
  CRISPR gRNA sequence
tcccctcgagcctccagagg

SEQ ID NO: 7788 - DNA, 20 bp, Artificial
  CRISPR gRNA sequence
tcgagcctccagaggcagcg

SEQ ID NO: 7789 - DNA, 20 bp, Artificial
  CRISPR gRNA sequence
gcgtggccctgctgacacct

SEQ ID NO: 7790 - DNA, 20 bp, Artificial
  CRISPR gRNA sequence
gacaccttggcttcaacttc

SEQ ID NO: 7791 - DNA, 20 bp, Artificial
  CRISPR gRNA sequence
tggcttcaacttctggcctc

SEQ ID NO: 7792 - DNA, 20 bp, Artificial
  CRISPR gRNA sequence
cttctggcctccagaaccat

SEQ ID NO: 7793 - DNA, 20 bp, Artificial
  CRISPR gRNA sequence
tctggcctccagaaccatga

SEQ ID NO: 7794 - DNA, 20 bp, Artificial
  CRISPR gRNA sequence
tccagaaccatgagagaata

SEQ ID NO: 7795 - DNA, 20 bp, Artificial
  CRISPR gRNA sequence
gaataaagtgctgttgttct

SEQ ID NO: 7796 - DNA, 20 bp, Artificial
  CRISPR gRNA sequence
tgctgttgttctgagctacc

SEQ ID NO: 7797 - DNA, 20 bp, Artificial
  CRISPR gRNA sequence
gttctgagctacctggatgc

SEQ ID NO: 7798 - DNA, 20 bp, Artificial
  CRISPR gRNA sequence
tggatgctggtaccttgttt

SEQ ID NO: 7799 - DNA, 20 bp, Artificial
  CRISPR gRNA sequence
atgctggtaccttgtttcag

SEQ ID NO: 7800 - DNA, 20 bp, Artificial
  CRISPR gRNA sequence
gtaccttgtttcagcagccc

SEQ ID NO: 7801 - DNA, 20 bp, Artificial
  CRISPR gRNA sequence
taccttgtttcagcagccct

SEQ ID NO: 7802 - DNA, 20 bp, Artificial
  CRISPR gRNA sequence
cctgggaaatgaatatacca

SEQ ID NO: 7803 - DNA, 20 bp, Artificial
  CRISPR gRNA sequence
atgaatataccatggaaaca

SEQ ID NO: 7804 - DNA, 20 bp, Artificial
  CRISPR gRNA sequence
ggaaacatggacctgaacca

SEQ ID NO: 7805 - DNA, 20 bp, Artificial
  CRISPR gRNA sequence
tggacctgaaccacggatcc

SEQ ID NO: 7806 - DNA, 20 bp, Artificial
  CRISPR gRNA sequence
acctgaaccacggatcctgg

SEQ ID NO: 7807 - DNA, 20 bp, Artificial
  CRISPR gRNA sequence
cctgaaccacggatcctggc

SEQ ID NO: 7808 - DNA, 20 bp, Artificial
  CRISPR gRNA sequence
tgaaccacggatcctggcag

SEQ ID NO: 7809 - DNA, 20 bp, Artificial
  CRISPR gRNA sequence
acggatcctggcaggagcct

SEQ ID NO: 7810 - DNA, 20 bp, Artificial
  CRISPR gRNA sequence
ggatcctggcaggagcctta

SEQ ID NO: 7811 - DNA, 20 bp, Artificial
  CRISPR gRNA sequence
gcaggagccttagagccaca

SEQ ID NO: 7812 - DNA, 20 bp, Artificial
  CRISPR gRNA sequence
agccttagagccacacagat

SEQ ID NO: 7813 - DNA, 20 bp, Artificial
  CRISPR gRNA sequence
gagccacacagatgagcctt

SEQ ID NO: 7814 - DNA, 20 bp, Artificial
  CRISPR gRNA sequence
acacagatgagccttcagct

SEQ ID NO: 7815 - DNA, 20 bp, Artificial
  CRISPR gRNA sequence
gccttcagcttggctttccc

SEQ ID NO: 7816 - DNA, 20 bp, Artificial
  CRISPR gRNA sequence
tcagcttggctttccccagc

SEQ ID NO: 7817 - DNA, 20 bp, Artificial
  CRISPR gRNA sequence
agcttggctttccccagcaa

SEQ ID NO: 7818 - DNA, 20 bp, Artificial
  CRISPR gRNA sequence
agcaagagctacatgatctt

SEQ ID NO: 7819 - DNA, 20 bp, Artificial
  CRISPR gRNA sequence
gcaagagctacatgatcttg

SEQ ID NO: 7820 - DNA, 20 bp, Artificial
  CRISPR gRNA sequence
agagctacatgatcttgagg

SEQ ID NO: 7821 - DNA, 20 bp, Artificial
  CRISPR gRNA sequence
aggaagctgcttgtcttctc

SEQ ID NO: 7822 - DNA, 20 bp, Artificial
  CRISPR gRNA sequence
ggaagctgcttgtcttctct

SEQ ID NO: 7823 - DNA, 20 bp, Artificial
  CRISPR gRNA sequence
gcttgtcttctctgggtctc

SEQ ID NO: 7824 - DNA, 20 bp, Artificial
  CRISPR gRNA sequence
tcaagttcttcatctgccaa

SEQ ID NO: 7825 - DNA, 20 bp, Artificial
  CRISPR gRNA sequence
aagttcttcatctgccaatg

SEQ ID NO: 7826 - DNA, 20 bp, Artificial
  CRISPR gRNA sequence
agacaataatgcttacttcc

SEQ ID NO: 7827 - DNA, 20 bp, Artificial
  CRISPR gRNA sequence
gacaataatgcttacttcct

SEQ ID NO: 7828 - DNA, 20 bp, Artificial
  CRISPR gRNA sequence
gcttacttcctaggttttaa

SEQ ID NO: 7829 - DNA, 20 bp, Artificial
  CRISPR gRNA sequence
taggttttaacagctttatt

SEQ ID NO: 7830 - DNA, 20 bp, Artificial
  CRISPR gRNA sequence
atacaatttgcccacttaaa

SEQ ID NO: 7831 - DNA, 20 bp, Artificial
  CRISPR gRNA sequence
atttgcccacttaaaaagta

SEQ ID NO: 7832 - DNA, 20 bp, Artificial
  CRISPR gRNA sequence
tgcctgtaatcccaacactt

SEQ ID NO: 7833 - DNA, 20 bp, Artificial
  CRISPR gRNA sequence
gcctgtaatcccaacacttt

SEQ ID NO: 7834 - DNA, 20 bp, Artificial
  CRISPR gRNA sequence
ctgtaatcccaacactttgg

SEQ ID NO: 7835 - DNA, 20 bp, Artificial
  CRISPR gRNA sequence
tgtaatcccaacactttggg

SEQ ID NO: 7836 - DNA, 20 bp, Artificial
  CRISPR gRNA sequence
tcccaacactttgggaggcc

SEQ ID NO: 7837 - DNA, 20 bp, Artificial
  CRISPR gRNA sequence
cccaacactttgggaggccg

SEQ ID NO: 7838 - DNA, 20 bp, Artificial
  CRISPR gRNA sequence
caacactttgggaggccgag

SEQ ID NO: 7839 - DNA, 20 bp, Artificial
  CRISPR gRNA sequence
actttgggaggccgaggaga

SEQ ID NO: 7840 - DNA, 20 bp, Artificial
  CRISPR gRNA sequence
ctttgggaggccgaggagac

SEQ ID NO: 7841 - DNA, 20 bp, Artificial
  CRISPR gRNA sequence
tgggaggccgaggagacagg

SEQ ID NO: 7842 - DNA, 20 bp, Artificial
  CRISPR gRNA sequence
aggagacaggcggatcactt

SEQ ID NO: 7843 - DNA, 20 bp, Artificial
  CRISPR gRNA sequence
ggagacaggcggatcacttg

SEQ ID NO: 7844 - DNA, 20 bp, Artificial
  CRISPR gRNA sequence
acaggcggatcacttgaggt

SEQ ID NO: 7845 - DNA, 20 bp, Artificial
  CRISPR gRNA sequence
caggcggatcacttgaggtc

SEQ ID NO: 7846 - DNA, 20 bp, Artificial
  CRISPR gRNA sequence
ggcggatcacttgaggtcag

SEQ ID NO: 7847 - DNA, 20 bp, Artificial
  CRISPR gRNA sequence
tcacttgaggtcaggagttt

SEQ ID NO: 7848 - DNA, 20 bp, Artificial
  CRISPR gRNA sequence
tgaggtcaggagtttgagaa

SEQ ID NO: 7849 - DNA, 20 bp, Artificial
  CRISPR gRNA sequence
tcaggagtttgagaacagcc

SEQ ID NO: 7850 - DNA, 20 bp, Artificial
  CRISPR gRNA sequence
tgagaacagcctggccaaaa

SEQ ID NO: 7851 - DNA, 20 bp, Artificial
  CRISPR gRNA sequence
tctactaaaaatgcaaaaat

SEQ ID NO: 7852 - DNA, 20 bp, Artificial
  CRISPR gRNA sequence
ctaaaaatgcaaaaattagc

SEQ ID NO: 7853 - DNA, 20 bp, Artificial
  CRISPR gRNA sequence
taaaaatgcaaaaattagcc

SEQ ID NO: 7854 - DNA, 20 bp, Artificial
  CRISPR gRNA sequence
atgcaaaaattagccgggtg

SEQ ID NO: 7855 - DNA, 20 bp, Artificial
  CRISPR gRNA sequence
caaaaattagccgggtgtgg

SEQ ID NO: 7856 - DNA, 20 bp, Artificial
  CRISPR gRNA sequence
aaattagccgggtgtggtgg

SEQ ID NO: 7857 - DNA, 20 bp, Artificial
  CRISPR gRNA sequence
aattagccgggtgtggtggt

SEQ ID NO: 7858 - DNA, 20 bp, Artificial
  CRISPR gRNA sequence
gtggtgggtgcctgtaatcc

SEQ ID NO: 7859 - DNA, 20 bp, Artificial
  CRISPR gRNA sequence
tgcctgtaatcccagctgct

SEQ ID NO: 7860 - DNA, 20 bp, Artificial
  CRISPR gRNA sequence
gcctgtaatcccagctgctc

SEQ ID NO: 7861 - DNA, 20 bp, Artificial
  CRISPR gRNA sequence
ctgtaatcccagctgctcag

SEQ ID NO: 7862 - DNA, 20 bp, Artificial
  CRISPR gRNA sequence
tgtaatcccagctgctcagg

SEQ ID NO: 7863 - DNA, 20 bp, Artificial
  CRISPR gRNA sequence
tcccagctgctcaggaggct

SEQ ID NO: 7864 - DNA, 20 bp, Artificial
  CRISPR gRNA sequence
cccagctgctcaggaggctg

SEQ ID NO: 7865 - DNA, 20 bp, Artificial
  CRISPR gRNA sequence
agctgctcaggaggctgagg

SEQ ID NO: 7866 - DNA, 20 bp, Artificial
  CRISPR gRNA sequence
tgctcaggaggctgaggcag

SEQ ID NO: 7867 - DNA, 20 bp, Artificial
  CRISPR gRNA sequence
aggaggctgaggcagaagaa

SEQ ID NO: 7868 - DNA, 20 bp, Artificial
  CRISPR gRNA sequence
gcagaagaatggcttgaacc

SEQ ID NO: 7869 - DNA, 20 bp, Artificial
  CRISPR gRNA sequence
cagaagaatggcttgaacct

SEQ ID NO: 7870 - DNA, 20 bp, Artificial
  CRISPR gRNA sequence
gaagaatggcttgaacctgg

SEQ ID NO: 7871 - DNA, 20 bp, Artificial
  CRISPR gRNA sequence
aagaatggcttgaacctggg

SEQ ID NO: 7872 - DNA, 20 bp, Artificial
  CRISPR gRNA sequence
aatggcttgaacctgggagg

SEQ ID NO: 7873 - DNA, 20 bp, Artificial
  CRISPR gRNA sequence
aacctgggaggcagacgttg

SEQ ID NO: 7874 - DNA, 20 bp, Artificial
  CRISPR gRNA sequence
tgggaggcagacgttgcagt

SEQ ID NO: 7875 - DNA, 20 bp, Artificial
  CRISPR gRNA sequence
ggcagacgttgcagtgagcc

SEQ ID NO: 7876 - DNA, 20 bp, Artificial
  CRISPR gRNA sequence
aagattgcacccctgcactc

SEQ ID NO: 7877 - DNA, 20 bp, Artificial
  CRISPR gRNA sequence
tgcacccctgcactccagcc

SEQ ID NO: 7878 - DNA, 20 bp, Artificial
  CRISPR gRNA sequence
gcacccctgcactccagcct

SEQ ID NO: 7879 - DNA, 20 bp, Artificial
  CRISPR gRNA sequence
ctgcactccagcctgggtga

SEQ ID NO: 7880 - DNA, 20 bp, Artificial
  CRISPR gRNA sequence
gcactccagcctgggtgaca

SEQ ID NO: 7881 - DNA, 20 bp, Artificial
  CRISPR gRNA sequence
aaaaaaaaaaaaaaaaaaaa

SEQ ID NO: 7882 - DNA, 20 bp, Artificial
  CRISPR gRNA sequence
aaaaaaaaaaaaaaaaaaag

SEQ ID NO: 7883 - DNA, 20 bp, Artificial
  CRISPR gRNA sequence
aaaaaaaaaaaaaaaaagta

SEQ ID NO: 7884 - DNA, 20 bp, Artificial
  CRISPR gRNA sequence
aaaaaaaaaaaagtagagtt

SEQ ID NO: 7885 - DNA, 20 bp, Artificial
  CRISPR gRNA sequence
agtagagttcagtgttcttt

SEQ ID NO: 7886 - DNA, 20 bp, Artificial
  CRISPR gRNA sequence
gtagagttcagtgttctttt

SEQ ID NO: 7887 - DNA, 20 bp, Artificial
  CRISPR gRNA sequence
agtgttcttttgggaatact

SEQ ID NO: 7888 - DNA, 20 bp, Artificial
  CRISPR gRNA sequence
tgttcttttgggaatactca

SEQ ID NO: 7889 - DNA, 20 bp, Artificial
  CRISPR gRNA sequence
ttcttttgggaatactcaga

SEQ ID NO: 7890 - DNA, 20 bp, Artificial
  CRISPR gRNA sequence
gtgaccatctcccatcccca

SEQ ID NO: 7891 - DNA, 20 bp, Artificial
  CRISPR gRNA sequence
cccatccccacagtcaattt

SEQ ID NO: 7892 - DNA, 20 bp, Artificial
  CRISPR gRNA sequence
gcacatttcatcacccccta

SEQ ID NO: 7893 - DNA, 20 bp, Artificial
  CRISPR gRNA sequence
atcaccccctaaagaaactc

SEQ ID NO: 7894 - DNA, 20 bp, Artificial
  CRISPR gRNA sequence
taaagaaactccagacccat

SEQ ID NO: 7895 - DNA, 20 bp, Artificial
  CRISPR gRNA sequence
agaaactccagacccatcag

SEQ ID NO: 7896 - DNA, 20 bp, Artificial
  CRISPR gRNA sequence
ttccaaaatccctctctgcc

SEQ ID NO: 7897 - DNA, 20 bp, Artificial
  CRISPR gRNA sequence
aatccctctctgccaagccc

SEQ ID NO: 7898 - DNA, 20 bp, Artificial
  CRISPR gRNA sequence
atccctctctgccaagccct

SEQ ID NO: 7899 - DNA, 20 bp, Artificial
  CRISPR gRNA sequence
ctttcttaaaaaaaaattaa

SEQ ID NO: 7900 - DNA, 20 bp, Artificial
  CRISPR gRNA sequence
ttcttaaaaaaaaattaata

SEQ ID NO: 7901 - DNA, 20 bp, Artificial
  CRISPR gRNA sequence
taaaaaaaaattaatagaga

SEQ ID NO: 7902 - DNA, 20 bp, Artificial
  CRISPR gRNA sequence
aaaaaaaaattaatagagat

SEQ ID NO: 7903 - DNA, 20 bp, Artificial
  CRISPR gRNA sequence
taggcttttgctatgttgcc

SEQ ID NO: 7904 - DNA, 20 bp, Artificial
  CRISPR gRNA sequence
aggcttttgctatgttgccc

SEQ ID NO: 7905 - DNA, 20 bp, Artificial
  CRISPR gRNA sequence
ttttgctatgttgcccaggc

SEQ ID NO: 7906 - DNA, 20 bp, Artificial
  CRISPR gRNA sequence
ccaggctggtcttgaacacc

SEQ ID NO: 7907 - DNA, 20 bp, Artificial
  CRISPR gRNA sequence
caggctggtcttgaacacct

SEQ ID NO: 7908 - DNA, 20 bp, Artificial
  CRISPR gRNA sequence
ggtcttgaacacctgggctc

SEQ ID NO: 7909 - DNA, 20 bp, Artificial
  CRISPR gRNA sequence
ctcaagcgattctcctgtct

SEQ ID NO: 7910 - DNA, 20 bp, Artificial
  CRISPR gRNA sequence
tctcctgtctcagcctccca

SEQ ID NO: 7911 - DNA, 20 bp, Artificial
  CRISPR gRNA sequence
gtctcagcctcccaaagtgc

SEQ ID NO: 7912 - DNA, 20 bp, Artificial
  CRISPR gRNA sequence
tctcagcctcccaaagtgct

SEQ ID NO: 7913 - DNA, 20 bp, Artificial
  CRISPR gRNA sequence
ctcccaaagtgctgggattt

SEQ ID NO: 7914 - DNA, 20 bp, Artificial
  CRISPR gRNA sequence
tcccaaagtgctgggatttc

SEQ ID NO: 7915 - DNA, 20 bp, Artificial
  CRISPR gRNA sequence
agtgctgggatttcaggcat

SEQ ID NO: 7916 - DNA, 20 bp, Artificial
  CRISPR gRNA sequence
cctcctactttatgtctcca

SEQ ID NO: 7917 - DNA, 20 bp, Artificial
  CRISPR gRNA sequence
ctccatggatttgcctgttt

SEQ ID NO: 7918 - DNA, 20 bp, Artificial
  CRISPR gRNA sequence
ttttggtcatttcaaataaa

SEQ ID NO: 7919 - DNA, 20 bp, Artificial
  CRISPR gRNA sequence
aatatgtgaccctttgtgtc

SEQ ID NO: 7920 - DNA, 20 bp, Artificial
  CRISPR gRNA sequence
ttgtgtccggcttcttcact

SEQ ID NO: 7921 - DNA, 20 bp, Artificial
  CRISPR gRNA sequence
cttcacttagcatttttttt

SEQ ID NO: 7922 - DNA, 20 bp, Artificial
  CRISPR gRNA sequence
ttcacttagcatttttttta

SEQ ID NO: 7923 - DNA, 20 bp, Artificial
  CRISPR gRNA sequence
tttaaggttcatccatgttc

SEQ ID NO: 7924 - DNA, 20 bp, Artificial
  CRISPR gRNA sequence
atccatgttccagcatgtat

SEQ ID NO: 7925 - DNA, 20 bp, Artificial
  CRISPR gRNA sequence
tcagtgctttctccctttaa

SEQ ID NO: 7926 - DNA, 20 bp, Artificial
  CRISPR gRNA sequence
gtgctttctccctttaatgg

SEQ ID NO: 7927 - DNA, 20 bp, Artificial
  CRISPR gRNA sequence
tggtggaatactttattgta

SEQ ID NO: 7928 - DNA, 20 bp, Artificial
  CRISPR gRNA sequence
gaatactttattgtatagat

SEQ ID NO: 7929 - DNA, 20 bp, Artificial
  CRISPR gRNA sequence
ttgtttatccatttattttt

SEQ ID NO: 7930 - DNA, 20 bp, Artificial
  CRISPR gRNA sequence
tttatccatttattttttgg

SEQ ID NO: 7931 - DNA, 20 bp, Artificial
  CRISPR gRNA sequence
tttattttttggtggatatt

SEQ ID NO: 7932 - DNA, 20 bp, Artificial
  CRISPR gRNA sequence
ttattttttggtggatattt

SEQ ID NO: 7933 - DNA, 20 bp, Artificial
  CRISPR gRNA sequence
tttgggctgtttttatattt

SEQ ID NO: 7934 - DNA, 20 bp, Artificial
  CRISPR gRNA sequence
cttctgtgaacattcgtgta

SEQ ID NO: 7935 - DNA, 20 bp, Artificial
  CRISPR gRNA sequence
ttctgtgaacattcgtgtat

SEQ ID NO: 7936 - DNA, 20 bp, Artificial
  CRISPR gRNA sequence
ttcgtgtataggtttttgtg

SEQ ID NO: 7937 - DNA, 20 bp, Artificial
  CRISPR gRNA sequence
ggtttttgtgtggatatatc

SEQ ID NO: 7938 - DNA, 20 bp, Artificial
  CRISPR gRNA sequence
cataatatgatacatattta

SEQ ID NO: 7939 - DNA, 20 bp, Artificial
  CRISPR gRNA sequence
ataatatgatacatatttat

SEQ ID NO: 7940 - DNA, 20 bp, Artificial
  CRISPR gRNA sequence
taatatgatacatatttatg

SEQ ID NO: 7941 - DNA, 20 bp, Artificial
  CRISPR gRNA sequence
gtgaatatttattacatgca

SEQ ID NO: 7942 - DNA, 20 bp, Artificial
  CRISPR gRNA sequence
aatatttattacatgcatag

SEQ ID NO: 7943 - DNA, 20 bp, Artificial
  CRISPR gRNA sequence
atatttattacatgcataga

SEQ ID NO: 7944 - DNA, 20 bp, Artificial
  CRISPR gRNA sequence
agaaggtataatgatcatgt

SEQ ID NO: 7945 - DNA, 20 bp, Artificial
  CRISPR gRNA sequence
gaaggtataatgatcatgtc

SEQ ID NO: 7946 - DNA, 20 bp, Artificial
  CRISPR gRNA sequence
atgatcatgtcaggatattt

SEQ ID NO: 7947 - DNA, 20 bp, Artificial
  CRISPR gRNA sequence
tgatcatgtcaggatatttg

SEQ ID NO: 7948 - DNA, 20 bp, Artificial
  CRISPR gRNA sequence
atatttgaggtatccacatt

SEQ ID NO: 7949 - DNA, 20 bp, Artificial
  CRISPR gRNA sequence
tatttgaggtatccacattt

SEQ ID NO: 7950 - DNA, 20 bp, Artificial
  CRISPR gRNA sequence
tccacatttgggattgttta

SEQ ID NO: 7951 - DNA, 20 bp, Artificial
  CRISPR gRNA sequence
tgtttaaagattaaatgaaa

SEQ ID NO: 7952 - DNA, 20 bp, Artificial
  CRISPR gRNA sequence
attaaatgaaatagtgttaa

SEQ ID NO: 7953 - DNA, 20 bp, Artificial
  CRISPR gRNA sequence
tatgcccttcaacaaatgat

SEQ ID NO: 7954 - DNA, 20 bp, Artificial
  CRISPR gRNA sequence
atgcccttcaacaaatgatg

SEQ ID NO: 7955 - DNA, 20 bp, Artificial
  CRISPR gRNA sequence
aacaaatgatgaggaaatct

SEQ ID NO: 7956 - DNA, 20 bp, Artificial
  CRISPR gRNA sequence
aggaaatcttagaatctgct

SEQ ID NO: 7957 - DNA, 20 bp, Artificial
  CRISPR gRNA sequence
agaatctgctcagactcctt

SEQ ID NO: 7958 - DNA, 20 bp, Artificial
  CRISPR gRNA sequence
gactccttcagtttacatat

SEQ ID NO: 7959 - DNA, 20 bp, Artificial
  CRISPR gRNA sequence
actccttcagtttacatatt

SEQ ID NO: 7960 - DNA, 20 bp, Artificial
  CRISPR gRNA sequence
agtttacatattaggaaact

SEQ ID NO: 7961 - DNA, 20 bp, Artificial
  CRISPR gRNA sequence
gtttacatattaggaaactg

SEQ ID NO: 7962 - DNA, 20 bp, Artificial
  CRISPR gRNA sequence
catattaggaaactgaggca

SEQ ID NO: 7963 - DNA, 20 bp, Artificial
  CRISPR gRNA sequence
ttaggaaactgaggcacaga

SEQ ID NO: 7964 - DNA, 20 bp, Artificial
  CRISPR gRNA sequence
taggaaactgaggcacagaa

SEQ ID NO: 7965 - DNA, 20 bp, Artificial
  CRISPR gRNA sequence
ggaaactgaggcacagaaag

SEQ ID NO: 7966 - DNA, 20 bp, Artificial
  CRISPR gRNA sequence
aactgaggcacagaaaggag

SEQ ID NO: 7967 - DNA, 20 bp, Artificial
  CRISPR gRNA sequence
ctgaggcacagaaaggagca

SEQ ID NO: 7968 - DNA, 20 bp, Artificial
  CRISPR gRNA sequence
aaaggagcagagacttgctc

SEQ ID NO: 7969 - DNA, 20 bp, Artificial
  CRISPR gRNA sequence
gacttgctcaagtccaccca

SEQ ID NO: 7970 - DNA, 20 bp, Artificial
  CRISPR gRNA sequence
ttgctcaagtccacccaaag

SEQ ID NO: 7971 - DNA, 20 bp, Artificial
  CRISPR gRNA sequence
ctcaagtccacccaaagcag

SEQ ID NO: 7972 - DNA, 20 bp, Artificial
  CRISPR gRNA sequence
caagtccacccaaagcagta

SEQ ID NO: 7973 - DNA, 20 bp, Artificial
  CRISPR gRNA sequence
cccaaagcagtagagcattg

SEQ ID NO: 7974 - DNA, 20 bp, Artificial
  CRISPR gRNA sequence
tagagcattgtggttaaatg

SEQ ID NO: 7975 - DNA, 20 bp, Artificial
  CRISPR gRNA sequence
agagcattgtggttaaatgc

SEQ ID NO: 7976 - DNA, 20 bp, Artificial
  CRISPR gRNA sequence
tgtggttaaatgcaggactt

SEQ ID NO: 7977 - DNA, 20 bp, Artificial
  CRISPR gRNA sequence
gttaaatgcaggacttcagt

SEQ ID NO: 7978 - DNA, 20 bp, Artificial
  CRISPR gRNA sequence
aggacttcagtcagactgtc

SEQ ID NO: 7979 - DNA, 20 bp, Artificial
  CRISPR gRNA sequence
ggacttcagtcagactgtct

SEQ ID NO: 7980 - DNA, 20 bp, Artificial
  CRISPR gRNA sequence
gactgtctgggttcaaatcc

SEQ ID NO: 7981 - DNA, 20 bp, Artificial
  CRISPR gRNA sequence
gttcaaatcctggttccact

SEQ ID NO: 7982 - DNA, 20 bp, Artificial
  CRISPR gRNA sequence
atcctggttccacttggaca

SEQ ID NO: 7983 - DNA, 20 bp, Artificial
  CRISPR gRNA sequence
tcctggttccacttggacat

SEQ ID NO: 7984 - DNA, 20 bp, Artificial
  CRISPR gRNA sequence
ataaatcacttcacctctct

SEQ ID NO: 7985 - DNA, 20 bp, Artificial
  CRISPR gRNA sequence
cacttcacctctctgagcct

SEQ ID NO: 7986 - DNA, 20 bp, Artificial
  CRISPR gRNA sequence
cctcagttttctcatatgca

SEQ ID NO: 7987 - DNA, 20 bp, Artificial
  CRISPR gRNA sequence
agttttctcatatgcaaagt

SEQ ID NO: 7988 - DNA, 20 bp, Artificial
  CRISPR gRNA sequence
gttttctcatatgcaaagtg

SEQ ID NO: 7989 - DNA, 20 bp, Artificial
  CRISPR gRNA sequence
ataataataccttccttaca

SEQ ID NO: 7990 - DNA, 20 bp, Artificial
  CRISPR gRNA sequence
ccttacatggttactgatat

SEQ ID NO: 7991 - DNA, 20 bp, Artificial
  CRISPR gRNA sequence
gatatgagtattaaatgtgc

SEQ ID NO: 7992 - DNA, 20 bp, Artificial
  CRISPR gRNA sequence
aatgtgccagctcatgtgcc

SEQ ID NO: 7993 - DNA, 20 bp, Artificial
  CRISPR gRNA sequence
cagctcatgtgcctggcgta

SEQ ID NO: 7994 - DNA, 20 bp, Artificial
  CRISPR gRNA sequence
agctcatgtgcctggcgtat

SEQ ID NO: 7995 - DNA, 20 bp, Artificial
  CRISPR gRNA sequence
ctcatgtgcctggcgtatag

SEQ ID NO: 7996 - DNA, 20 bp, Artificial
  CRISPR gRNA sequence
tcatgtgcctggcgtatagg

SEQ ID NO: 7997 - DNA, 20 bp, Artificial
  CRISPR gRNA sequence
aggaggtgctttataaacct

SEQ ID NO: 7998 - DNA, 20 bp, Artificial
  CRISPR gRNA sequence
accttagctgttaccactca

SEQ ID NO: 7999 - DNA, 20 bp, Artificial
  CRISPR gRNA sequence
actcatggcattgccaaatg

SEQ ID NO: 8000 - DNA, 20 bp, Artificial
  CRISPR gRNA sequence
ctcatggcattgccaaatgt

SEQ ID NO: 8001 - DNA, 20 bp, Artificial
  CRISPR gRNA sequence
tggcattgccaaatgtggga

SEQ ID NO: 8002 - DNA, 20 bp, Artificial
  CRISPR gRNA sequence
ggcattgccaaatgtgggac

SEQ ID NO: 8003 - DNA, 20 bp, Artificial
  CRISPR gRNA sequence
ggacgggtctcctgactctc

SEQ ID NO: 8004 - DNA, 20 bp, Artificial
  CRISPR gRNA sequence
gtctcctgactctctggtgt

SEQ ID NO: 8005 - DNA, 20 bp, Artificial
  CRISPR gRNA sequence
actctctggtgtgagattga

SEQ ID NO: 8006 - DNA, 20 bp, Artificial
  CRISPR gRNA sequence
ttgatggaatccacactttc

SEQ ID NO: 8007 - DNA, 20 bp, Artificial
  CRISPR gRNA sequence
cagttcccttttctacctcc

SEQ ID NO: 8008 - DNA, 20 bp, Artificial
  CRISPR gRNA sequence
agttcccttttctacctcct

SEQ ID NO: 8009 - DNA, 20 bp, Artificial
  CRISPR gRNA sequence
ctcctgggtatcttctcata

SEQ ID NO: 8010 - DNA, 20 bp, Artificial
  CRISPR gRNA sequence
gtatcttctcatatggttgt

SEQ ID NO: 8011 - DNA, 20 bp, Artificial
  CRISPR gRNA sequence
tcatatggttgtaagttcct

SEQ ID NO: 8012 - DNA, 20 bp, Artificial
  CRISPR gRNA sequence
atatggttgtaagttccttg

SEQ ID NO: 8013 - DNA, 20 bp, Artificial
  CRISPR gRNA sequence
tatggttgtaagttccttgg

SEQ ID NO: 8014 - DNA, 20 bp, Artificial
  CRISPR gRNA sequence
ggttgtaagttccttggagg

SEQ ID NO: 8015 - DNA, 20 bp, Artificial
  CRISPR gRNA sequence
gttgtaagttccttggagga

SEQ ID NO: 8016 - DNA, 20 bp, Artificial
  CRISPR gRNA sequence
ttgtaagttccttggaggaa

SEQ ID NO: 8017 - DNA, 20 bp, Artificial
  CRISPR gRNA sequence
ttccttggaggaagggaatg

SEQ ID NO: 8018 - DNA, 20 bp, Artificial
  CRISPR gRNA sequence
cttgctctctccaccacgct

SEQ ID NO: 8019 - DNA, 20 bp, Artificial
  CRISPR gRNA sequence
ctccaccacgctgagcatat

SEQ ID NO: 8020 - DNA, 20 bp, Artificial
  CRISPR gRNA sequence
ccaccacgctgagcatataa

SEQ ID NO: 8021 - DNA, 20 bp, Artificial
  CRISPR gRNA sequence
caccacgctgagcatataag

SEQ ID NO: 8022 - DNA, 20 bp, Artificial
  CRISPR gRNA sequence
gcatataagaggtgctgaat

SEQ ID NO: 8023 - DNA, 20 bp, Artificial
  CRISPR gRNA sequence
ttattcactcctctcatccc

SEQ ID NO: 8024 - DNA, 20 bp, Artificial
  CRISPR gRNA sequence
ctctcatccccagccctcac

SEQ ID NO: 8025 - DNA, 20 bp, Artificial
  CRISPR gRNA sequence
catccccagccctcaccagc

SEQ ID NO: 8026 - DNA, 20 bp, Artificial
  CRISPR gRNA sequence
atccccagccctcaccagct

SEQ ID NO: 8027 - DNA, 20 bp, Artificial
  CRISPR gRNA sequence
ccccagccctcaccagctgg

SEQ ID NO: 8028 - DNA, 20 bp, Artificial
  CRISPR gRNA sequence
tcaccagctgggagttgttg

SEQ ID NO: 8029 - DNA, 20 bp, Artificial
  CRISPR gRNA sequence
caccagctgggagttgttgt

SEQ ID NO: 8030 - DNA, 20 bp, Artificial
  CRISPR gRNA sequence
gcctctttccaacaccctgt

SEQ ID NO: 8031 - DNA, 20 bp, Artificial
  CRISPR gRNA sequence
cctctttccaacaccctgtg

SEQ ID NO: 8032 - DNA, 20 bp, Artificial
  CRISPR gRNA sequence
caacaccctgtgaggtgact

SEQ ID NO: 8033 - DNA, 20 bp, Artificial
  CRISPR gRNA sequence
ctgagcattgtcttccctcc

SEQ ID NO: 8034 - DNA, 20 bp, Artificial
  CRISPR gRNA sequence
tgagcattgtcttccctccc

SEQ ID NO: 8035 - DNA, 20 bp, Artificial
  CRISPR gRNA sequence
gcattgtcttccctcccagg

SEQ ID NO: 8036 - DNA, 20 bp, Artificial
  CRISPR gRNA sequence
cttccctcccaggcagctca

SEQ ID NO: 8037 - DNA, 20 bp, Artificial
  CRISPR gRNA sequence
cagctcacagtgtgccacca

SEQ ID NO: 8038 - DNA, 20 bp, Artificial
  CRISPR gRNA sequence
gctcacagtgtgccaccatg

SEQ ID NO: 8039 - DNA, 20 bp, Artificial
  CRISPR gRNA sequence
acagtgtgccaccatggagt

SEQ ID NO: 8040 - DNA, 20 bp, Artificial
  CRISPR gRNA sequence
cagtgtgccaccatggagtt

SEQ ID NO: 8041 - DNA, 20 bp, Artificial
  CRISPR gRNA sequence
agtgtgccaccatggagttg

SEQ ID NO: 8042 - DNA, 20 bp, Artificial
  CRISPR gRNA sequence
caccatggagttggggcccc

SEQ ID NO: 8043 - DNA, 20 bp, Artificial
  CRISPR gRNA sequence
catggagttggggcccctag

SEQ ID NO: 8044 - DNA, 20 bp, Artificial
  CRISPR gRNA sequence
atggagttggggcccctaga

SEQ ID NO: 8045 - DNA, 20 bp, Artificial
  CRISPR gRNA sequence
gagttggggcccctagaagg

SEQ ID NO: 8046 - DNA, 20 bp, Artificial
  CRISPR gRNA sequence
gcccctagaaggtggctacc

SEQ ID NO: 8047 - DNA, 20 bp, Artificial
  CRISPR gRNA sequence
ccctagaaggtggctacctg

SEQ ID NO: 8048 - DNA, 20 bp, Artificial
  CRISPR gRNA sequence
ggctacctggagcttcttaa

SEQ ID NO: 8049 - DNA, 20 bp, Artificial
  CRISPR gRNA sequence
gcctctaccacttctatgac

SEQ ID NO: 8050 - DNA, 20 bp, Artificial
  CRISPR gRNA sequence
ctaccacttctatgaccaga

SEQ ID NO: 8051 - DNA, 20 bp, Artificial
  CRISPR gRNA sequence
cttctatgaccagatggacc

SEQ ID NO: 8052 - DNA, 20 bp, Artificial
  CRISPR gRNA sequence
tatgaccagatggacctggc

SEQ ID NO: 8053 - DNA, 20 bp, Artificial
  CRISPR gRNA sequence
tgaccagatggacctggctg

SEQ ID NO: 8054 - DNA, 20 bp, Artificial
  CRISPR gRNA sequence
ccagatggacctggctggag

SEQ ID NO: 8055 - DNA, 20 bp, Artificial
  CRISPR gRNA sequence
gatggacctggctggagaag

SEQ ID NO: 8056 - DNA, 20 bp, Artificial
  CRISPR gRNA sequence
tggacctggctggagaagaa

SEQ ID NO: 8057 - DNA, 20 bp, Artificial
  CRISPR gRNA sequence
tggctggagaagaagagatt

SEQ ID NO: 8058 - DNA, 20 bp, Artificial
  CRISPR gRNA sequence
agaagagattgagctctact

SEQ ID NO: 8059 - DNA, 20 bp, Artificial
  CRISPR gRNA sequence
gaagagattgagctctactc

SEQ ID NO: 8060 - DNA, 20 bp, Artificial
  CRISPR gRNA sequence
gagattgagctctactcagg

SEQ ID NO: 8061 - DNA, 20 bp, Artificial
  CRISPR gRNA sequence
agattgagctctactcaggt

SEQ ID NO: 8062 - DNA, 20 bp, Artificial
  CRISPR gRNA sequence
caggtgggccctcctccctc

SEQ ID NO: 8063 - DNA, 20 bp, Artificial
  CRISPR gRNA sequence
ctcctccctctggtctcttc

SEQ ID NO: 8064 - DNA, 20 bp, Artificial
  CRISPR gRNA sequence
ttccggtatcccccacccct

SEQ ID NO: 8065 - DNA, 20 bp, Artificial
  CRISPR gRNA sequence
ccccacccctcagcttgctg

SEQ ID NO: 8066 - DNA, 20 bp, Artificial
  CRISPR gRNA sequence
ccacccctcagcttgctgta

SEQ ID NO: 8067 - DNA, 20 bp, Artificial
  CRISPR gRNA sequence
ccctcagcttgctgtagaga

SEQ ID NO: 8068 - DNA, 20 bp, Artificial
  CRISPR gRNA sequence
cttgctgtagagacggcaat

SEQ ID NO: 8069 - DNA, 20 bp, Artificial
  CRISPR gRNA sequence
ttgctgtagagacggcaatc

SEQ ID NO: 8070 - DNA, 20 bp, Artificial
  CRISPR gRNA sequence
tgctgtagagacggcaatca

SEQ ID NO: 8071 - DNA, 20 bp, Artificial
  CRISPR gRNA sequence
gctgtagagacggcaatcag

SEQ ID NO: 8072 - DNA, 20 bp, Artificial
  CRISPR gRNA sequence
acggcaatcaggggaaattc

SEQ ID NO: 8073 - DNA, 20 bp, Artificial
  CRISPR gRNA sequence
tctggtccctgccctcccgt

SEQ ID NO: 8074 - DNA, 20 bp, Artificial
  CRISPR gRNA sequence
ctgccctcccgtcagcacca

SEQ ID NO: 8075 - DNA, 20 bp, Artificial
  CRISPR gRNA sequence
cctcccgtcagcaccacgga

SEQ ID NO: 8076 - DNA, 20 bp, Artificial
  CRISPR gRNA sequence
acggacagctcccacgtctg

SEQ ID NO: 8077 - DNA, 20 bp, Artificial
  CRISPR gRNA sequence
cggacagctcccacgtctgt

SEQ ID NO: 8078 - DNA, 20 bp, Artificial
  CRISPR gRNA sequence
cgtctgtgggacgctctctg

SEQ ID NO: 8079 - DNA, 20 bp, Artificial
  CRISPR gRNA sequence
tgtgggacgctctctgcaga

SEQ ID NO: 8080 - DNA, 20 bp, Artificial
  CRISPR gRNA sequence
gtgggacgctctctgcagat

SEQ ID NO: 8081 - DNA, 20 bp, Artificial
  CRISPR gRNA sequence
tgggacgctctctgcagatg

SEQ ID NO: 8082 - DNA, 20 bp, Artificial
  CRISPR gRNA sequence
tgcagatggggatgatctcc

SEQ ID NO: 8083 - DNA, 20 bp, Artificial
  CRISPR gRNA sequence
gcctctccctcgttccccac

SEQ ID NO: 8084 - DNA, 20 bp, Artificial
  CRISPR gRNA sequence
ttccccaccagccctctttc

SEQ ID NO: 8085 - DNA, 20 bp, Artificial
  CRISPR gRNA sequence
agaaatttccttcttcatcc

SEQ ID NO: 8086 - DNA, 20 bp, Artificial
  CRISPR gRNA sequence
gaaatttccttcttcatcca

SEQ ID NO: 8087 - DNA, 20 bp, Artificial
  CRISPR gRNA sequence
aaatttccttcttcatccaa

SEQ ID NO: 8088 - DNA, 20 bp, Artificial
  CRISPR gRNA sequence
atccaagggacttttcctcc

SEQ ID NO: 8089 - DNA, 20 bp, Artificial
  CRISPR gRNA sequence
tttcctcccagaacccgaca

SEQ ID NO: 8090 - DNA, 20 bp, Artificial
  CRISPR gRNA sequence
cagacaccatcaactgcgac

SEQ ID NO: 8091 - DNA, 20 bp, Artificial
  CRISPR gRNA sequence
accatcaactgcgaccagtt

SEQ ID NO: 8092 - DNA, 20 bp, Artificial
  CRISPR gRNA sequence
atcaactgcgaccagttcag

SEQ ID NO: 8093 - DNA, 20 bp, Artificial
  CRISPR gRNA sequence
tcaactgcgaccagttcagc

SEQ ID NO: 8094 - DNA, 20 bp, Artificial
  CRISPR gRNA sequence
cagcaggctgttgtgtgaca

SEQ ID NO: 8095 - DNA, 20 bp, Artificial
  CRISPR gRNA sequence
caggctgttgtgtgacatgg

SEQ ID NO: 8096 - DNA, 20 bp, Artificial
  CRISPR gRNA sequence
aggctgttgtgtgacatgga

SEQ ID NO: 8097 - DNA, 20 bp, Artificial
  CRISPR gRNA sequence
gtgtgacatggaaggtgatg

SEQ ID NO: 8098 - DNA, 20 bp, Artificial
  CRISPR gRNA sequence
gtgacatggaaggtgatgaa

SEQ ID NO: 8099 - DNA, 20 bp, Artificial
  CRISPR gRNA sequence
atggaaggtgatgaagagac

SEQ ID NO: 8100 - DNA, 20 bp, Artificial
  CRISPR gRNA sequence
tggaaggtgatgaagagacc

SEQ ID NO: 8101 - DNA, 20 bp, Artificial
  CRISPR gRNA sequence
ggaaggtgatgaagagacca

SEQ ID NO: 8102 - DNA, 20 bp, Artificial
  CRISPR gRNA sequence
aaggtgatgaagagaccagg

SEQ ID NO: 8103 - DNA, 20 bp, Artificial
  CRISPR gRNA sequence
aggtgatgaagagaccaggg

SEQ ID NO: 8104 - DNA, 20 bp, Artificial
  CRISPR gRNA sequence
agggaggcttatgccaatat

SEQ ID NO: 8105 - DNA, 20 bp, Artificial
  CRISPR gRNA sequence
aggcttatgccaatatcggt

SEQ ID NO: 8106 - DNA, 20 bp, Artificial
  CRISPR gRNA sequence
ggcttatgccaatatcggtg

SEQ ID NO: 8107 - DNA, 20 bp, Artificial
  CRISPR gRNA sequence
ttatgccaatatcggtgagg

SEQ ID NO: 8108 - DNA, 20 bp, Artificial
  CRISPR gRNA sequence
atatcggtgaggaagcacct

SEQ ID NO: 8109 - DNA, 20 bp, Artificial
  CRISPR gRNA sequence
ggtgaggaagcacctgagcc

SEQ ID NO: 8110 - DNA, 20 bp, Artificial
  CRISPR gRNA sequence
ggaagcacctgagcccagaa

SEQ ID NO: 8111 - DNA, 20 bp, Artificial
  CRISPR gRNA sequence
gaagcacctgagcccagaaa

SEQ ID NO: 8112 - DNA, 20 bp, Artificial
  CRISPR gRNA sequence
gagcccagaaaaggacaatc

SEQ ID NO: 8113 - DNA, 20 bp, Artificial
  CRISPR gRNA sequence
agcccagaaaaggacaatca

SEQ ID NO: 8114 - DNA, 20 bp, Artificial
  CRISPR gRNA sequence
gcccagaaaaggacaatcaa

SEQ ID NO: 8115 - DNA, 20 bp, Artificial
  CRISPR gRNA sequence
agaaaaggacaatcaagggc

SEQ ID NO: 8116 - DNA, 20 bp, Artificial
  CRISPR gRNA sequence
aaaaggacaatcaagggcaa

SEQ ID NO: 8117 - DNA, 20 bp, Artificial
  CRISPR gRNA sequence
caatatcacccattcatcat

SEQ ID NO: 8118 - DNA, 20 bp, Artificial
  CRISPR gRNA sequence
ccattcatcatgagccacgt

SEQ ID NO: 8119 - DNA, 20 bp, Artificial
  CRISPR gRNA sequence
gccacgtcagtcccctccca

SEQ ID NO: 8120 - DNA, 20 bp, Artificial
  CRISPR gRNA sequence
cctcccacagaaatcattgc

SEQ ID NO: 8121 - DNA, 20 bp, Artificial
  CRISPR gRNA sequence
ctcccacagaaatcattgca

SEQ ID NO: 8122 - DNA, 20 bp, Artificial
  CRISPR gRNA sequence
tcccacagaaatcattgcaa

SEQ ID NO: 8123 - DNA, 20 bp, Artificial
  CRISPR gRNA sequence
cccacagaaatcattgcaag

SEQ ID NO: 8124 - DNA, 20 bp, Artificial
  CRISPR gRNA sequence
ccacagaaatcattgcaagg

SEQ ID NO: 8125 - DNA, 20 bp, Artificial
  CRISPR gRNA sequence
aaatcattgcaagggggatg

SEQ ID NO: 8126 - DNA, 20 bp, Artificial
  CRISPR gRNA sequence
atcattgcaagggggatgcg

SEQ ID NO: 8127 - DNA, 20 bp, Artificial
  CRISPR gRNA sequence
gcaagggggatgcggagcaa

SEQ ID NO: 8128 - DNA, 20 bp, Artificial
  CRISPR gRNA sequence
gggggatgcggagcaatggc

SEQ ID NO: 8129 - DNA, 20 bp, Artificial
  CRISPR gRNA sequence
gggatgcggagcaatggctg

SEQ ID NO: 8130 - DNA, 20 bp, Artificial
  CRISPR gRNA sequence
ggatgcggagcaatggctgg

SEQ ID NO: 8131 - DNA, 20 bp, Artificial
  CRISPR gRNA sequence
cggagcaatggctggaggaa

SEQ ID NO: 8132 - DNA, 20 bp, Artificial
  CRISPR gRNA sequence
gagcaatggctggaggaacg

SEQ ID NO: 8133 - DNA, 20 bp, Artificial
  CRISPR gRNA sequence
ggctggaggaacggagactc

SEQ ID NO: 8134 - DNA, 20 bp, Artificial
  CRISPR gRNA sequence
gctggaggaacggagactcc

SEQ ID NO: 8135 - DNA, 20 bp, Artificial
  CRISPR gRNA sequence
ctggaggaacggagactcca

SEQ ID NO: 8136 - DNA, 20 bp, Artificial
  CRISPR gRNA sequence
gaggaacggagactccaggg

SEQ ID NO: 8137 - DNA, 20 bp, Artificial
  CRISPR gRNA sequence
ggaacggagactccagggaa

SEQ ID NO: 8138 - DNA, 20 bp, Artificial
  CRISPR gRNA sequence
aacggagactccagggaaga

SEQ ID NO: 8139 - DNA, 20 bp, Artificial
  CRISPR gRNA sequence
acggagactccagggaagag

SEQ ID NO: 8140 - DNA, 20 bp, Artificial
  CRISPR gRNA sequence
cggagactccagggaagaga

SEQ ID NO: 8141 - DNA, 20 bp, Artificial
  CRISPR gRNA sequence
ggagactccagggaagagag

SEQ ID NO: 8142 - DNA, 20 bp, Artificial
  CRISPR gRNA sequence
agactccagggaagagaggg

SEQ ID NO: 8143 - DNA, 20 bp, Artificial
  CRISPR gRNA sequence
tccagggaagagaggggaga

SEQ ID NO: 8144 - DNA, 20 bp, Artificial
  CRISPR gRNA sequence
cagggaagagaggggagatg

SEQ ID NO: 8145 - DNA, 20 bp, Artificial
  CRISPR gRNA sequence
agggaagagaggggagatgg

SEQ ID NO: 8146 - DNA, 20 bp, Artificial
  CRISPR gRNA sequence
aagagaggggagatggaggc

SEQ ID NO: 8147 - DNA, 20 bp, Artificial
  CRISPR gRNA sequence
agaggggagatggaggccag

SEQ ID NO: 8148 - DNA, 20 bp, Artificial
  CRISPR gRNA sequence
gaggggagatggaggccagt

SEQ ID NO: 8149 - DNA, 20 bp, Artificial
  CRISPR gRNA sequence
aggggagatggaggccagtg

SEQ ID NO: 8150 - DNA, 20 bp, Artificial
  CRISPR gRNA sequence
ggggagatggaggccagtgg

SEQ ID NO: 8151 - DNA, 20 bp, Artificial
  CRISPR gRNA sequence
atggaggccagtgggggaaa

SEQ ID NO: 8152 - DNA, 20 bp, Artificial
  CRISPR gRNA sequence
tggaggccagtgggggaaat

SEQ ID NO: 8153 - DNA, 20 bp, Artificial
  CRISPR gRNA sequence
ccccttcactaatgaccacc

SEQ ID NO: 8154 - DNA, 20 bp, Artificial
  CRISPR gRNA sequence
ttctgtccatcctttctaca

SEQ ID NO: 8155 - DNA, 20 bp, Artificial
  CRISPR gRNA sequence
acccctttcccttttcctcc

SEQ ID NO: 8156 - DNA, 20 bp, Artificial
  CRISPR gRNA sequence
cccttttcctcccagctcct

SEQ ID NO: 8157 - DNA, 20 bp, Artificial
  CRISPR gRNA sequence
ttcctcccagctccttagcc

SEQ ID NO: 8158 - DNA, 20 bp, Artificial
  CRISPR gRNA sequence
gctccttagccaagctactc

SEQ ID NO: 8159 - DNA, 20 bp, Artificial
  CRISPR gRNA sequence
actctagtatttgtaataac

SEQ ID NO: 8160 - DNA, 20 bp, Artificial
  CRISPR gRNA sequence
ttgtaataactagcatttac

SEQ ID NO: 8161 - DNA, 20 bp, Artificial
  CRISPR gRNA sequence
tagcatttactggatactca

SEQ ID NO: 8162 - DNA, 20 bp, Artificial
  CRISPR gRNA sequence
gctgtccatacattatcatc

SEQ ID NO: 8163 - DNA, 20 bp, Artificial
  CRISPR gRNA sequence
ctggaatccttacaacaaca

SEQ ID NO: 8164 - DNA, 20 bp, Artificial
  CRISPR gRNA sequence
tggaatccttacaacaacaa

SEQ ID NO: 8165 - DNA, 20 bp, Artificial
  CRISPR gRNA sequence
acaaaggaaatacatattat

SEQ ID NO: 8166 - DNA, 20 bp, Artificial
  CRISPR gRNA sequence
agtttctgtcttttacaaat

SEQ ID NO: 8167 - DNA, 20 bp, Artificial
  CRISPR gRNA sequence
gtttctgtcttttacaaatg

SEQ ID NO: 8168 - DNA, 20 bp, Artificial
  CRISPR gRNA sequence
cttttacaaatgaggaaatt

SEQ ID NO: 8169 - DNA, 20 bp, Artificial
  CRISPR gRNA sequence
ttttacaaatgaggaaattg

SEQ ID NO: 8170 - DNA, 20 bp, Artificial
  CRISPR gRNA sequence
caaatgaggaaattgaggtt

SEQ ID NO: 8171 - DNA, 20 bp, Artificial
  CRISPR gRNA sequence
aatgaggaaattgaggttta

SEQ ID NO: 8172 - DNA, 20 bp, Artificial
  CRISPR gRNA sequence
tgaggaaattgaggtttaga

SEQ ID NO: 8173 - DNA, 20 bp, Artificial
  CRISPR gRNA sequence
gaggaaattgaggtttagag

SEQ ID NO: 8174 - DNA, 20 bp, Artificial
  CRISPR gRNA sequence
agaggtgaaacgacctaccc

SEQ ID NO: 8175 - DNA, 20 bp, Artificial
  CRISPR gRNA sequence
cgacctacccaagtttgcat

SEQ ID NO: 8176 - DNA, 20 bp, Artificial
  CRISPR gRNA sequence
acctacccaagtttgcatta

SEQ ID NO: 8177 - DNA, 20 bp, Artificial
  CRISPR gRNA sequence
acccaagtttgcattagaga

SEQ ID NO: 8178 - DNA, 20 bp, Artificial
  CRISPR gRNA sequence
gcattagagatagtaatgta

SEQ ID NO: 8179 - DNA, 20 bp, Artificial
  CRISPR gRNA sequence
acagatctgaaattctaacc

SEQ ID NO: 8180 - DNA, 20 bp, Artificial
  CRISPR gRNA sequence
cagatctgaaattctaacct

SEQ ID NO: 8181 - DNA, 20 bp, Artificial
  CRISPR gRNA sequence
cctaggtctttctcgtttca

SEQ ID NO: 8182 - DNA, 20 bp, Artificial
  CRISPR gRNA sequence
tccatttttaaccacaaaaa

SEQ ID NO: 8183 - DNA, 20 bp, Artificial
  CRISPR gRNA sequence
tttttaaccacaaaaaaaga

SEQ ID NO: 8184 - DNA, 20 bp, Artificial
  CRISPR gRNA sequence
ccacaaaaaaagaaagtgtc

SEQ ID NO: 8185 - DNA, 20 bp, Artificial
  CRISPR gRNA sequence
cacaaaaaaagaaagtgtct

SEQ ID NO: 8186 - DNA, 20 bp, Artificial
  CRISPR gRNA sequence
acaaaaaaagaaagtgtctg

SEQ ID NO: 8187 - DNA, 20 bp, Artificial
  CRISPR gRNA sequence
aaaaagaaagtgtctggggt

SEQ ID NO: 8188 - DNA, 20 bp, Artificial
  CRISPR gRNA sequence
aagaaagtgtctggggttgg

SEQ ID NO: 8189 - DNA, 20 bp, Artificial
  CRISPR gRNA sequence
ctggggttggaagatttgct

SEQ ID NO: 8190 - DNA, 20 bp, Artificial
  CRISPR gRNA sequence
tggggttggaagatttgcta

SEQ ID NO: 8191 - DNA, 20 bp, Artificial
  CRISPR gRNA sequence
tggaagatttgctaaggctt

SEQ ID NO: 8192 - DNA, 20 bp, Artificial
  CRISPR gRNA sequence
aagatttgctaaggcttaag

SEQ ID NO: 8193 - DNA, 20 bp, Artificial
  CRISPR gRNA sequence
gatttgctaaggcttaagca

SEQ ID NO: 8194 - DNA, 20 bp, Artificial
  CRISPR gRNA sequence
ttgctaaggcttaagcagag

SEQ ID NO: 8195 - DNA, 20 bp, Artificial
  CRISPR gRNA sequence
taagcagagaagctaatttg

SEQ ID NO: 8196 - DNA, 20 bp, Artificial
  CRISPR gRNA sequence
agaagctaatttgtagcctt

SEQ ID NO: 8197 - DNA, 20 bp, Artificial
  CRISPR gRNA sequence
agctaatttgtagccttaag

SEQ ID NO: 8198 - DNA, 20 bp, Artificial
  CRISPR gRNA sequence
ctaatttgtagccttaagaa

SEQ ID NO: 8199 - DNA, 20 bp, Artificial
  CRISPR gRNA sequence
tgtagccttaagaagagcta

SEQ ID NO: 8200 - DNA, 20 bp, Artificial
  CRISPR gRNA sequence
ttaagaagagctacagcttt

SEQ ID NO: 8201 - DNA, 20 bp, Artificial
  CRISPR gRNA sequence
aagagctacagctttcagac

SEQ ID NO: 8202 - DNA, 20 bp, Artificial
  CRISPR gRNA sequence
agagctacagctttcagaca

SEQ ID NO: 8203 - DNA, 20 bp, Artificial
  CRISPR gRNA sequence
gagctacagctttcagacaa

SEQ ID NO: 8204 - DNA, 20 bp, Artificial
  CRISPR gRNA sequence
ctacagctttcagacaaggg

SEQ ID NO: 8205 - DNA, 20 bp, Artificial
  CRISPR gRNA sequence
tacagctttcagacaagggc

SEQ ID NO: 8206 - DNA, 20 bp, Artificial
  CRISPR gRNA sequence
tcagacaagggcaggactct

SEQ ID NO: 8207 - DNA, 20 bp, Artificial
  CRISPR gRNA sequence
cagacaagggcaggactctt

SEQ ID NO: 8208 - DNA, 20 bp, Artificial
  CRISPR gRNA sequence
agacaagggcaggactcttg

SEQ ID NO: 8209 - DNA, 20 bp, Artificial
  CRISPR gRNA sequence
acaagggcaggactcttggg

SEQ ID NO: 8210 - DNA, 20 bp, Artificial
  CRISPR gRNA sequence
aagggcaggactcttgggga

SEQ ID NO: 8211 - DNA, 20 bp, Artificial
  CRISPR gRNA sequence
agggcaggactcttggggag

SEQ ID NO: 8212 - DNA, 20 bp, Artificial
  CRISPR gRNA sequence
gcaggactcttggggagagg

SEQ ID NO: 8213 - DNA, 20 bp, Artificial
  CRISPR gRNA sequence
ggactcttggggagaggtgg

SEQ ID NO: 8214 - DNA, 20 bp, Artificial
  CRISPR gRNA sequence
ctcttggggagaggtggtgg

SEQ ID NO: 8215 - DNA, 20 bp, Artificial
  CRISPR gRNA sequence
ggtggtggtggtgttgctgc

SEQ ID NO: 8216 - DNA, 20 bp, Artificial
  CRISPR gRNA sequence
ggtggtggtgttgctgctag

SEQ ID NO: 8217 - DNA, 20 bp, Artificial
  CRISPR gRNA sequence
gctgctagtggtttgttttt

SEQ ID NO: 8218 - DNA, 20 bp, Artificial
  CRISPR gRNA sequence
ctgctagtggtttgtttttt

SEQ ID NO: 8219 - DNA, 20 bp, Artificial
  CRISPR gRNA sequence
tgctagtggtttgttttttg

SEQ ID NO: 8220 - DNA, 20 bp, Artificial
  CRISPR gRNA sequence
gctagtggtttgttttttgg

SEQ ID NO: 8221 - DNA, 20 bp, Artificial
  CRISPR gRNA sequence
tagtggtttgttttttgggg

SEQ ID NO: 8222 - DNA, 20 bp, Artificial
  CRISPR gRNA sequence
gtggtttgttttttggggga

SEQ ID NO: 8223 - DNA, 20 bp, Artificial
  CRISPR gRNA sequence
tgttttttgggggagagacg

SEQ ID NO: 8224 - DNA, 20 bp, Artificial
  CRISPR gRNA sequence
gttttttgggggagagacgt

SEQ ID NO: 8225 - DNA, 20 bp, Artificial
  CRISPR gRNA sequence
tttgggggagagacgtggga

SEQ ID NO: 8226 - DNA, 20 bp, Artificial
  CRISPR gRNA sequence
tgggggagagacgtgggata

SEQ ID NO: 8227 - DNA, 20 bp, Artificial
  CRISPR gRNA sequence
gatagagaatctcttctcac

SEQ ID NO: 8228 - DNA, 20 bp, Artificial
  CRISPR gRNA sequence
agcatcaccaccacctcata

SEQ ID NO: 8229 - DNA, 20 bp, Artificial
  CRISPR gRNA sequence
catcaccaccacctcataca

SEQ ID NO: 8230 - DNA, 20 bp, Artificial
  CRISPR gRNA sequence
atacagagcctatgttgaaa

SEQ ID NO: 8231 - DNA, 20 bp, Artificial
  CRISPR gRNA sequence
gcctatgttgaaatagaaaa

SEQ ID NO: 8232 - DNA, 20 bp, Artificial
  CRISPR gRNA sequence
tatgttgaaatagaaaaaag

SEQ ID NO: 8233 - DNA, 20 bp, Artificial
  CRISPR gRNA sequence
agaaaaaagtggcctttttc

SEQ ID NO: 8234 - DNA, 20 bp, Artificial
  CRISPR gRNA sequence
aaaaaagtggcctttttctg

SEQ ID NO: 8235 - DNA, 20 bp, Artificial
  CRISPR gRNA sequence
aaaaagtggcctttttctgg

SEQ ID NO: 8236 - DNA, 20 bp, Artificial
  CRISPR gRNA sequence
tggcctttttctggaggatg

SEQ ID NO: 8237 - DNA, 20 bp, Artificial
  CRISPR gRNA sequence
ctggaggatgcagcccctac

SEQ ID NO: 8238 - DNA, 20 bp, Artificial
  CRISPR gRNA sequence
tggaggatgcagcccctacc

SEQ ID NO: 8239 - DNA, 20 bp, Artificial
  CRISPR gRNA sequence
aggatgcagcccctaccagg

SEQ ID NO: 8240 - DNA, 20 bp, Artificial
  CRISPR gRNA sequence
cctaccaggaagtaactgct

SEQ ID NO: 8241 - DNA, 20 bp, Artificial
  CRISPR gRNA sequence
ccaggaagtaactgcttggc

SEQ ID NO: 8242 - DNA, 20 bp, Artificial
  CRISPR gRNA sequence
aagtaactgcttggctagca

SEQ ID NO: 8243 - DNA, 20 bp, Artificial
  CRISPR gRNA sequence
ctgcttggctagcaaagtgc

SEQ ID NO: 8244 - DNA, 20 bp, Artificial
  CRISPR gRNA sequence
ttggctagcaaagtgcaagc

SEQ ID NO: 8245 - DNA, 20 bp, Artificial
  CRISPR gRNA sequence
ggctagcaaagtgcaagccg

SEQ ID NO: 8246 - DNA, 20 bp, Artificial
  CRISPR gRNA sequence
cctgcccccattttccttgt

SEQ ID NO: 8247 - DNA, 20 bp, Artificial
  CRISPR gRNA sequence
ccccattttccttgttggct

SEQ ID NO: 8248 - DNA, 20 bp, Artificial
  CRISPR gRNA sequence
cccattttccttgttggctt

SEQ ID NO: 8249 - DNA, 20 bp, Artificial
  CRISPR gRNA sequence
ttggcttgggcacctgtgtg

SEQ ID NO: 8250 - DNA, 20 bp, Artificial
  CRISPR gRNA sequence
acaacctgcaaaactcttct

SEQ ID NO: 8251 - DNA, 20 bp, Artificial
  CRISPR gRNA sequence
acctgcaaaactcttcttag

SEQ ID NO: 8252 - DNA, 20 bp, Artificial
  CRISPR gRNA sequence
tggtcttcttcctgccaacc

SEQ ID NO: 8253 - DNA, 20 bp, Artificial
  CRISPR gRNA sequence
ggtcttcttcctgccaaccc

SEQ ID NO: 8254 - DNA, 20 bp, Artificial
  CRISPR gRNA sequence
tcttcctgccaacccaggaa

SEQ ID NO: 8255 - DNA, 20 bp, Artificial
  CRISPR gRNA sequence
tcctgccaacccaggaacag

SEQ ID NO: 8256 - DNA, 20 bp, Artificial
  CRISPR gRNA sequence
aacccaggaacagcagcatt

SEQ ID NO: 8257 - DNA, 20 bp, Artificial
  CRISPR gRNA sequence
ccaggaacagcagcattcag

SEQ ID NO: 8258 - DNA, 20 bp, Artificial
  CRISPR gRNA sequence
ttctgtgcttgatccaaatg

SEQ ID NO: 8259 - DNA, 20 bp, Artificial
  CRISPR gRNA sequence
aaatgtggccaatttttccc

SEQ ID NO: 8260 - DNA, 20 bp, Artificial
  CRISPR gRNA sequence
atgtggccaatttttcccca

SEQ ID NO: 8261 - DNA, 20 bp, Artificial
  CRISPR gRNA sequence
gccaatttttccccagagca

SEQ ID NO: 8262 - DNA, 20 bp, Artificial
  CRISPR gRNA sequence
agtgtattgaaaatcatacc

SEQ ID NO: 8263 - DNA, 20 bp, Artificial
  CRISPR gRNA sequence
gtgtattgaaaatcatacca

SEQ ID NO: 8264 - DNA, 20 bp, Artificial
  CRISPR gRNA sequence
tattgaaaatcataccaagg

SEQ ID NO: 8265 - DNA, 20 bp, Artificial
  CRISPR gRNA sequence
aatcataccaaggaagaaaa

SEQ ID NO: 8266 - DNA, 20 bp, Artificial
  CRISPR gRNA sequence
tcataccaaggaagaaaatg

SEQ ID NO: 8267 - DNA, 20 bp, Artificial
  CRISPR gRNA sequence
cataccaaggaagaaaatgg

SEQ ID NO: 8268 - DNA, 20 bp, Artificial
  CRISPR gRNA sequence
ataccaaggaagaaaatgga

SEQ ID NO: 8269 - DNA, 20 bp, Artificial
  CRISPR gRNA sequence
taccaaggaagaaaatggag

SEQ ID NO: 8270 - DNA, 20 bp, Artificial
  CRISPR gRNA sequence
aggaagaaaatggaggggac

SEQ ID NO: 8271 - DNA, 20 bp, Artificial
  CRISPR gRNA sequence
actagtaattgttcatgttt

SEQ ID NO: 8272 - DNA, 20 bp, Artificial
  CRISPR gRNA sequence
tgttcatgtttcagaaatta

SEQ ID NO: 8273 - DNA, 20 bp, Artificial
  CRISPR gRNA sequence
gtttcagaaattacagaact

SEQ ID NO: 8274 - DNA, 20 bp, Artificial
  CRISPR gRNA sequence
ttcagaaattacagaactga

SEQ ID NO: 8275 - DNA, 20 bp, Artificial
  CRISPR gRNA sequence
tgactgcttccttcccttcc

SEQ ID NO: 8276 - DNA, 20 bp, Artificial
  CRISPR gRNA sequence
gactgcttccttcccttcct

SEQ ID NO: 8277 - DNA, 20 bp, Artificial
  CRISPR gRNA sequence
actgcttccttcccttcctg

SEQ ID NO: 8278 - DNA, 20 bp, Artificial
  CRISPR gRNA sequence
tcccttcctggggatttaca

SEQ ID NO: 8279 - DNA, 20 bp, Artificial
  CRISPR gRNA sequence
cccttcctggggatttacat

SEQ ID NO: 8280 - DNA, 20 bp, Artificial
  CRISPR gRNA sequence
ccttcctggggatttacatg

SEQ ID NO: 8281 - DNA, 20 bp, Artificial
  CRISPR gRNA sequence
cttcctggggatttacatgg

SEQ ID NO: 8282 - DNA, 20 bp, Artificial
  CRISPR gRNA sequence
cctggggatttacatggggg

SEQ ID NO: 8283 - DNA, 20 bp, Artificial
  CRISPR gRNA sequence
ggggatttacatgggggaag

SEQ ID NO: 8284 - DNA, 20 bp, Artificial
  CRISPR gRNA sequence
gatttacatgggggaagcag

SEQ ID NO: 8285 - DNA, 20 bp, Artificial
  CRISPR gRNA sequence
atgggggaagcagaagtgat

SEQ ID NO: 8286 - DNA, 20 bp, Artificial
  CRISPR gRNA sequence
tgggggaagcagaagtgatt

SEQ ID NO: 8287 - DNA, 20 bp, Artificial
  CRISPR gRNA sequence
gggggaagcagaagtgattg

SEQ ID NO: 8288 - DNA, 20 bp, Artificial
  CRISPR gRNA sequence
aagcagaagtgattggggct

SEQ ID NO: 8289 - DNA, 20 bp, Artificial
  CRISPR gRNA sequence
agcagaagtgattggggctg

SEQ ID NO: 8290 - DNA, 20 bp, Artificial
  CRISPR gRNA sequence
cattcacatttcctcacaac

SEQ ID NO: 8291 - DNA, 20 bp, Artificial
  CRISPR gRNA sequence
ttcacatttcctcacaactg

SEQ ID NO: 8292 - DNA, 20 bp, Artificial
  CRISPR gRNA sequence
tcacatttcctcacaactgg

SEQ ID NO: 8293 - DNA, 20 bp, Artificial
  CRISPR gRNA sequence
catttcctcacaactggagg

SEQ ID NO: 8294 - DNA, 20 bp, Artificial
  CRISPR gRNA sequence
cacaactggaggcagtcatt

SEQ ID NO: 8295 - DNA, 20 bp, Artificial
  CRISPR gRNA sequence
acaactggaggcagtcatta

SEQ ID NO: 8296 - DNA, 20 bp, Artificial
  CRISPR gRNA sequence
ggaggcagtcattaaggatt

SEQ ID NO: 8297 - DNA, 20 bp, Artificial
  CRISPR gRNA sequence
gaggcagtcattaaggattt

SEQ ID NO: 8298 - DNA, 20 bp, Artificial
  CRISPR gRNA sequence
ttaaggatttgggcatgtca

SEQ ID NO: 8299 - DNA, 20 bp, Artificial
  CRISPR gRNA sequence
taaggatttgggcatgtcat

SEQ ID NO: 8300 - DNA, 20 bp, Artificial
  CRISPR gRNA sequence
tttgggcatgtcataggatt

SEQ ID NO: 8301 - DNA, 20 bp, Artificial
  CRISPR gRNA sequence
ttgggcatgtcataggattt

SEQ ID NO: 8302 - DNA, 20 bp, Artificial
  CRISPR gRNA sequence
tgggtgtttttctcccccct

SEQ ID NO: 8303 - DNA, 20 bp, Artificial
  CRISPR gRNA sequence
gtgtttttctccccccttag

SEQ ID NO: 8304 - DNA, 20 bp, Artificial
  CRISPR gRNA sequence
cccccttagtggcatctcca

SEQ ID NO: 8305 - DNA, 20 bp, Artificial
  CRISPR gRNA sequence
ccccttagtggcatctccac

SEQ ID NO: 8306 - DNA, 20 bp, Artificial
  CRISPR gRNA sequence
cttagtggcatctccacagg

SEQ ID NO: 8307 - DNA, 20 bp, Artificial
  CRISPR gRNA sequence
ggcatctccacaggcagcga

SEQ ID NO: 8308 - DNA, 20 bp, Artificial
  CRISPR gRNA sequence
acaggcagcgaaagctgtct

SEQ ID NO: 8309 - DNA, 20 bp, Artificial
  CRISPR gRNA sequence
gcgaaagctgtctaagcaaa

SEQ ID NO: 8310 - DNA, 20 bp, Artificial
  CRISPR gRNA sequence
cgaaagctgtctaagcaaat

SEQ ID NO: 8311 - DNA, 20 bp, Artificial
  CRISPR gRNA sequence
agctgtctaagcaaataggt

SEQ ID NO: 8312 - DNA, 20 bp, Artificial
  CRISPR gRNA sequence
gctgtctaagcaaataggtg

SEQ ID NO: 8313 - DNA, 20 bp, Artificial
  CRISPR gRNA sequence
gtctaagcaaataggtgagg

SEQ ID NO: 8314 - DNA, 20 bp, Artificial
  CRISPR gRNA sequence
aaataggtgaggcagtgcgt

SEQ ID NO: 8315 - DNA, 20 bp, Artificial
  CRISPR gRNA sequence
aaaacaacatacctgacact

SEQ ID NO: 8316 - DNA, 20 bp, Artificial
  CRISPR gRNA sequence
ctgacactgagtaatttata

SEQ ID NO: 8317 - DNA, 20 bp, Artificial
  CRISPR gRNA sequence
aagaaaaaaaatatttctta

SEQ ID NO: 8318 - DNA, 20 bp, Artificial
  CRISPR gRNA sequence
aaaaatatttcttacagtta

SEQ ID NO: 8319 - DNA, 20 bp, Artificial
  CRISPR gRNA sequence
aaatatttcttacagttatg

SEQ ID NO: 8320 - DNA, 20 bp, Artificial
  CRISPR gRNA sequence
aatatttcttacagttatgg

SEQ ID NO: 8321 - DNA, 20 bp, Artificial
  CRISPR gRNA sequence
ttcttacagttatggaggct

SEQ ID NO: 8322 - DNA, 20 bp, Artificial
  CRISPR gRNA sequence
ttacagttatggaggctgag

SEQ ID NO: 8323 - DNA, 20 bp, Artificial
  CRISPR gRNA sequence
ttatggaggctgagaagtcc

SEQ ID NO: 8324 - DNA, 20 bp, Artificial
  CRISPR gRNA sequence
tatggaggctgagaagtcca

SEQ ID NO: 8325 - DNA, 20 bp, Artificial
  CRISPR gRNA sequence
gaggctgagaagtccaaggt

SEQ ID NO: 8326 - DNA, 20 bp, Artificial
  CRISPR gRNA sequence
aggctgagaagtccaaggtt

SEQ ID NO: 8327 - DNA, 20 bp, Artificial
  CRISPR gRNA sequence
ggctgagaagtccaaggtta

SEQ ID NO: 8328 - DNA, 20 bp, Artificial
  CRISPR gRNA sequence
gctgagaagtccaaggttag

SEQ ID NO: 8329 - DNA, 20 bp, Artificial
  CRISPR gRNA sequence
ccaaggttaggggctgcatc

SEQ ID NO: 8330 - DNA, 20 bp, Artificial
  CRISPR gRNA sequence
ggttaggggctgcatctggt

SEQ ID NO: 8331 - DNA, 20 bp, Artificial
  CRISPR gRNA sequence
gttaggggctgcatctggtg

SEQ ID NO: 8332 - DNA, 20 bp, Artificial
  CRISPR gRNA sequence
ttaggggctgcatctggtga

SEQ ID NO: 8333 - DNA, 20 bp, Artificial
  CRISPR gRNA sequence
tctggtgagggccttcttac

SEQ ID NO: 8334 - DNA, 20 bp, Artificial
  CRISPR gRNA sequence
gtgagggccttcttactggt

SEQ ID NO: 8335 - DNA, 20 bp, Artificial
  CRISPR gRNA sequence
tgagggccttcttactggtg

SEQ ID NO: 8336 - DNA, 20 bp, Artificial
  CRISPR gRNA sequence
ttactggtgaggactctctg

SEQ ID NO: 8337 - DNA, 20 bp, Artificial
  CRISPR gRNA sequence
actggtgaggactctctgca

SEQ ID NO: 8338 - DNA, 20 bp, Artificial
  CRISPR gRNA sequence
aggactctctgcagagtccc

SEQ ID NO: 8339 - DNA, 20 bp, Artificial
  CRISPR gRNA sequence
ggactctctgcagagtccca

SEQ ID NO: 8340 - DNA, 20 bp, Artificial
  CRISPR gRNA sequence
ctctctgcagagtcccaagg

SEQ ID NO: 8341 - DNA, 20 bp, Artificial
  CRISPR gRNA sequence
tgcagagtcccaaggcagtg

SEQ ID NO: 8342 - DNA, 20 bp, Artificial
  CRISPR gRNA sequence
gcagagtcccaaggcagtgt

SEQ ID NO: 8343 - DNA, 20 bp, Artificial
  CRISPR gRNA sequence
cagagtcccaaggcagtgtg

SEQ ID NO: 8344 - DNA, 20 bp, Artificial
  CRISPR gRNA sequence
aaggcagtgtggggcatcac

SEQ ID NO: 8345 - DNA, 20 bp, Artificial
  CRISPR gRNA sequence
aggcagtgtggggcatcacg

SEQ ID NO: 8346 - DNA, 20 bp, Artificial
  CRISPR gRNA sequence
agtgtggggcatcacgaggc

SEQ ID NO: 8347 - DNA, 20 bp, Artificial
  CRISPR gRNA sequence
tgtggggcatcacgaggcaa

SEQ ID NO: 8348 - DNA, 20 bp, Artificial
  CRISPR gRNA sequence
gtggggcatcacgaggcaag

SEQ ID NO: 8349 - DNA, 20 bp, Artificial
  CRISPR gRNA sequence
catcacgaggcaagaggttt

SEQ ID NO: 8350 - DNA, 20 bp, Artificial
  CRISPR gRNA sequence
ggcaagaggtttcggtgtga

SEQ ID NO: 8351 - DNA, 20 bp, Artificial
  CRISPR gRNA sequence
tcctcttctcataaaaccac

SEQ ID NO: 8352 - DNA, 20 bp, Artificial
  CRISPR gRNA sequence
tttatccactaatccatgaa

SEQ ID NO: 8353 - DNA, 20 bp, Artificial
  CRISPR gRNA sequence
aacggattaacccattcatc

SEQ ID NO: 8354 - DNA, 20 bp, Artificial
  CRISPR gRNA sequence
acggattaacccattcatca

SEQ ID NO: 8355 - DNA, 20 bp, Artificial
  CRISPR gRNA sequence
ttaacccattcatcaaggaa

SEQ ID NO: 8356 - DNA, 20 bp, Artificial
  CRISPR gRNA sequence
cattcatcaaggaaaagccc

SEQ ID NO: 8357 - DNA, 20 bp, Artificial
  CRISPR gRNA sequence
aaagccccagtcacctctta

SEQ ID NO: 8358 - DNA, 20 bp, Artificial
  CRISPR gRNA sequence
aagccccagtcacctcttaa

SEQ ID NO: 8359 - DNA, 20 bp, Artificial
  CRISPR gRNA sequence
cacctctcaatactgccaca

SEQ ID NO: 8360 - DNA, 20 bp, Artificial
  CRISPR gRNA sequence
acctctcaatactgccacat

SEQ ID NO: 8361 - DNA, 20 bp, Artificial
  CRISPR gRNA sequence
cctctcaatactgccacata

SEQ ID NO: 8362 - DNA, 20 bp, Artificial
  CRISPR gRNA sequence
ctctcaatactgccacatag

SEQ ID NO: 8363 - DNA, 20 bp, Artificial
  CRISPR gRNA sequence
aggggattacatttatacat

SEQ ID NO: 8364 - DNA, 20 bp, Artificial
  CRISPR gRNA sequence
ttacatttatacatgagttt

SEQ ID NO: 8365 - DNA, 20 bp, Artificial
  CRISPR gRNA sequence
acatttatacatgagttttg

SEQ ID NO: 8366 - DNA, 20 bp, Artificial
  CRISPR gRNA sequence
tttatacatgagttttggag

SEQ ID NO: 8367 - DNA, 20 bp, Artificial
  CRISPR gRNA sequence
gacaaacattcacgtcataa

SEQ ID NO: 8368 - DNA, 20 bp, Artificial
  CRISPR gRNA sequence
acaaacattcacgtcataac

SEQ ID NO: 8369 - DNA, 20 bp, Artificial
  CRISPR gRNA sequence
aacattcacgtcataacagg

SEQ ID NO: 8370 - DNA, 20 bp, Artificial
  CRISPR gRNA sequence
cataacaggcagcttcaccc

SEQ ID NO: 8371 - DNA, 20 bp, Artificial
  CRISPR gRNA sequence
ttcacccaagtctgctcctc

SEQ ID NO: 8372 - DNA, 20 bp, Artificial
  CRISPR gRNA sequence
aagtctgctcctcaagtctg

SEQ ID NO: 8373 - DNA, 20 bp, Artificial
  CRISPR gRNA sequence
agtctgctcctcaagtctgt

SEQ ID NO: 8374 - DNA, 20 bp, Artificial
  CRISPR gRNA sequence
gtgggttttctctctgcttc

SEQ ID NO: 8375 - DNA, 20 bp, Artificial
  CRISPR gRNA sequence
ggttttctctctgcttctgg

SEQ ID NO: 8376 - DNA, 20 bp, Artificial
  CRISPR gRNA sequence
gttttctctctgcttctgga

SEQ ID NO: 8377 - DNA, 20 bp, Artificial
  CRISPR gRNA sequence
ctctctgcttctggaaggtg

SEQ ID NO: 8378 - DNA, 20 bp, Artificial
  CRISPR gRNA sequence
tgcttctggaaggtgaagcc

SEQ ID NO: 8379 - DNA, 20 bp, Artificial
  CRISPR gRNA sequence
gcttctggaaggtgaagccc

SEQ ID NO: 8380 - DNA, 20 bp, Artificial
  CRISPR gRNA sequence
tggaaggtgaagcccaggcc

SEQ ID NO: 8381 - DNA, 20 bp, Artificial
  CRISPR gRNA sequence
ggaaggtgaagcccaggcct

SEQ ID NO: 8382 - DNA, 20 bp, Artificial
  CRISPR gRNA sequence
ggtgaagcccaggcctgggc

SEQ ID NO: 8383 - DNA, 20 bp, Artificial
  CRISPR gRNA sequence
cctgggcaagtattcttttg

SEQ ID NO: 8384 - DNA, 20 bp, Artificial
  CRISPR gRNA sequence
agcatcctgaaatatgacct

SEQ ID NO: 8385 - DNA, 20 bp, Artificial
  CRISPR gRNA sequence
tagcttctaaatgtgtaaaa

SEQ ID NO: 8386 - DNA, 20 bp, Artificial
  CRISPR gRNA sequence
gcttctaaatgtgtaaaatg

SEQ ID NO: 8387 - DNA, 20 bp, Artificial
  CRISPR gRNA sequence
aataatcacacccaccatca

SEQ ID NO: 8388 - DNA, 20 bp, Artificial
  CRISPR gRNA sequence
ataatcacacccaccatcac

SEQ ID NO: 8389 - DNA, 20 bp, Artificial
  CRISPR gRNA sequence
tcacacccaccatcacggga

SEQ ID NO: 8390 - DNA, 20 bp, Artificial
  CRISPR gRNA sequence
caccatcacgggatggttgt

SEQ ID NO: 8391 - DNA, 20 bp, Artificial
  CRISPR gRNA sequence
ggatggttgtaagactgaat

SEQ ID NO: 8392 - DNA, 20 bp, Artificial
  CRISPR gRNA sequence
tgaataagttacaatgtgta

SEQ ID NO: 8393 - DNA, 20 bp, Artificial
  CRISPR gRNA sequence
gttacaatgtgtaaagcatt

SEQ ID NO: 8394 - DNA, 20 bp, Artificial
  CRISPR gRNA sequence
aatgtgtaaagcatttagaa

SEQ ID NO: 8395 - DNA, 20 bp, Artificial
  CRISPR gRNA sequence
atgtgtaaagcatttagaaa

SEQ ID NO: 8396 - DNA, 20 bp, Artificial
  CRISPR gRNA sequence
atttagaaaaggaatttgca

SEQ ID NO: 8397 - DNA, 20 bp, Artificial
  CRISPR gRNA sequence
ttagaaaaggaatttgcaca

SEQ ID NO: 8398 - DNA, 20 bp, Artificial
  CRISPR gRNA sequence
aaaaggaatttgcacagagt

SEQ ID NO: 8399 - DNA, 20 bp, Artificial
  CRISPR gRNA sequence
atttgcacagagtaagcatt

SEQ ID NO: 8400 - DNA, 20 bp, Artificial
  CRISPR gRNA sequence
tgcacagagtaagcattcag

SEQ ID NO: 8401 - DNA, 20 bp, Artificial
  CRISPR gRNA sequence
agtaagcattcagtagatgt

SEQ ID NO: 8402 - DNA, 20 bp, Artificial
  CRISPR gRNA sequence
gtaagcattcagtagatgtt

SEQ ID NO: 8403 - DNA, 20 bp, Artificial
  CRISPR gRNA sequence
cattttcatcaccttcatta

SEQ ID NO: 8404 - DNA, 20 bp, Artificial
  CRISPR gRNA sequence
atggccatcattccattcct

SEQ ID NO: 8405 - DNA, 20 bp, Artificial
  CRISPR gRNA sequence
catcattccattcctcagct

SEQ ID NO: 8406 - DNA, 20 bp, Artificial
  CRISPR gRNA sequence
cattccattcctcagctcag

SEQ ID NO: 8407 - DNA, 20 bp, Artificial
  CRISPR gRNA sequence
ctcagctcagaagccttcta

SEQ ID NO: 8408 - DNA, 20 bp, Artificial
  CRISPR gRNA sequence
tccccattgcttataaaatc

SEQ ID NO: 8409 - DNA, 20 bp, Artificial
  CRISPR gRNA sequence
aatcaagtcctaactttccc

SEQ ID NO: 8410 - DNA, 20 bp, Artificial
  CRISPR gRNA sequence
taccaccgtcacctatctct

SEQ ID NO: 8411 - DNA, 20 bp, Artificial
  CRISPR gRNA sequence
accaccgtcacctatctctc

SEQ ID NO: 8412 - DNA, 20 bp, Artificial
  CRISPR gRNA sequence
ccaccgtcacctatctctca

SEQ ID NO: 8413 - DNA, 20 bp, Artificial
  CRISPR gRNA sequence
ttcctaaacatactctgaac

SEQ ID NO: 8414 - DNA, 20 bp, Artificial
  CRISPR gRNA sequence
ctcactctgccactgtgacc

SEQ ID NO: 8415 - DNA, 20 bp, Artificial
  CRISPR gRNA sequence
ctctgccactgtgacccaga

SEQ ID NO: 8416 - DNA, 20 bp, Artificial
  CRISPR gRNA sequence
gctatctgttctccttctcc

SEQ ID NO: 8417 - DNA, 20 bp, Artificial
  CRISPR gRNA sequence
cagactctgcctcatctttc

SEQ ID NO: 8418 - DNA, 20 bp, Artificial
  CRISPR gRNA sequence
agactctgcctcatctttca

SEQ ID NO: 8419 - DNA, 20 bp, Artificial
  CRISPR gRNA sequence
ctgcctcatctttcaaggcc

SEQ ID NO: 8420 - DNA, 20 bp, Artificial
  CRISPR gRNA sequence
catctttcaaggcctggttc

SEQ ID NO: 8421 - DNA, 20 bp, Artificial
  CRISPR gRNA sequence
atctttcaaggcctggttcc

SEQ ID NO: 8422 - DNA, 20 bp, Artificial
  CRISPR gRNA sequence
ggttccaggatcccttcctc

SEQ ID NO: 8423 - DNA, 20 bp, Artificial
  CRISPR gRNA sequence
gttccaggatcccttcctcc

SEQ ID NO: 8424 - DNA, 20 bp, Artificial
  CRISPR gRNA sequence
ccaggatcccttcctccagg

SEQ ID NO: 8425 - DNA, 20 bp, Artificial
  CRISPR gRNA sequence
ccaccatacaccttttttct

SEQ ID NO: 8426 - DNA, 20 bp, Artificial
  CRISPR gRNA sequence
ttttctcggacttcatgtca

SEQ ID NO: 8427 - DNA, 20 bp, Artificial
  CRISPR gRNA sequence
tgtcatggtgcctatattcc

SEQ ID NO: 8428 - DNA, 20 bp, Artificial
  CRISPR gRNA sequence
gtcatggtgcctatattcca

SEQ ID NO: 8429 - DNA, 20 bp, Artificial
  CRISPR gRNA sequence
tcatggtgcctatattccaa

SEQ ID NO: 8430 - DNA, 20 bp, Artificial
  CRISPR gRNA sequence
gcctatattccaagggctct

SEQ ID NO: 8431 - DNA, 20 bp, Artificial
  CRISPR gRNA sequence
gagccatgtacccctttata

SEQ ID NO: 8432 - DNA, 20 bp, Artificial
  CRISPR gRNA sequence
tatagttaccactatttact

SEQ ID NO: 8433 - DNA, 20 bp, Artificial
  CRISPR gRNA sequence
actgagtgcctactgtatac

SEQ ID NO: 8434 - DNA, 20 bp, Artificial
  CRISPR gRNA sequence
ctgtataccagctactgtgt

SEQ ID NO: 8435 - DNA, 20 bp, Artificial
  CRISPR gRNA sequence
agctactgtgttggatgctc

SEQ ID NO: 8436 - DNA, 20 bp, Artificial
  CRISPR gRNA sequence
tgtgttggatgctctagatg

SEQ ID NO: 8437 - DNA, 20 bp, Artificial
  CRISPR gRNA sequence
taattatcaccatcgattcc

SEQ ID NO: 8438 - DNA, 20 bp, Artificial
  CRISPR gRNA sequence
aattatcaccatcgattcct

SEQ ID NO: 8439 - DNA, 20 bp, Artificial
  CRISPR gRNA sequence
tatcaccatcgattcctggg

SEQ ID NO: 8440 - DNA, 20 bp, Artificial
  CRISPR gRNA sequence
caccatcgattcctgggtag

SEQ ID NO: 8441 - DNA, 20 bp, Artificial
  CRISPR gRNA sequence
accatcgattcctgggtagt

SEQ ID NO: 8442 - DNA, 20 bp, Artificial
  CRISPR gRNA sequence
cattatttattcatcttaca

SEQ ID NO: 8443 - DNA, 20 bp, Artificial
  CRISPR gRNA sequence
tttattcatcttacacagat

SEQ ID NO: 8444 - DNA, 20 bp, Artificial
  CRISPR gRNA sequence
atcttacacagatgagaaaa

SEQ ID NO: 8445 - DNA, 20 bp, Artificial
  CRISPR gRNA sequence
cttacacagatgagaaaatg

SEQ ID NO: 8446 - DNA, 20 bp, Artificial
  CRISPR gRNA sequence
ttacacagatgagaaaatgg

SEQ ID NO: 8447 - DNA, 20 bp, Artificial
  CRISPR gRNA sequence
gatgagaaaatggaggccca

SEQ ID NO: 8448 - DNA, 20 bp, Artificial
  CRISPR gRNA sequence
gagaaaatggaggcccacag

SEQ ID NO: 8449 - DNA, 20 bp, Artificial
  CRISPR gRNA sequence
gaggcccacagtggttaaat

SEQ ID NO: 8450 - DNA, 20 bp, Artificial
  CRISPR gRNA sequence
gcccacagtggttaaataag

SEQ ID NO: 8451 - DNA, 20 bp, Artificial
  CRISPR gRNA sequence
agtggttaaataagtagccc

SEQ ID NO: 8452 - DNA, 20 bp, Artificial
  CRISPR gRNA sequence
ataagtagcccaagattgca

SEQ ID NO: 8453 - DNA, 20 bp, Artificial
  CRISPR gRNA sequence
gtagcccaagattgcacagc

SEQ ID NO: 8454 - DNA, 20 bp, Artificial
  CRISPR gRNA sequence
gcccaagattgcacagctag

SEQ ID NO: 8455 - DNA, 20 bp, Artificial
  CRISPR gRNA sequence
cccaagattgcacagctagt

SEQ ID NO: 8456 - DNA, 20 bp, Artificial
  CRISPR gRNA sequence
ccaagattgcacagctagta

SEQ ID NO: 8457 - DNA, 20 bp, Artificial
  CRISPR gRNA sequence
gattgcacagctagtagggc

SEQ ID NO: 8458 - DNA, 20 bp, Artificial
  CRISPR gRNA sequence
tgcacagctagtagggctag

SEQ ID NO: 8459 - DNA, 20 bp, Artificial
  CRISPR gRNA sequence
cagctagtagggctagtgga

SEQ ID NO: 8460 - DNA, 20 bp, Artificial
  CRISPR gRNA sequence
ctagtagggctagtggaaag

SEQ ID NO: 8461 - DNA, 20 bp, Artificial
  CRISPR gRNA sequence
agtagggctagtggaaagta

SEQ ID NO: 8462 - DNA, 20 bp, Artificial
  CRISPR gRNA sequence
gtagggctagtggaaagtag

SEQ ID NO: 8463 - DNA, 20 bp, Artificial
  CRISPR gRNA sequence
gggctagtggaaagtagagg

SEQ ID NO: 8464 - DNA, 20 bp, Artificial
  CRISPR gRNA sequence
gaatttgaactcaaatcctg

SEQ ID NO: 8465 - DNA, 20 bp, Artificial
  CRISPR gRNA sequence
ttctgccttgctcttctttg

SEQ ID NO: 8466 - DNA, 20 bp, Artificial
  CRISPR gRNA sequence
tgccttgctcttctttgtag

SEQ ID NO: 8467 - DNA, 20 bp, Artificial
  CRISPR gRNA sequence
cttgctcttctttgtagcag

SEQ ID NO: 8468 - DNA, 20 bp, Artificial
  CRISPR gRNA sequence
tcttctttgtagcagtagat

SEQ ID NO: 8469 - DNA, 20 bp, Artificial
  CRISPR gRNA sequence
tagcagtagataagttttca

SEQ ID NO: 8470 - DNA, 20 bp, Artificial
  CRISPR gRNA sequence
acatacctcatccttttgat

SEQ ID NO: 8471 - DNA, 20 bp, Artificial
  CRISPR gRNA sequence
ctcatccttttgattagatt

SEQ ID NO: 8472 - DNA, 20 bp, Artificial
  CRISPR gRNA sequence
tcatccttttgattagatta

SEQ ID NO: 8473 - DNA, 20 bp, Artificial
  CRISPR gRNA sequence
catccttttgattagattaa

SEQ ID NO: 8474 - DNA, 20 bp, Artificial
  CRISPR gRNA sequence
ttgattagattaagggcccc

SEQ ID NO: 8475 - DNA, 20 bp, Artificial
  CRISPR gRNA sequence
gattagattaagggcccctg

SEQ ID NO: 8476 - DNA, 20 bp, Artificial
  CRISPR gRNA sequence
attaagggcccctggagtgt

SEQ ID NO: 8477 - DNA, 20 bp, Artificial
  CRISPR gRNA sequence
tcattcaacaaacatttctt

SEQ ID NO: 8478 - DNA, 20 bp, Artificial
  CRISPR gRNA sequence
cttgagtccccactgtgtgc

SEQ ID NO: 8479 - DNA, 20 bp, Artificial
  CRISPR gRNA sequence
ttgagtccccactgtgtgcc

SEQ ID NO: 8480 - DNA, 20 bp, Artificial
  CRISPR gRNA sequence
tccccactgtgtgccaggcc

SEQ ID NO: 8481 - DNA, 20 bp, Artificial
  CRISPR gRNA sequence
cccactgtgtgccaggccca

SEQ ID NO: 8482 - DNA, 20 bp, Artificial
  CRISPR gRNA sequence
ccactgtgtgccaggcccag

SEQ ID NO: 8483 - DNA, 20 bp, Artificial
  CRISPR gRNA sequence
tgccaggcccagaggttccc

SEQ ID NO: 8484 - DNA, 20 bp, Artificial
  CRISPR gRNA sequence
gcccagaggttccccagccc

SEQ ID NO: 8485 - DNA, 20 bp, Artificial
  CRISPR gRNA sequence
cccagaggttccccagccca

SEQ ID NO: 8486 - DNA, 20 bp, Artificial
  CRISPR gRNA sequence
aggttccccagcccaaggcc

SEQ ID NO: 8487 - DNA, 20 bp, Artificial
  CRISPR gRNA sequence
ccagcccaaggcctggcaca

SEQ ID NO: 8488 - DNA, 20 bp, Artificial
  CRISPR gRNA sequence
gcccaaggcctggcacacag

SEQ ID NO: 8489 - DNA, 20 bp, Artificial
  CRISPR gRNA sequence
cccaaggcctggcacacagt

SEQ ID NO: 8490 - DNA, 20 bp, Artificial
  CRISPR gRNA sequence
cctggcacacagtgggcctt

SEQ ID NO: 8491 - DNA, 20 bp, Artificial
  CRISPR gRNA sequence
gcacacagtgggccttcagt

SEQ ID NO: 8492 - DNA, 20 bp, Artificial
  CRISPR gRNA sequence
tgactgcgcttttccttgtc

SEQ ID NO: 8493 - DNA, 20 bp, Artificial
  CRISPR gRNA sequence
gactgcgcttttccttgtct

SEQ ID NO: 8494 - DNA, 20 bp, Artificial
  CRISPR gRNA sequence
tgcgcttttccttgtctggg

SEQ ID NO: 8495 - DNA, 20 bp, Artificial
  CRISPR gRNA sequence
gcttttccttgtctgggcag

SEQ ID NO: 8496 - DNA, 20 bp, Artificial
  CRISPR gRNA sequence
ccttgtctgggcagcggaac

SEQ ID NO: 8497 - DNA, 20 bp, Artificial
  CRISPR gRNA sequence
tctgggcagcggaactggac

SEQ ID NO: 8498 - DNA, 20 bp, Artificial
  CRISPR gRNA sequence
aactggaccagtatgtcttc

SEQ ID NO: 8499 - DNA, 20 bp, Artificial
  CRISPR gRNA sequence
actggaccagtatgtcttcc

SEQ ID NO: 8500 - DNA, 20 bp, Artificial
  CRISPR gRNA sequence
agtatgtcttccaggactcc

SEQ ID NO: 8501 - DNA, 20 bp, Artificial
  CRISPR gRNA sequence
tgtcttccaggactcccagc

SEQ ID NO: 8502 - DNA, 20 bp, Artificial
  CRISPR gRNA sequence
tcttccaggactcccagctg

SEQ ID NO: 8503 - DNA, 20 bp, Artificial
  CRISPR gRNA sequence
cttccaggactcccagctgg

SEQ ID NO: 8504 - DNA, 20 bp, Artificial
  CRISPR gRNA sequence
ttccaggactcccagctgga

SEQ ID NO: 8505 - DNA, 20 bp, Artificial
  CRISPR gRNA sequence
gactcccagctggagggcct

SEQ ID NO: 8506 - DNA, 20 bp, Artificial
  CRISPR gRNA sequence
cccagctggagggcctgagc

SEQ ID NO: 8507 - DNA, 20 bp, Artificial
  CRISPR gRNA sequence
ccagctggagggcctgagca

SEQ ID NO: 8508 - DNA, 20 bp, Artificial
  CRISPR gRNA sequence
ggcctgagcaaggacatttt

SEQ ID NO: 8509 - DNA, 20 bp, Artificial
  CRISPR gRNA sequence
tgagcaaggacattttcagt

SEQ ID NO: 8510 - DNA, 20 bp, Artificial
  CRISPR gRNA sequence
ggacattttcagtaagtttg

SEQ ID NO: 8511 - DNA, 20 bp, Artificial
  CRISPR gRNA sequence
cattttcagtaagtttgtgg

SEQ ID NO: 8512 - DNA, 20 bp, Artificial
  CRISPR gRNA sequence
attttcagtaagtttgtggt

SEQ ID NO: 8513 - DNA, 20 bp, Artificial
  CRISPR gRNA sequence
ttcagtaagtttgtggtggg

SEQ ID NO: 8514 - DNA, 20 bp, Artificial
  CRISPR gRNA sequence
tcagtaagtttgtggtgggt

SEQ ID NO: 8515 - DNA, 20 bp, Artificial
  CRISPR gRNA sequence
cagtaagtttgtggtgggtg

SEQ ID NO: 8516 - DNA, 20 bp, Artificial
  CRISPR gRNA sequence
gtaagtttgtggtgggtggg

SEQ ID NO: 8517 - DNA, 20 bp, Artificial
  CRISPR gRNA sequence
taagtttgtggtgggtgggg

SEQ ID NO: 8518 - DNA, 20 bp, Artificial
  CRISPR gRNA sequence
tgtggtgggtggggaggtct

SEQ ID NO: 8519 - DNA, 20 bp, Artificial
  CRISPR gRNA sequence
tgggtggggaggtcttggct

SEQ ID NO: 8520 - DNA, 20 bp, Artificial
  CRISPR gRNA sequence
gcatttcctgccttgttccc

SEQ ID NO: 8521 - DNA, 20 bp, Artificial
  CRISPR gRNA sequence
catttcctgccttgttccct

SEQ ID NO: 8522 - DNA, 20 bp, Artificial
  CRISPR gRNA sequence
atttcctgccttgttccctg

SEQ ID NO: 8523 - DNA, 20 bp, Artificial
  CRISPR gRNA sequence
tttcctgccttgttccctgg

SEQ ID NO: 8524 - DNA, 20 bp, Artificial
  CRISPR gRNA sequence
ttcctgccttgttccctggg

SEQ ID NO: 8525 - DNA, 20 bp, Artificial
  CRISPR gRNA sequence
acctgacgaccattcattga

SEQ ID NO: 8526 - DNA, 20 bp, Artificial
  CRISPR gRNA sequence
cctgacgaccattcattgat

SEQ ID NO: 8527 - DNA, 20 bp, Artificial
  CRISPR gRNA sequence
gacgaccattcattgatggg

SEQ ID NO: 8528 - DNA, 20 bp, Artificial
  CRISPR gRNA sequence
accattcattgatgggcagt

SEQ ID NO: 8529 - DNA, 20 bp, Artificial
  CRISPR gRNA sequence
gcagtcagacccctctcccc

SEQ ID NO: 8530 - DNA, 20 bp, Artificial
  CRISPR gRNA sequence
cagtcagacccctctcccca

SEQ ID NO: 8531 - DNA, 20 bp, Artificial
  CRISPR gRNA sequence
tcagacccctctccccaagg

SEQ ID NO: 8532 - DNA, 20 bp, Artificial
  CRISPR gRNA sequence
cagacccctctccccaaggt

SEQ ID NO: 8533 - DNA, 20 bp, Artificial
  CRISPR gRNA sequence
tctccccaaggtgggtacaa

SEQ ID NO: 8534 - DNA, 20 bp, Artificial
  CRISPR gRNA sequence
tccccaaggtgggtacaata

SEQ ID NO: 8535 - DNA, 20 bp, Artificial
  CRISPR gRNA sequence
ggtacaatagagactcacct

SEQ ID NO: 8536 - DNA, 20 bp, Artificial
  CRISPR gRNA sequence
gtacaatagagactcacctt

SEQ ID NO: 8537 - DNA, 20 bp, Artificial
  CRISPR gRNA sequence
tgggctttcattgattgtgt

SEQ ID NO: 8538 - DNA, 20 bp, Artificial
  CRISPR gRNA sequence
ctttcattgattgtgtgagt

SEQ ID NO: 8539 - DNA, 20 bp, Artificial
  CRISPR gRNA sequence
tgattgtgtgagttggtctc

SEQ ID NO: 8540 - DNA, 20 bp, Artificial
  CRISPR gRNA sequence
ttggtctctggtttttctca

SEQ ID NO: 8541 - DNA, 20 bp, Artificial
  CRISPR gRNA sequence
gtctctggtttttctcaaag

SEQ ID NO: 8542 - DNA, 20 bp, Artificial
  CRISPR gRNA sequence
ctctggtttttctcaaagta

SEQ ID NO: 8543 - DNA, 20 bp, Artificial
  CRISPR gRNA sequence
ttttctcaaagtagagcaca

SEQ ID NO: 8544 - DNA, 20 bp, Artificial
  CRISPR gRNA sequence
tttctcaaagtagagcacat

SEQ ID NO: 8545 - DNA, 20 bp, Artificial
  CRISPR gRNA sequence
caaagtagagcacataggac

SEQ ID NO: 8546 - DNA, 20 bp, Artificial
  CRISPR gRNA sequence
agagcacataggaccagatg

SEQ ID NO: 8547 - DNA, 20 bp, Artificial
  CRISPR gRNA sequence
ataggaccagatgaagtgat

SEQ ID NO: 8548 - DNA, 20 bp, Artificial
  CRISPR gRNA sequence
gaccagatgaagtgatcggt

SEQ ID NO: 8549 - DNA, 20 bp, Artificial
  CRISPR gRNA sequence
ccagatgaagtgatcggtga

SEQ ID NO: 8550 - DNA, 20 bp, Artificial
  CRISPR gRNA sequence
tgaagtgatcggtgagagta

SEQ ID NO: 8551 - DNA, 20 bp, Artificial
  CRISPR gRNA sequence
aagtgatcggtgagagtatg

SEQ ID NO: 8552 - DNA, 20 bp, Artificial
  CRISPR gRNA sequence
cggtgagagtatggagatgc

SEQ ID NO: 8553 - DNA, 20 bp, Artificial
  CRISPR gRNA sequence
tgagagtatggagatgccag

SEQ ID NO: 8554 - DNA, 20 bp, Artificial
  CRISPR gRNA sequence
gagtatggagatgccagcag

SEQ ID NO: 8555 - DNA, 20 bp, Artificial
  CRISPR gRNA sequence
atggagatgccagcagaagt

SEQ ID NO: 8556 - DNA, 20 bp, Artificial
  CRISPR gRNA sequence
tggagatgccagcagaagtt

SEQ ID NO: 8557 - DNA, 20 bp, Artificial
  CRISPR gRNA sequence
agatgccagcagaagttggg

SEQ ID NO: 8558 - DNA, 20 bp, Artificial
  CRISPR gRNA sequence
ccagcagaagttgggcagaa

SEQ ID NO: 8559 - DNA, 20 bp, Artificial
  CRISPR gRNA sequence
cagaagttgggcagaaaagt

SEQ ID NO: 8560 - DNA, 20 bp, Artificial
  CRISPR gRNA sequence
gttgggcagaaaagtcagaa

SEQ ID NO: 8561 - DNA, 20 bp, Artificial
  CRISPR gRNA sequence
agaaaagtcagaaaagacgt

SEQ ID NO: 8562 - DNA, 20 bp, Artificial
  CRISPR gRNA sequence
aagtcagaaaagacgtgagt

SEQ ID NO: 8563 - DNA, 20 bp, Artificial
  CRISPR gRNA sequence
agcccctccctgatccaacc

SEQ ID NO: 8564 - DNA, 20 bp, Artificial
  CRISPR gRNA sequence
gatccaacctagccttgctt

SEQ ID NO: 8565 - DNA, 20 bp, Artificial
  CRISPR gRNA sequence
acctagccttgcttgagacc

SEQ ID NO: 8566 - DNA, 20 bp, Artificial
  CRISPR gRNA sequence
ctggcctttccttgactcca

SEQ ID NO: 8567 - DNA, 20 bp, Artificial
  CRISPR gRNA sequence
cttgactccaaagcctgctg

SEQ ID NO: 8568 - DNA, 20 bp, Artificial
  CRISPR gRNA sequence
ttgactccaaagcctgctgt

SEQ ID NO: 8569 - DNA, 20 bp, Artificial
  CRISPR gRNA sequence
tccaacttgcttccctcgct

SEQ ID NO: 8570 - DNA, 20 bp, Artificial
  CRISPR gRNA sequence
ttccctcgctaagtcctgtc

SEQ ID NO: 8571 - DNA, 20 bp, Artificial
  CRISPR gRNA sequence
ctcgctaagtcctgtctggt

SEQ ID NO: 8572 - DNA, 20 bp, Artificial
  CRISPR gRNA sequence
tcgctaagtcctgtctggtt

SEQ ID NO: 8573 - DNA, 20 bp, Artificial
  CRISPR gRNA sequence
gctaagtcctgtctggttgg

SEQ ID NO: 8574 - DNA, 20 bp, Artificial
  CRISPR gRNA sequence
ctaagtcctgtctggttggg

SEQ ID NO: 8575 - DNA, 20 bp, Artificial
  CRISPR gRNA sequence
ctggttgggaggccctttaa

SEQ ID NO: 8576 - DNA, 20 bp, Artificial
  CRISPR gRNA sequence
ggaggccctttaaaagccaa

SEQ ID NO: 8577 - DNA, 20 bp, Artificial
  CRISPR gRNA sequence
gaggccctttaaaagccaac

SEQ ID NO: 8578 - DNA, 20 bp, Artificial
  CRISPR gRNA sequence
ggccctttaaaagccaacag

SEQ ID NO: 8579 - DNA, 20 bp, Artificial
  CRISPR gRNA sequence
atgtacatctgattatttca

SEQ ID NO: 8580 - DNA, 20 bp, Artificial
  CRISPR gRNA sequence
tggccctgataaccctccaa

SEQ ID NO: 8581 - DNA, 20 bp, Artificial
  CRISPR gRNA sequence
ggctacaaaatacatgccac

SEQ ID NO: 8582 - DNA, 20 bp, Artificial
  CRISPR gRNA sequence
gctacaaaatacatgccaca

SEQ ID NO: 8583 - DNA, 20 bp, Artificial
  CRISPR gRNA sequence
tacatgccacaaggcctgta

SEQ ID NO: 8584 - DNA, 20 bp, Artificial
  CRISPR gRNA sequence
tccctctccaaacccactat

SEQ ID NO: 8585 - DNA, 20 bp, Artificial
  CRISPR gRNA sequence
cactatgagacaccacactt

SEQ ID NO: 8586 - DNA, 20 bp, Artificial
  CRISPR gRNA sequence
caccacacttcagccaccac

SEQ ID NO: 8587 - DNA, 20 bp, Artificial
  CRISPR gRNA sequence
tataacccatgtgccctttc

SEQ ID NO: 8588 - DNA, 20 bp, Artificial
  CRISPR gRNA sequence
ccatgtgccctttcaagcct

SEQ ID NO: 8589 - DNA, 20 bp, Artificial
  CRISPR gRNA sequence
catgtgccctttcaagcctc

SEQ ID NO: 8590 - DNA, 20 bp, Artificial
  CRISPR gRNA sequence
atgtgccctttcaagcctcg

SEQ ID NO: 8591 - DNA, 20 bp, Artificial
  CRISPR gRNA sequence
ttcaagcctcggggcctttg

SEQ ID NO: 8592 - DNA, 20 bp, Artificial
  CRISPR gRNA sequence
cggggcctttgcagttgcta

SEQ ID NO: 8593 - DNA, 20 bp, Artificial
  CRISPR gRNA sequence
cagttgctatagtctctatc

SEQ ID NO: 8594 - DNA, 20 bp, Artificial
  CRISPR gRNA sequence
tatctggaatgcccttcccc

SEQ ID NO: 8595 - DNA, 20 bp, Artificial
  CRISPR gRNA sequence
ccttcccccagttcttccca

SEQ ID NO: 8596 - DNA, 20 bp, Artificial
  CRISPR gRNA sequence
ctgactcctttgaatctttc

SEQ ID NO: 8597 - DNA, 20 bp, Artificial
  CRISPR gRNA sequence
cctttgaatctttctggtgt

SEQ ID NO: 8598 - DNA, 20 bp, Artificial
  CRISPR gRNA sequence
gctaaactgtcacctcttcc

SEQ ID NO: 8599 - DNA, 20 bp, Artificial
  CRISPR gRNA sequence
tctctgaccatccttccatg

SEQ ID NO: 8600 - DNA, 20 bp, Artificial
  CRISPR gRNA sequence
gaccatccttccatgtagat

SEQ ID NO: 8601 - DNA, 20 bp, Artificial
  CRISPR gRNA sequence
tccttccatgtagattagct

SEQ ID NO: 8602 - DNA, 20 bp, Artificial
  CRISPR gRNA sequence
cttgtgtgtctttttccttg

SEQ ID NO: 8603 - DNA, 20 bp, Artificial
  CRISPR gRNA sequence
gtgtctttttccttgcagtt

SEQ ID NO: 8604 - DNA, 20 bp, Artificial
  CRISPR gRNA sequence
gtttagcactcattaccatc

SEQ ID NO: 8605 - DNA, 20 bp, Artificial
  CRISPR gRNA sequence
acgccttgctctcccactgt

SEQ ID NO: 8606 - DNA, 20 bp, Artificial
  CRISPR gRNA sequence
cgccttgctctcccactgtg

SEQ ID NO: 8607 - DNA, 20 bp, Artificial
  CRISPR gRNA sequence
ttgctctcccactgtgagga

SEQ ID NO: 8608 - DNA, 20 bp, Artificial
  CRISPR gRNA sequence
tgctctcccactgtgaggac

SEQ ID NO: 8609 - DNA, 20 bp, Artificial
  CRISPR gRNA sequence
gctctcccactgtgaggaca

SEQ ID NO: 8610 - DNA, 20 bp, Artificial
  CRISPR gRNA sequence
cttgctcgtgactgtttccc

SEQ ID NO: 8611 - DNA, 20 bp, Artificial
  CRISPR gRNA sequence
gtgactgtttccccagcatc

SEQ ID NO: 8612 - DNA, 20 bp, Artificial
  CRISPR gRNA sequence
tgtttccccagcatctagtg

SEQ ID NO: 8613 - DNA, 20 bp, Artificial
  CRISPR gRNA sequence
ccagcatctagtgcagtgcc

SEQ ID NO: 8614 - DNA, 20 bp, Artificial
  CRISPR gRNA sequence
ctagtgcagtgcctggtatg

SEQ ID NO: 8615 - DNA, 20 bp, Artificial
  CRISPR gRNA sequence
gtgcagtgcctggtatgcag

SEQ ID NO: 8616 - DNA, 20 bp, Artificial
  CRISPR gRNA sequence
cctggtatgcagtagcacct

SEQ ID NO: 8617 - DNA, 20 bp, Artificial
  CRISPR gRNA sequence
ggtatgcagtagcacctcag

SEQ ID NO: 8618 - DNA, 20 bp, Artificial
  CRISPR gRNA sequence
gaatgaaaacatctgtaaaa

SEQ ID NO: 8619 - DNA, 20 bp, Artificial
  CRISPR gRNA sequence
aatgaaaacatctgtaaaat

SEQ ID NO: 8620 - DNA, 20 bp, Artificial
  CRISPR gRNA sequence
catctgtaaaatgggtgtaa

SEQ ID NO: 8621 - DNA, 20 bp, Artificial
  CRISPR gRNA sequence
aatgggtgtaacagttaact

SEQ ID NO: 8622 - DNA, 20 bp, Artificial
  CRISPR gRNA sequence
agttaactgagtacttatta

SEQ ID NO: 8623 - DNA, 20 bp, Artificial
  CRISPR gRNA sequence
gttaactgagtacttattat

SEQ ID NO: 8624 - DNA, 20 bp, Artificial
  CRISPR gRNA sequence
ttatgggtctgaccatgtgt

SEQ ID NO: 8625 - DNA, 20 bp, Artificial
  CRISPR gRNA sequence
aagtcctgtatctatttatt

SEQ ID NO: 8626 - DNA, 20 bp, Artificial
  CRISPR gRNA sequence
ctatttattcagttcttaaa

SEQ ID NO: 8627 - DNA, 20 bp, Artificial
  CRISPR gRNA sequence
tatttattcagttcttaaac

SEQ ID NO: 8628 - DNA, 20 bp, Artificial
  CRISPR gRNA sequence
ttaaacaggtgaatcgcaca

SEQ ID NO: 8629 - DNA, 20 bp, Artificial
  CRISPR gRNA sequence
taaacaggtgaatcgcacac

SEQ ID NO: 8630 - DNA, 20 bp, Artificial
  CRISPR gRNA sequence
aaacaggtgaatcgcacaca

SEQ ID NO: 8631 - DNA, 20 bp, Artificial
  CRISPR gRNA sequence
gtgaatcgcacacagggtat

SEQ ID NO: 8632 - DNA, 20 bp, Artificial
  CRISPR gRNA sequence
cacagggtatgagattttaa

SEQ ID NO: 8633 - DNA, 20 bp, Artificial
  CRISPR gRNA sequence
tatgagattttaaaagtgca

SEQ ID NO: 8634 - DNA, 20 bp, Artificial
  CRISPR gRNA sequence
ttaaaagtgcaaagaatatt

SEQ ID NO: 8635 - DNA, 20 bp, Artificial
  CRISPR gRNA sequence
agtgcaaagaatattcagtg

SEQ ID NO: 8636 - DNA, 20 bp, Artificial
  CRISPR gRNA sequence
gtgcaaagaatattcagtga

SEQ ID NO: 8637 - DNA, 20 bp, Artificial
  CRISPR gRNA sequence
aaagaatattcagtgaaggc

SEQ ID NO: 8638 - DNA, 20 bp, Artificial
  CRISPR gRNA sequence
aagaatattcagtgaaggct

SEQ ID NO: 8639 - DNA, 20 bp, Artificial
  CRISPR gRNA sequence
tattcagtgaaggctgggcg

SEQ ID NO: 8640 - DNA, 20 bp, Artificial
  CRISPR gRNA sequence
tcagtgaaggctgggcgcag

SEQ ID NO: 8641 - DNA, 20 bp, Artificial
  CRISPR gRNA sequence
gcggctcacacctgtaatcc

SEQ ID NO: 8642 - DNA, 20 bp, Artificial
  CRISPR gRNA sequence
gctcacacctgtaatcccag

SEQ ID NO: 8643 - DNA, 20 bp, Artificial
  CRISPR gRNA sequence
cacctgtaatcccagcagtt

SEQ ID NO: 8644 - DNA, 20 bp, Artificial
  CRISPR gRNA sequence
acctgtaatcccagcagttt

SEQ ID NO: 8645 - DNA, 20 bp, Artificial
  CRISPR gRNA sequence
ctgtaatcccagcagtttgg

SEQ ID NO: 8646 - DNA, 20 bp, Artificial
  CRISPR gRNA sequence
tgtaatcccagcagtttggg

SEQ ID NO: 8647 - DNA, 20 bp, Artificial
  CRISPR gRNA sequence
tcccagcagtttgggaggcc

SEQ ID NO: 8648 - DNA, 20 bp, Artificial
  CRISPR gRNA sequence
cccagcagtttgggaggcca

SEQ ID NO: 8649 - DNA, 20 bp, Artificial
  CRISPR gRNA sequence
ccagcagtttgggaggccaa

SEQ ID NO: 8650 - DNA, 20 bp, Artificial
  CRISPR gRNA sequence
cagcagtttgggaggccaag

SEQ ID NO: 8651 - DNA, 20 bp, Artificial
  CRISPR gRNA sequence
agcagtttgggaggccaagg

SEQ ID NO: 8652 - DNA, 20 bp, Artificial
  CRISPR gRNA sequence
gtttgggaggccaaggggga

SEQ ID NO: 8653 - DNA, 20 bp, Artificial
  CRISPR gRNA sequence
ccaagggggacggatcactt

SEQ ID NO: 8654 - DNA, 20 bp, Artificial
  CRISPR gRNA sequence
caagggggacggatcacttg

SEQ ID NO: 8655 - DNA, 20 bp, Artificial
  CRISPR gRNA sequence
ggggacggatcacttgaggt

SEQ ID NO: 8656 - DNA, 20 bp, Artificial
  CRISPR gRNA sequence
gggacggatcacttgaggtc

SEQ ID NO: 8657 - DNA, 20 bp, Artificial
  CRISPR gRNA sequence
gacggatcacttgaggtcag

SEQ ID NO: 8658 - DNA, 20 bp, Artificial
  CRISPR gRNA sequence
tcaggagtttgatacctgcc

SEQ ID NO: 8659 - DNA, 20 bp, Artificial
  CRISPR gRNA sequence
tgatacctgcctggccaaca

SEQ ID NO: 8660 - DNA, 20 bp, Artificial
  CRISPR gRNA sequence
ctaccaaaaaatacaaaaat

SEQ ID NO: 8661 - DNA, 20 bp, Artificial
  CRISPR gRNA sequence
caaaaaatacaaaaattagc

SEQ ID NO: 8662 - DNA, 20 bp, Artificial
  CRISPR gRNA sequence
aaaaaatacaaaaattagcc

SEQ ID NO: 8663 - DNA, 20 bp, Artificial
  CRISPR gRNA sequence
atacaaaaattagccgggtg

SEQ ID NO: 8664 - DNA, 20 bp, Artificial
  CRISPR gRNA sequence
caaaaattagccgggtgtgg

SEQ ID NO: 8665 - DNA, 20 bp, Artificial
  CRISPR gRNA sequence
gtggtgcacgcctgtaatcc

SEQ ID NO: 8666 - DNA, 20 bp, Artificial
  CRISPR gRNA sequence
cgcctgtaatcccagctact

SEQ ID NO: 8667 - DNA, 20 bp, Artificial
  CRISPR gRNA sequence
gcctgtaatcccagctactc

SEQ ID NO: 8668 - DNA, 20 bp, Artificial
  CRISPR gRNA sequence
ctgtaatcccagctactcgg

SEQ ID NO: 8669 - DNA, 20 bp, Artificial
  CRISPR gRNA sequence
tgtaatcccagctactcggg

SEQ ID NO: 8670 - DNA, 20 bp, Artificial
  CRISPR gRNA sequence
tcccagctactcgggaggct

SEQ ID NO: 8671 - DNA, 20 bp, Artificial
  CRISPR gRNA sequence
cccagctactcgggaggctg

SEQ ID NO: 8672 - DNA, 20 bp, Artificial
  CRISPR gRNA sequence
agctactcgggaggctgagg

SEQ ID NO: 8673 - DNA, 20 bp, Artificial
  CRISPR gRNA sequence
gctactcgggaggctgaggc

SEQ ID NO: 8674 - DNA, 20 bp, Artificial
  CRISPR gRNA sequence
tactcgggaggctgaggcag

SEQ ID NO: 8675 - DNA, 20 bp, Artificial
  CRISPR gRNA sequence
gcaggagaatcgcttgaacc

SEQ ID NO: 8676 - DNA, 20 bp, Artificial
  CRISPR gRNA sequence
caggagaatcgcttgaaccc

SEQ ID NO: 8677 - DNA, 20 bp, Artificial
  CRISPR gRNA sequence
ggagaatcgcttgaacccag

SEQ ID NO: 8678 - DNA, 20 bp, Artificial
  CRISPR gRNA sequence
gagaatcgcttgaacccagg

SEQ ID NO: 8679 - DNA, 20 bp, Artificial
  CRISPR gRNA sequence
aatcgcttgaacccaggagg

SEQ ID NO: 8680 - DNA, 20 bp, Artificial
  CRISPR gRNA sequence
tcgcttgaacccaggaggtg

SEQ ID NO: 8681 - DNA, 20 bp, Artificial
  CRISPR gRNA sequence
cgcttgaacccaggaggtgg

SEQ ID NO: 8682 - DNA, 20 bp, Artificial
  CRISPR gRNA sequence
aacccaggaggtggaggttg

SEQ ID NO: 8683 - DNA, 20 bp, Artificial
  CRISPR gRNA sequence
caggaggtggaggttgcagt

SEQ ID NO: 8684 - DNA, 20 bp, Artificial
  CRISPR gRNA sequence
ggtggaggttgcagtgagct

SEQ ID NO: 8685 - DNA, 20 bp, Artificial
  CRISPR gRNA sequence
aagatcacgccactgcactc

SEQ ID NO: 8686 - DNA, 20 bp, Artificial
  CRISPR gRNA sequence
cacgccactgcactccagcc

SEQ ID NO: 8687 - DNA, 20 bp, Artificial
  CRISPR gRNA sequence
acgccactgcactccagcct

SEQ ID NO: 8688 - DNA, 20 bp, Artificial
  CRISPR gRNA sequence
ccactgcactccagcctggg

SEQ ID NO: 8689 - DNA, 20 bp, Artificial
  CRISPR gRNA sequence
ctgcactccagcctgggtgg

SEQ ID NO: 8690 - DNA, 20 bp, Artificial
  CRISPR gRNA sequence
gcactccagcctgggtggca

SEQ ID NO: 8691 - DNA, 20 bp, Artificial
  CRISPR gRNA sequence
tccagcctgggtggcagagt

SEQ ID NO: 8692 - DNA, 20 bp, Artificial
  CRISPR gRNA sequence
tctcaaacaacaacaaccaa

SEQ ID NO: 8693 - DNA, 20 bp, Artificial
  CRISPR gRNA sequence
acaacaaccaaaagaatatt

SEQ ID NO: 8694 - DNA, 20 bp, Artificial
  CRISPR gRNA sequence
tccctcccactcctgttctg

SEQ ID NO: 8695 - DNA, 20 bp, Artificial
  CRISPR gRNA sequence
actcctgttctgtagtccct

SEQ ID NO: 8696 - DNA, 20 bp, Artificial
  CRISPR gRNA sequence
cctcagttttgctcctatct

SEQ ID NO: 8697 - DNA, 20 bp, Artificial
  CRISPR gRNA sequence
tcttagtcaacctatgtgac

SEQ ID NO: 8698 - DNA, 20 bp, Artificial
  CRISPR gRNA sequence
cagcttcctttttgccttgt

SEQ ID NO: 8699 - DNA, 20 bp, Artificial
  CRISPR gRNA sequence
tttttgccttgtcagaaata

SEQ ID NO: 8700 - DNA, 20 bp, Artificial
  CRISPR gRNA sequence
tgccttgtcagaaataaagc

SEQ ID NO: 8701 - DNA, 20 bp, Artificial
  CRISPR gRNA sequence
ttacttcattactccctgtc

SEQ ID NO: 8702 - DNA, 20 bp, Artificial
  CRISPR gRNA sequence
tacttcattactccctgtct

SEQ ID NO: 8703 - DNA, 20 bp, Artificial
  CRISPR gRNA sequence
cttcattactccctgtctgg

SEQ ID NO: 8704 - DNA, 20 bp, Artificial
  CRISPR gRNA sequence
ttcattactccctgtctggg

SEQ ID NO: 8705 - DNA, 20 bp, Artificial
  CRISPR gRNA sequence
aggtcacgttccatattatt

SEQ ID NO: 8706 - DNA, 20 bp, Artificial
  CRISPR gRNA sequence
ggtcacgttccatattattg

SEQ ID NO: 8707 - DNA, 20 bp, Artificial
  CRISPR gRNA sequence
gtcacgttccatattattga

SEQ ID NO: 8708 - DNA, 20 bp, Artificial
  CRISPR gRNA sequence
cacgttccatattattgagg

SEQ ID NO: 8709 - DNA, 20 bp, Artificial
  CRISPR gRNA sequence
cgttccatattattgaggga

SEQ ID NO: 8710 - DNA, 20 bp, Artificial
  CRISPR gRNA sequence
gttccatattattgagggag

SEQ ID NO: 8711 - DNA, 20 bp, Artificial
  CRISPR gRNA sequence
tattattgagggagaggaca

SEQ ID NO: 8712 - DNA, 20 bp, Artificial
  CRISPR gRNA sequence
agaggacacggtcctatctt

SEQ ID NO: 8713 - DNA, 20 bp, Artificial
  CRISPR gRNA sequence
ggacacggtcctatcttcag

SEQ ID NO: 8714 - DNA, 20 bp, Artificial
  CRISPR gRNA sequence
tttgataaatatttcccccc

SEQ ID NO: 8715 - DNA, 20 bp, Artificial
  CRISPR gRNA sequence
cccccaagattttattgtga

SEQ ID NO: 8716 - DNA, 20 bp, Artificial
  CRISPR gRNA sequence
gattttattgtgaaagtttt

SEQ ID NO: 8717 - DNA, 20 bp, Artificial
  CRISPR gRNA sequence
ttattgtgaaagttttcggc

SEQ ID NO: 8718 - DNA, 20 bp, Artificial
  CRISPR gRNA sequence
tattgtgaaagttttcggcc

SEQ ID NO: 8719 - DNA, 20 bp, Artificial
  CRISPR gRNA sequence
tgaaagttttcggccaggcg

SEQ ID NO: 8720 - DNA, 20 bp, Artificial
  CRISPR gRNA sequence
aagttttcggccaggcgtgg

SEQ ID NO: 8721 - DNA, 20 bp, Artificial
  CRISPR gRNA sequence
gtggctcacatctgtaatcc

SEQ ID NO: 8722 - DNA, 20 bp, Artificial
  CRISPR gRNA sequence
catctgtaatcccagcactt

SEQ ID NO: 8723 - DNA, 20 bp, Artificial
  CRISPR gRNA sequence
atctgtaatcccagcacttt

SEQ ID NO: 8724 - DNA, 20 bp, Artificial
  CRISPR gRNA sequence
ctgtaatcccagcactttgg

SEQ ID NO: 8725 - DNA, 20 bp, Artificial
  CRISPR gRNA sequence
tgtaatcccagcactttggg

SEQ ID NO: 8726 - DNA, 20 bp, Artificial
  CRISPR gRNA sequence
tcccagcactttgggaggcc

SEQ ID NO: 8727 - DNA, 20 bp, Artificial
  CRISPR gRNA sequence
cccagcactttgggaggcca

SEQ ID NO: 8728 - DNA, 20 bp, Artificial
  CRISPR gRNA sequence
gcactttgggaggccaaggc

SEQ ID NO: 8729 - DNA, 20 bp, Artificial
  CRISPR gRNA sequence
ctttgggaggccaaggctgg

SEQ ID NO: 8730 - DNA, 20 bp, Artificial
  CRISPR gRNA sequence
ccaaggctggcagatcacct

SEQ ID NO: 8731 - DNA, 20 bp, Artificial
  CRISPR gRNA sequence
caaggctggcagatcacctg

SEQ ID NO: 8732 - DNA, 20 bp, Artificial
  CRISPR gRNA sequence
ctggcagatcacctgaggtc

SEQ ID NO: 8733 - DNA, 20 bp, Artificial
  CRISPR gRNA sequence
ggcagatcacctgaggtcaa

SEQ ID NO: 8734 - DNA, 20 bp, Artificial
  CRISPR gRNA sequence
tcacctgaggtcaagagttt

SEQ ID NO: 8735 - DNA, 20 bp, Artificial
  CRISPR gRNA sequence
tgaggtcaagagtttgagac

SEQ ID NO: 8736 - DNA, 20 bp, Artificial
  CRISPR gRNA sequence
tcaagagtttgagaccagcc

SEQ ID NO: 8737 - DNA, 20 bp, Artificial
  CRISPR gRNA sequence
tgagaccagcctggccaaca

SEQ ID NO: 8738 - DNA, 20 bp, Artificial
  CRISPR gRNA sequence
tctactaaaaatacaaaaat

SEQ ID NO: 8739 - DNA, 20 bp, Artificial
  CRISPR gRNA sequence
ctaaaaatacaaaaattagc

SEQ ID NO: 8740 - DNA, 20 bp, Artificial
  CRISPR gRNA sequence
taaaaatacaaaaattagcc

SEQ ID NO: 8741 - DNA, 20 bp, Artificial
  CRISPR gRNA sequence
atacaaaaattagccaggcg

SEQ ID NO: 8742 - DNA, 20 bp, Artificial
  CRISPR gRNA sequence
caaaaattagccaggcgtgg

SEQ ID NO: 8743 - DNA, 20 bp, Artificial
  CRISPR gRNA sequence
gtggcgaacacctgtaatcc

SEQ ID NO: 8744 - DNA, 20 bp, Artificial
  CRISPR gRNA sequence
acacctgtaatcccagctac

SEQ ID NO: 8745 - DNA, 20 bp, Artificial
  CRISPR gRNA sequence
cacctgtaatcccagctacc

SEQ ID NO: 8746 - DNA, 20 bp, Artificial
  CRISPR gRNA sequence
acctgtaatcccagctacca

SEQ ID NO: 8747 - DNA, 20 bp, Artificial
  CRISPR gRNA sequence
ctgtaatcccagctaccagg

SEQ ID NO: 8748 - DNA, 20 bp, Artificial
  CRISPR gRNA sequence
tgtaatcccagctaccaggg

SEQ ID NO: 8749 - DNA, 20 bp, Artificial
  CRISPR gRNA sequence
atcccagctaccagggaggc

SEQ ID NO: 8750 - DNA, 20 bp, Artificial
  CRISPR gRNA sequence
tcccagctaccagggaggct

SEQ ID NO: 8751 - DNA, 20 bp, Artificial
  CRISPR gRNA sequence
cccagctaccagggaggcta

SEQ ID NO: 8752 - DNA, 20 bp, Artificial
  CRISPR gRNA sequence
agctaccagggaggctaggg

SEQ ID NO: 8753 - DNA, 20 bp, Artificial
  CRISPR gRNA sequence
gctaccagggaggctagggt

SEQ ID NO: 8754 - DNA, 20 bp, Artificial
  CRISPR gRNA sequence
taccagggaggctagggtgg

SEQ ID NO: 8755 - DNA, 20 bp, Artificial
  CRISPR gRNA sequence
tgggagaatcgcttgaacct

SEQ ID NO: 8756 - DNA, 20 bp, Artificial
  CRISPR gRNA sequence
gagaatcgcttgaacctaag

SEQ ID NO: 8757 - DNA, 20 bp, Artificial
  CRISPR gRNA sequence
aatcgcttgaacctaagaag

SEQ ID NO: 8758 - DNA, 20 bp, Artificial
  CRISPR gRNA sequence
tcgcttgaacctaagaagca

SEQ ID NO: 8759 - DNA, 20 bp, Artificial
  CRISPR gRNA sequence
cgcttgaacctaagaagcag

SEQ ID NO: 8760 - DNA, 20 bp, Artificial
  CRISPR gRNA sequence
aacctaagaagcagaggttg

SEQ ID NO: 8761 - DNA, 20 bp, Artificial
  CRISPR gRNA sequence
taagaagcagaggttgcagt

SEQ ID NO: 8762 - DNA, 20 bp, Artificial
  CRISPR gRNA sequence
agcagaggttgcagtgagcc

SEQ ID NO: 8763 - DNA, 20 bp, Artificial
  CRISPR gRNA sequence
gcagtgagccaagattgcgc

SEQ ID NO: 8764 - DNA, 20 bp, Artificial
  CRISPR gRNA sequence
aagattgcgccagtgcactc

SEQ ID NO: 8765 - DNA, 20 bp, Artificial
  CRISPR gRNA sequence
tgcgccagtgcactccagcc

SEQ ID NO: 8766 - DNA, 20 bp, Artificial
  CRISPR gRNA sequence
gcgccagtgcactccagcct

SEQ ID NO: 8767 - DNA, 20 bp, Artificial
  CRISPR gRNA sequence
gtgcactccagcctgggcaa

SEQ ID NO: 8768 - DNA, 20 bp, Artificial
  CRISPR gRNA sequence
gcactccagcctgggcaaca

SEQ ID NO: 8769 - DNA, 20 bp, Artificial
  CRISPR gRNA sequence
tccagcctgggcaacagagc

SEQ ID NO: 8770 - DNA, 20 bp, Artificial
  CRISPR gRNA sequence
aaaaaaaaaaaaatgttttc

SEQ ID NO: 8771 - DNA, 20 bp, Artificial
  CRISPR gRNA sequence
atgttttcaagatacaataa

SEQ ID NO: 8772 - DNA, 20 bp, Artificial
  CRISPR gRNA sequence
tcaagatacaataaaagtga

SEQ ID NO: 8773 - DNA, 20 bp, Artificial
  CRISPR gRNA sequence
atacaataaaagtgaaagaa

SEQ ID NO: 8774 - DNA, 20 bp, Artificial
  CRISPR gRNA sequence
agtgaaagaatggtactatg

SEQ ID NO: 8775 - DNA, 20 bp, Artificial
  CRISPR gRNA sequence
gtgaaagaatggtactatga

SEQ ID NO: 8776 - DNA, 20 bp, Artificial
  CRISPR gRNA sequence
tttgattctacaattaatgt

SEQ ID NO: 8777 - DNA, 20 bp, Artificial
  CRISPR gRNA sequence
ttgattctacaattaatgtt

SEQ ID NO: 8778 - DNA, 20 bp, Artificial
  CRISPR gRNA sequence
acacccattcattatatttt

SEQ ID NO: 8779 - DNA, 20 bp, Artificial
  CRISPR gRNA sequence
tacatttcaaatgtaaattg

SEQ ID NO: 8780 - DNA, 20 bp, Artificial
  CRISPR gRNA sequence
tacactcccctcgtgtactt

SEQ ID NO: 8781 - DNA, 20 bp, Artificial
  CRISPR gRNA sequence
acttcagcatcctttctttt

SEQ ID NO: 8782 - DNA, 20 bp, Artificial
  CRISPR gRNA sequence
cttcagcatcctttctttta

SEQ ID NO: 8783 - DNA, 20 bp, Artificial
  CRISPR gRNA sequence
tcctttcttttaaggccatg

SEQ ID NO: 8784 - DNA, 20 bp, Artificial
  CRISPR gRNA sequence
aaggccatgcagtgtttcgt

SEQ ID NO: 8785 - DNA, 20 bp, Artificial
  CRISPR gRNA sequence
aggccatgcagtgtttcgtt

SEQ ID NO: 8786 - DNA, 20 bp, Artificial
  CRISPR gRNA sequence
ccatgcagtgtttcgttggg

SEQ ID NO: 8787 - DNA, 20 bp, Artificial
  CRISPR gRNA sequence
agatgaaccataatttgttt

SEQ ID NO: 8788 - DNA, 20 bp, Artificial
  CRISPR gRNA sequence
tgaaccataatttgtttaag

SEQ ID NO: 8789 - DNA, 20 bp, Artificial
  CRISPR gRNA sequence
tgtttaagcagtcccttgct

SEQ ID NO: 8790 - DNA, 20 bp, Artificial
  CRISPR gRNA sequence
gtttaagcagtcccttgcta

SEQ ID NO: 8791 - DNA, 20 bp, Artificial
  CRISPR gRNA sequence
tttaagcagtcccttgctaa

SEQ ID NO: 8792 - DNA, 20 bp, Artificial
  CRISPR gRNA sequence
gtcccttgctaagggacacg

SEQ ID NO: 8793 - DNA, 20 bp, Artificial
  CRISPR gRNA sequence
tcccttgctaagggacacgt

SEQ ID NO: 8794 - DNA, 20 bp, Artificial
  CRISPR gRNA sequence
ggtttttaatctgttgctgt

SEQ ID NO: 8795 - DNA, 20 bp, Artificial
  CRISPR gRNA sequence
gatactcactcactgatttc

SEQ ID NO: 8796 - DNA, 20 bp, Artificial
  CRISPR gRNA sequence
tctggcatactcctgcaatg

SEQ ID NO: 8797 - DNA, 20 bp, Artificial
  CRISPR gRNA sequence
ctggcatactcctgcaatgt

SEQ ID NO: 8798 - DNA, 20 bp, Artificial
  CRISPR gRNA sequence
gaaccaccacccccatttca

SEQ ID NO: 8799 - DNA, 20 bp, Artificial
  CRISPR gRNA sequence
cacccccatttcatagatgt

SEQ ID NO: 8800 - DNA, 20 bp, Artificial
  CRISPR gRNA sequence
atttcatagatgtgagatca

SEQ ID NO: 8801 - DNA, 20 bp, Artificial
  CRISPR gRNA sequence
tttcatagatgtgagatcaa

SEQ ID NO: 8802 - DNA, 20 bp, Artificial
  CRISPR gRNA sequence
tagatgtgagatcaaaggtt

SEQ ID NO: 8803 - DNA, 20 bp, Artificial
  CRISPR gRNA sequence
gatgtgagatcaaaggttca

SEQ ID NO: 8804 - DNA, 20 bp, Artificial
  CRISPR gRNA sequence
gtgagatcaaaggttcagag

SEQ ID NO: 8805 - DNA, 20 bp, Artificial
  CRISPR gRNA sequence
ttcagagaagctgcattgca

SEQ ID NO: 8806 - DNA, 20 bp, Artificial
  CRISPR gRNA sequence
tcagagaagctgcattgcaa

SEQ ID NO: 8807 - DNA, 20 bp, Artificial
  CRISPR gRNA sequence
agctgcattgcaaaggcaca

SEQ ID NO: 8808 - DNA, 20 bp, Artificial
  CRISPR gRNA sequence
gcattgcaaaggcacacagc

SEQ ID NO: 8809 - DNA, 20 bp, Artificial
  CRISPR gRNA sequence
cattgcaaaggcacacagct

SEQ ID NO: 8810 - DNA, 20 bp, Artificial
  CRISPR gRNA sequence
tgcaaaggcacacagctagg

SEQ ID NO: 8811 - DNA, 20 bp, Artificial
  CRISPR gRNA sequence
aaaggcacacagctaggaag

SEQ ID NO: 8812 - DNA, 20 bp, Artificial
  CRISPR gRNA sequence
acagctaggaagcggttcaa

SEQ ID NO: 8813 - DNA, 20 bp, Artificial
  CRISPR gRNA sequence
gctaggaagcggttcaaaag

SEQ ID NO: 8814 - DNA, 20 bp, Artificial
  CRISPR gRNA sequence
ctaggaagcggttcaaaagc

SEQ ID NO: 8815 - DNA, 20 bp, Artificial
  CRISPR gRNA sequence
ttttgttttgttttgttttt

SEQ ID NO: 8816 - DNA, 20 bp, Artificial
  CRISPR gRNA sequence
ttgtgtccccatttgtgact

SEQ ID NO: 8817 - DNA, 20 bp, Artificial
  CRISPR gRNA sequence
tcttctgctgctacactgcc

SEQ ID NO: 8818 - DNA, 20 bp, Artificial
  CRISPR gRNA sequence
tgctgctacactgcctggta

SEQ ID NO: 8819 - DNA, 20 bp, Artificial
  CRISPR gRNA sequence
tacactgcctggtatggttt

SEQ ID NO: 8820 - DNA, 20 bp, Artificial
  CRISPR gRNA sequence
ctgcctggtatggtttgaga

SEQ ID NO: 8821 - DNA, 20 bp, Artificial
  CRISPR gRNA sequence
tgcctggtatggtttgagat

SEQ ID NO: 8822 - DNA, 20 bp, Artificial
  CRISPR gRNA sequence
gcctggtatggtttgagatg

SEQ ID NO: 8823 - DNA, 20 bp, Artificial
  CRISPR gRNA sequence
gtatggtttgagatggggtt

SEQ ID NO: 8824 - DNA, 20 bp, Artificial
  CRISPR gRNA sequence
tatggtttgagatggggttt

SEQ ID NO: 8825 - DNA, 20 bp, Artificial
  CRISPR gRNA sequence
ttgagatggggtttgggttc

SEQ ID NO: 8826 - DNA, 20 bp, Artificial
  CRISPR gRNA sequence
atggggtttgggttcaagcc

SEQ ID NO: 8827 - DNA, 20 bp, Artificial
  CRISPR gRNA sequence
tggggtttgggttcaagcca

SEQ ID NO: 8828 - DNA, 20 bp, Artificial
  CRISPR gRNA sequence
gggtttgggttcaagccaag

SEQ ID NO: 8829 - DNA, 20 bp, Artificial
  CRISPR gRNA sequence
ttgggttcaagccaaggagc

SEQ ID NO: 8830 - DNA, 20 bp, Artificial
  CRISPR gRNA sequence
tgggttcaagccaaggagct

SEQ ID NO: 8831 - DNA, 20 bp, Artificial
  CRISPR gRNA sequence
gggttcaagccaaggagctg

SEQ ID NO: 8832 - DNA, 20 bp, Artificial
  CRISPR gRNA sequence
tcaagccaaggagctggggt

SEQ ID NO: 8833 - DNA, 20 bp, Artificial
  CRISPR gRNA sequence
aggagctggggttggaatgt

SEQ ID NO: 8834 - DNA, 20 bp, Artificial
  CRISPR gRNA sequence
gagctggggttggaatgtta

SEQ ID NO: 8835 - DNA, 20 bp, Artificial
  CRISPR gRNA sequence
tggggttggaatgttagagc

SEQ ID NO: 8836 - DNA, 20 bp, Artificial
  CRISPR gRNA sequence
ggggttggaatgttagagcg

SEQ ID NO: 8837 - DNA, 20 bp, Artificial
  CRISPR gRNA sequence
gggttggaatgttagagcga

SEQ ID NO: 8838 - DNA, 20 bp, Artificial
  CRISPR gRNA sequence
ggttggaatgttagagcgag

SEQ ID NO: 8839 - DNA, 20 bp, Artificial
  CRISPR gRNA sequence
ttggaatgttagagcgaggg

SEQ ID NO: 8840 - DNA, 20 bp, Artificial
  CRISPR gRNA sequence
tggaatgttagagcgagggg

SEQ ID NO: 8841 - DNA, 20 bp, Artificial
  CRISPR gRNA sequence
ttagagcgaggggaggaaaa

SEQ ID NO: 8842 - DNA, 20 bp, Artificial
  CRISPR gRNA sequence
ggggaggaaaatggaccccc

SEQ ID NO: 8843 - DNA, 20 bp, Artificial
  CRISPR gRNA sequence
ggacccccaagaccactacc

SEQ ID NO: 8844 - DNA, 20 bp, Artificial
  CRISPR gRNA sequence
aagaccactacccagccttg

SEQ ID NO: 8845 - DNA, 20 bp, Artificial
  CRISPR gRNA sequence
cactacccagccttgaagtt

SEQ ID NO: 8846 - DNA, 20 bp, Artificial
  CRISPR gRNA sequence
actacccagccttgaagtta

SEQ ID NO: 8847 - DNA, 20 bp, Artificial
  CRISPR gRNA sequence
gccttgaagttaaggccgta

SEQ ID NO: 8848 - DNA, 20 bp, Artificial
  CRISPR gRNA sequence
gttaaggccgtatagcctgc

SEQ ID NO: 8849 - DNA, 20 bp, Artificial
  CRISPR gRNA sequence
taaggccgtatagcctgcta

SEQ ID NO: 8850 - DNA, 20 bp, Artificial
  CRISPR gRNA sequence
gtatagcctgctagagtcct

SEQ ID NO: 8851 - DNA, 20 bp, Artificial
  CRISPR gRNA sequence
ctagagtcctgagccccttc

SEQ ID NO: 8852 - DNA, 20 bp, Artificial
  CRISPR gRNA sequence
gtcctgagccccttctggct

SEQ ID NO: 8853 - DNA, 20 bp, Artificial
  CRISPR gRNA sequence
tcctgagccccttctggctt

SEQ ID NO: 8854 - DNA, 20 bp, Artificial
  CRISPR gRNA sequence
ggcttgggacatcctctccc

SEQ ID NO: 8855 - DNA, 20 bp, Artificial
  CRISPR gRNA sequence
gcttgggacatcctctccct

SEQ ID NO: 8856 - DNA, 20 bp, Artificial
  CRISPR gRNA sequence
cttgggacatcctctccctg

SEQ ID NO: 8857 - DNA, 20 bp, Artificial
  CRISPR gRNA sequence
gggacatcctctccctgggg

SEQ ID NO: 8858 - DNA, 20 bp, Artificial
  CRISPR gRNA sequence
ctgatcacatgttttctctg

SEQ ID NO: 8859 - DNA, 20 bp, Artificial
  CRISPR gRNA sequence
tgttttctctgcagccttcc

SEQ ID NO: 8860 - DNA, 20 bp, Artificial
  CRISPR gRNA sequence
ttttctctgcagccttccca

SEQ ID NO: 8861 - DNA, 20 bp, Artificial
  CRISPR gRNA sequence
tttctctgcagccttcccag

SEQ ID NO: 8862 - DNA, 20 bp, Artificial
  CRISPR gRNA sequence
tctctgcagccttcccagag

SEQ ID NO: 8863 - DNA, 20 bp, Artificial
  CRISPR gRNA sequence
agccttcccagaggagcttc

SEQ ID NO: 8864 - DNA, 20 bp, Artificial
  CRISPR gRNA sequence
cttcccagaggagcttccgg

SEQ ID NO: 8865 - DNA, 20 bp, Artificial
  CRISPR gRNA sequence
aggagcttccggcagacctg

SEQ ID NO: 8866 - DNA, 20 bp, Artificial
  CRISPR gRNA sequence
ttccggcagacctgaagcac

SEQ ID NO: 8867 - DNA, 20 bp, Artificial
  CRISPR gRNA sequence
cggcagacctgaagcactgg

SEQ ID NO: 8868 - DNA, 20 bp, Artificial
  CRISPR gRNA sequence
agacctgaagcactggaagc

SEQ ID NO: 8869 - DNA, 20 bp, Artificial
  CRISPR gRNA sequence
gacctgaagcactggaagcc

SEQ ID NO: 8870 - DNA, 20 bp, Artificial
  CRISPR gRNA sequence
agcactggaagccaggtgtg

SEQ ID NO: 8871 - DNA, 20 bp, Artificial
  CRISPR gRNA sequence
gcactggaagccaggtgtgc

SEQ ID NO: 8872 - DNA, 20 bp, Artificial
  CRISPR gRNA sequence
cactggaagccaggtgtgca

SEQ ID NO: 8873 - DNA, 20 bp, Artificial
  CRISPR gRNA sequence
tggaagccaggtgtgcaggg

SEQ ID NO: 8874 - DNA, 20 bp, Artificial
  CRISPR gRNA sequence
ggaagccaggtgtgcagggc

SEQ ID NO: 8875 - DNA, 20 bp, Artificial
  CRISPR gRNA sequence
agccaggtgtgcagggcagg

SEQ ID NO: 8876 - DNA, 20 bp, Artificial
  CRISPR gRNA sequence
gccaggtgtgcagggcaggt

SEQ ID NO: 8877 - DNA, 20 bp, Artificial
  CRISPR gRNA sequence
ggtgtgcagggcaggtgggc

SEQ ID NO: 8878 - DNA, 20 bp, Artificial
  CRISPR gRNA sequence
gtgtgcagggcaggtgggct

SEQ ID NO: 8879 - DNA, 20 bp, Artificial
  CRISPR gRNA sequence
tgtgcagggcaggtgggctg

SEQ ID NO: 8880 - DNA, 20 bp, Artificial
  CRISPR gRNA sequence
cagggcaggtgggctggggt

SEQ ID NO: 8881 - DNA, 20 bp, Artificial
  CRISPR gRNA sequence
agggcaggtgggctggggtt

SEQ ID NO: 8882 - DNA, 20 bp, Artificial
  CRISPR gRNA sequence
gcaggtgggctggggttggg

SEQ ID NO: 8883 - DNA, 20 bp, Artificial
  CRISPR gRNA sequence
caggtgggctggggttggga

SEQ ID NO: 8884 - DNA, 20 bp, Artificial
  CRISPR gRNA sequence
aggtgggctggggttgggaa

SEQ ID NO: 8885 - DNA, 20 bp, Artificial
  CRISPR gRNA sequence
tgggctggggttgggaaggg

SEQ ID NO: 8886 - DNA, 20 bp, Artificial
  CRISPR gRNA sequence
gttgggaagggtggatgcct

SEQ ID NO: 8887 - DNA, 20 bp, Artificial
  CRISPR gRNA sequence
ttgggaagggtggatgcctt

SEQ ID NO: 8888 - DNA, 20 bp, Artificial
  CRISPR gRNA sequence
tgggaagggtggatgccttg

SEQ ID NO: 8889 - DNA, 20 bp, Artificial
  CRISPR gRNA sequence
ggaagggtggatgccttggg

SEQ ID NO: 8890 - DNA, 20 bp, Artificial
  CRISPR gRNA sequence
gaagggtggatgccttgggg

SEQ ID NO: 8891 - DNA, 20 bp, Artificial
  CRISPR gRNA sequence
aagggtggatgccttgggga

SEQ ID NO: 8892 - DNA, 20 bp, Artificial
  CRISPR gRNA sequence
agggtggatgccttggggag

SEQ ID NO: 8893 - DNA, 20 bp, Artificial
  CRISPR gRNA sequence
tggatgccttggggagggga

SEQ ID NO: 8894 - DNA, 20 bp, Artificial
  CRISPR gRNA sequence
atgccttggggaggggatgg

SEQ ID NO: 8895 - DNA, 20 bp, Artificial
  CRISPR gRNA sequence
gccttggggaggggatggaa

SEQ ID NO: 8896 - DNA, 20 bp, Artificial
  CRISPR gRNA sequence
gatggaagagattgaactcc

SEQ ID NO: 8897 - DNA, 20 bp, Artificial
  CRISPR gRNA sequence
agagattgaactcctggccc

SEQ ID NO: 8898 - DNA, 20 bp, Artificial
  CRISPR gRNA sequence
aactcctggcccaagtctga

SEQ ID NO: 8899 - DNA, 20 bp, Artificial
  CRISPR gRNA sequence
actcctggcccaagtctgat

SEQ ID NO: 8900 - DNA, 20 bp, Artificial
  CRISPR gRNA sequence
ctcctggcccaagtctgatg

SEQ ID NO: 8901 - DNA, 20 bp, Artificial
  CRISPR gRNA sequence
tggcccaagtctgatgggga

SEQ ID NO: 8902 - DNA, 20 bp, Artificial
  CRISPR gRNA sequence
agtctgatggggatggtgca

SEQ ID NO: 8903 - DNA, 20 bp, Artificial
  CRISPR gRNA sequence
gatggggatggtgcatggtg

SEQ ID NO: 8904 - DNA, 20 bp, Artificial
  CRISPR gRNA sequence
gtgcagcccctgcccttctt

SEQ ID NO: 8905 - DNA, 20 bp, Artificial
  CRISPR gRNA sequence
tgcagcccctgcccttcttt

SEQ ID NO: 8906 - DNA, 20 bp, Artificial
  CRISPR gRNA sequence
agcccctgcccttctttggg

SEQ ID NO: 8907 - DNA, 20 bp, Artificial
  CRISPR gRNA sequence
cccctgcccttctttgggta

SEQ ID NO: 8908 - DNA, 20 bp, Artificial
  CRISPR gRNA sequence
ccctgcccttctttgggtag

SEQ ID NO: 8909 - DNA, 20 bp, Artificial
  CRISPR gRNA sequence
cccttctttgggtagaggct

SEQ ID NO: 8910 - DNA, 20 bp, Artificial
  CRISPR gRNA sequence
cttctttgggtagaggctga

SEQ ID NO: 8911 - DNA, 20 bp, Artificial
  CRISPR gRNA sequence
ttgggtagaggctgagagct

SEQ ID NO: 8912 - DNA, 20 bp, Artificial
  CRISPR gRNA sequence
tgggtagaggctgagagctt

SEQ ID NO: 8913 - DNA, 20 bp, Artificial
  CRISPR gRNA sequence
gggtagaggctgagagcttg

SEQ ID NO: 8914 - DNA, 20 bp, Artificial
  CRISPR gRNA sequence
gctgagagcttggggtccct

SEQ ID NO: 8915 - DNA, 20 bp, Artificial
  CRISPR gRNA sequence
tgagagcttggggtccctta

SEQ ID NO: 8916 - DNA, 20 bp, Artificial
  CRISPR gRNA sequence
ggggtcccttagagtcctct

SEQ ID NO: 8917 - DNA, 20 bp, Artificial
  CRISPR gRNA sequence
gggtcccttagagtcctcta

SEQ ID NO: 8918 - DNA, 20 bp, Artificial
  CRISPR gRNA sequence
ggtcccttagagtcctctaa

SEQ ID NO: 8919 - DNA, 20 bp, Artificial
  CRISPR gRNA sequence
gtcccttagagtcctctaag

SEQ ID NO: 8920 - DNA, 20 bp, Artificial
  CRISPR gRNA sequence
aaggggctcacgactgtttg

SEQ ID NO: 8921 - DNA, 20 bp, Artificial
  CRISPR gRNA sequence
gggctcacgactgtttgtgg

SEQ ID NO: 8922 - DNA, 20 bp, Artificial
  CRISPR gRNA sequence
ggctcacgactgtttgtgga

SEQ ID NO: 8923 - DNA, 20 bp, Artificial
  CRISPR gRNA sequence
tcacgactgtttgtggaagg

SEQ ID NO: 8924 - DNA, 20 bp, Artificial
  CRISPR gRNA sequence
cgactgtttgtggaaggtgg

SEQ ID NO: 8925 - DNA, 20 bp, Artificial
  CRISPR gRNA sequence
gactgtttgtggaaggtggt

SEQ ID NO: 8926 - DNA, 20 bp, Artificial
  CRISPR gRNA sequence
actgtttgtggaaggtggta

SEQ ID NO: 8927 - DNA, 20 bp, Artificial
  CRISPR gRNA sequence
ctgtttgtggaaggtggtag

SEQ ID NO: 8928 - DNA, 20 bp, Artificial
  CRISPR gRNA sequence
tgtggaaggtggtaggggct

SEQ ID NO: 8929 - DNA, 20 bp, Artificial
  CRISPR gRNA sequence
tggaaggtggtaggggcttg

SEQ ID NO: 8930 - DNA, 20 bp, Artificial
  CRISPR gRNA sequence
tggtaggggcttggagctaa

SEQ ID NO: 8931 - DNA, 20 bp, Artificial
  CRISPR gRNA sequence
tggagctaacagattgttca

SEQ ID NO: 8932 - DNA, 20 bp, Artificial
  CRISPR gRNA sequence
ggagctaacagattgttcat

SEQ ID NO: 8933 - DNA, 20 bp, Artificial
  CRISPR gRNA sequence
tcataggttctattctgccc

SEQ ID NO: 8934 - DNA, 20 bp, Artificial
  CRISPR gRNA sequence
ttctgccccagctctccgtg

SEQ ID NO: 8935 - DNA, 20 bp, Artificial
  CRISPR gRNA sequence
ctgccccagctctccgtgtg

SEQ ID NO: 8936 - DNA, 20 bp, Artificial
  CRISPR gRNA sequence
tgccccagctctccgtgtgg

SEQ ID NO: 8937 - DNA, 20 bp, Artificial
  CRISPR gRNA sequence
agctctccgtgtggaggccc

SEQ ID NO: 8938 - DNA, 20 bp, Artificial
  CRISPR gRNA sequence
gctctccgtgtggaggccct

SEQ ID NO: 8939 - DNA, 20 bp, Artificial
  CRISPR gRNA sequence
ctctccgtgtggaggcccta

SEQ ID NO: 8940 - DNA, 20 bp, Artificial
  CRISPR gRNA sequence
ggaggccctagggtcctgct

SEQ ID NO: 8941 - DNA, 20 bp, Artificial
  CRISPR gRNA sequence
ccctagggtcctgctcagca

SEQ ID NO: 8942 - DNA, 20 bp, Artificial
  CRISPR gRNA sequence
gtcctgctcagcatagctct

SEQ ID NO: 8943 - DNA, 20 bp, Artificial
  CRISPR gRNA sequence
cctgctcagcatagctctca

SEQ ID NO: 8944 - DNA, 20 bp, Artificial
  CRISPR gRNA sequence
tcagcatagctctcagagcc

SEQ ID NO: 8945 - DNA, 20 bp, Artificial
  CRISPR gRNA sequence
agctctcagagccaagtcac

SEQ ID NO: 8946 - DNA, 20 bp, Artificial
  CRISPR gRNA sequence
gctctcagagccaagtcaca

SEQ ID NO: 8947 - DNA, 20 bp, Artificial
  CRISPR gRNA sequence
tctcagagccaagtcacaag

SEQ ID NO: 8948 - DNA, 20 bp, Artificial
  CRISPR gRNA sequence
tcagagccaagtcacaagga

SEQ ID NO: 8949 - DNA, 20 bp, Artificial
  CRISPR gRNA sequence
cagagccaagtcacaaggag

SEQ ID NO: 8950 - DNA, 20 bp, Artificial
  CRISPR gRNA sequence
ccaagtcacaaggagaggac

SEQ ID NO: 8951 - DNA, 20 bp, Artificial
  CRISPR gRNA sequence
caagtcacaaggagaggact

SEQ ID NO: 8952 - DNA, 20 bp, Artificial
  CRISPR gRNA sequence
aagtcacaaggagaggactg

SEQ ID NO: 8953 - DNA, 20 bp, Artificial
  CRISPR gRNA sequence
agtcacaaggagaggactgg

SEQ ID NO: 8954 - DNA, 20 bp, Artificial
  CRISPR gRNA sequence
gagaggactgggggactgcc

SEQ ID NO: 8955 - DNA, 20 bp, Artificial
  CRISPR gRNA sequence
gactgggggactgcctggca

SEQ ID NO: 8956 - DNA, 20 bp, Artificial
  CRISPR gRNA sequence
ctgggggactgcctggcaca

SEQ ID NO: 8957 - DNA, 20 bp, Artificial
  CRISPR gRNA sequence
ggggactgcctggcacagag

SEQ ID NO: 8958 - DNA, 20 bp, Artificial
  CRISPR gRNA sequence
agagcagttgctgatcaaca

SEQ ID NO: 8959 - DNA, 20 bp, Artificial
  CRISPR gRNA sequence
gttgctgatcaacacagctg

SEQ ID NO: 8960 - DNA, 20 bp, Artificial
  CRISPR gRNA sequence
ctgatcaacacagctgcagc

SEQ ID NO: 8961 - DNA, 20 bp, Artificial
  CRISPR gRNA sequence
tgatcaacacagctgcagcc

SEQ ID NO: 8962 - DNA, 20 bp, Artificial
  CRISPR gRNA sequence
gatcaacacagctgcagcca

SEQ ID NO: 8963 - DNA, 20 bp, Artificial
  CRISPR gRNA sequence
acacagctgcagccagggct

SEQ ID NO: 8964 - DNA, 20 bp, Artificial
  CRISPR gRNA sequence
cagctgcagccagggctgag

SEQ ID NO: 8965 - DNA, 20 bp, Artificial
  CRISPR gRNA sequence
gccagggctgagaagatgac

SEQ ID NO: 8966 - DNA, 20 bp, Artificial
  CRISPR gRNA sequence
atgacaagcatttcctctgt

SEQ ID NO: 8967 - DNA, 20 bp, Artificial
  CRISPR gRNA sequence
tgacaagcatttcctctgtc

SEQ ID NO: 8968 - DNA, 20 bp, Artificial
  CRISPR gRNA sequence
acaagcatttcctctgtcag

SEQ ID NO: 8969 - DNA, 20 bp, Artificial
  CRISPR gRNA sequence
aagcatttcctctgtcagga

SEQ ID NO: 8970 - DNA, 20 bp, Artificial
  CRISPR gRNA sequence
gagagacatccatgccactc

SEQ ID NO: 8971 - DNA, 20 bp, Artificial
  CRISPR gRNA sequence
agagacatccatgccactcc

SEQ ID NO: 8972 - DNA, 20 bp, Artificial
  CRISPR gRNA sequence
gagacatccatgccactcca

SEQ ID NO: 8973 - DNA, 20 bp, Artificial
  CRISPR gRNA sequence
ctccagggccctccccatcc

SEQ ID NO: 8974 - DNA, 20 bp, Artificial
  CRISPR gRNA sequence
tccagggccctccccatccc

SEQ ID NO: 8975 - DNA, 20 bp, Artificial
  CRISPR gRNA sequence
agggccctccccatcccagg

SEQ ID NO: 8976 - DNA, 20 bp, Artificial
  CRISPR gRNA sequence
gggccctccccatcccagga

SEQ ID NO: 8977 - DNA, 20 bp, Artificial
  CRISPR gRNA sequence
catcccaggaaggcccctcc

SEQ ID NO: 8978 - DNA, 20 bp, Artificial
  CRISPR gRNA sequence
ggaaggcccctccaagcacc

SEQ ID NO: 8979 - DNA, 20 bp, Artificial
  CRISPR gRNA sequence
caagcacccagtctctaaca

SEQ ID NO: 8980 - DNA, 20 bp, Artificial
  CRISPR gRNA sequence
taacacagcccacttcctca

SEQ ID NO: 8981 - DNA, 20 bp, Artificial
  CRISPR gRNA sequence
cagcccacttcctcacagct

SEQ ID NO: 8982 - DNA, 20 bp, Artificial
  CRISPR gRNA sequence
cacagctgagccccccactg

SEQ ID NO: 8983 - DNA, 20 bp, Artificial
  CRISPR gRNA sequence
gagccccccactgtggtgac

SEQ ID NO: 8984 - DNA, 20 bp, Artificial
  CRISPR gRNA sequence
ccccccactgtggtgactgg

SEQ ID NO: 8985 - DNA, 20 bp, Artificial
  CRISPR gRNA sequence
tgtggtgactggcagtctcc

SEQ ID NO: 8986 - DNA, 20 bp, Artificial
  CRISPR gRNA sequence
gtgactggcagtctcctagt

SEQ ID NO: 8987 - DNA, 20 bp, Artificial
  CRISPR gRNA sequence
tggcagtctcctagtgagac

SEQ ID NO: 8988 - DNA, 20 bp, Artificial
  CRISPR gRNA sequence
agtctcctagtgagaccagt

SEQ ID NO: 8989 - DNA, 20 bp, Artificial
  CRISPR gRNA sequence
cactgcctgcgctgttcaac

SEQ ID NO: 8990 - DNA, 20 bp, Artificial
  CRISPR gRNA sequence
actgcctgcgctgttcaacc

SEQ ID NO: 8991 - DNA, 20 bp, Artificial
  CRISPR gRNA sequence
tgcctgcgctgttcaaccag

SEQ ID NO: 8992 - DNA, 20 bp, Artificial
  CRISPR gRNA sequence
tgcgctgttcaaccaggagc

SEQ ID NO: 8993 - DNA, 20 bp, Artificial
  CRISPR gRNA sequence
ttcaaccaggagccagcctc

SEQ ID NO: 8994 - DNA, 20 bp, Artificial
  CRISPR gRNA sequence
accaggagccagcctccggc

SEQ ID NO: 8995 - DNA, 20 bp, Artificial
  CRISPR gRNA sequence
agcctccggccagatgcgcc

SEQ ID NO: 8996 - DNA, 20 bp, Artificial
  CRISPR gRNA sequence
cctccggccagatgcgcctg

SEQ ID NO: 8997 - DNA, 20 bp, Artificial
  CRISPR gRNA sequence
tgcgcctggagaaaaccgac

SEQ ID NO: 8998 - DNA, 20 bp, Artificial
  CRISPR gRNA sequence
gagaaaaccgaccagattcc

SEQ ID NO: 8999 - DNA, 20 bp, Artificial
  CRISPR gRNA sequence
cgaccagattcccagtatgt

SEQ ID NO: 9000 - DNA, 20 bp, Artificial
  CRISPR gRNA sequence
gaccagattcccagtatgtt

SEQ ID NO: 9001 - DNA, 20 bp, Artificial
  CRISPR gRNA sequence
accagattcccagtatgtta

SEQ ID NO: 9002 - DNA, 20 bp, Artificial
  CRISPR gRNA sequence
ccagattcccagtatgttag

SEQ ID NO: 9003 - DNA, 20 bp, Artificial
  CRISPR gRNA sequence
cagattcccagtatgttagg

SEQ ID NO: 9004 - DNA, 20 bp, Artificial
  CRISPR gRNA sequence
tcccagtatgttagggggct

SEQ ID NO: 9005 - DNA, 20 bp, Artificial
  CRISPR gRNA sequence
ccagtatgttagggggcttg

SEQ ID NO: 9006 - DNA, 20 bp, Artificial
  CRISPR gRNA sequence
agtatgttagggggcttgga

SEQ ID NO: 9007 - DNA, 20 bp, Artificial
  CRISPR gRNA sequence
tatgttagggggcttggaga

SEQ ID NO: 9008 - DNA, 20 bp, Artificial
  CRISPR gRNA sequence
gttagggggcttggagagag

SEQ ID NO: 9009 - DNA, 20 bp, Artificial
  CRISPR gRNA sequence
ttagggggcttggagagagt

SEQ ID NO: 9010 - DNA, 20 bp, Artificial
  CRISPR gRNA sequence
agagtgggctttctccctct

SEQ ID NO: 9011 - DNA, 20 bp, Artificial
  CRISPR gRNA sequence
gagtgggctttctccctctt

SEQ ID NO: 9012 - DNA, 20 bp, Artificial
  CRISPR gRNA sequence
gtgggctttctccctcttgg

SEQ ID NO: 9013 - DNA, 20 bp, Artificial
  CRISPR gRNA sequence
tgggctttctccctcttggg

SEQ ID NO: 9014 - DNA, 20 bp, Artificial
  CRISPR gRNA sequence
gctttctccctcttgggagg

SEQ ID NO: 9015 - DNA, 20 bp, Artificial
  CRISPR gRNA sequence
ctccctcttgggaggtggat

SEQ ID NO: 9016 - DNA, 20 bp, Artificial
  CRISPR gRNA sequence
tccctcttgggaggtggata

SEQ ID NO: 9017 - DNA, 20 bp, Artificial
  CRISPR gRNA sequence
cctcttgggaggtggataag

SEQ ID NO: 9018 - DNA, 20 bp, Artificial
  CRISPR gRNA sequence
gtggataaggagttgacact

SEQ ID NO: 9019 - DNA, 20 bp, Artificial
  CRISPR gRNA sequence
tggataaggagttgacacta

SEQ ID NO: 9020 - DNA, 20 bp, Artificial
  CRISPR gRNA sequence
ataaggagttgacactaagg

SEQ ID NO: 9021 - DNA, 20 bp, Artificial
  CRISPR gRNA sequence
taaggagttgacactaaggc

SEQ ID NO: 9022 - DNA, 20 bp, Artificial
  CRISPR gRNA sequence
aaggagttgacactaaggca

SEQ ID NO: 9023 - DNA, 20 bp, Artificial
  CRISPR gRNA sequence
gacactaaggcagggactgt

SEQ ID NO: 9024 - DNA, 20 bp, Artificial
  CRISPR gRNA sequence
acactaaggcagggactgtc

SEQ ID NO: 9025 - DNA, 20 bp, Artificial
  CRISPR gRNA sequence
aggcagggactgtcaggaac

SEQ ID NO: 9026 - DNA, 20 bp, Artificial
  CRISPR gRNA sequence
tcacctctccccaaccctat

SEQ ID NO: 9027 - DNA, 20 bp, Artificial
  CRISPR gRNA sequence
agtgtcactcacctctgccc

SEQ ID NO: 9028 - DNA, 20 bp, Artificial
  CRISPR gRNA sequence
tcactcacctctgccccagc

SEQ ID NO: 9029 - DNA, 20 bp, Artificial
  CRISPR gRNA sequence
gccccagccagttttatcct

SEQ ID NO: 9030 - DNA, 20 bp, Artificial
  CRISPR gRNA sequence
ccccagccagttttatcctt

SEQ ID NO: 9031 - DNA, 20 bp, Artificial
  CRISPR gRNA sequence
cccagccagttttatccttg

SEQ ID NO: 9032 - DNA, 20 bp, Artificial
  CRISPR gRNA sequence
tttatccttggggcccccgt

SEQ ID NO: 9033 - DNA, 20 bp, Artificial
  CRISPR gRNA sequence
gcccccgtcagctcaatccc

SEQ ID NO: 9034 - DNA, 20 bp, Artificial
  CRISPR gRNA sequence
cccgtcagctcaatccctgg

SEQ ID NO: 9035 - DNA, 20 bp, Artificial
  CRISPR gRNA sequence
cgtcagctcaatccctggca

SEQ ID NO: 9036 - DNA, 20 bp, Artificial
  CRISPR gRNA sequence
ccctggcagagaacatgcct

SEQ ID NO: 9037 - DNA, 20 bp, Artificial
  CRISPR gRNA sequence
tggcagagaacatgcctcag

SEQ ID NO: 9038 - DNA, 20 bp, Artificial
  CRISPR gRNA sequence
ggcagagaacatgcctcaga

SEQ ID NO: 9039 - DNA, 20 bp, Artificial
  CRISPR gRNA sequence
agaaggaaacacatccgtgc

SEQ ID NO: 9040 - DNA, 20 bp, Artificial
  CRISPR gRNA sequence
aaacacatccgtgcgagcat

SEQ ID NO: 9041 - DNA, 20 bp, Artificial
  CRISPR gRNA sequence
aacacatccgtgcgagcatc

SEQ ID NO: 9042 - DNA, 20 bp, Artificial
  CRISPR gRNA sequence
cacatccgtgcgagcatcag

SEQ ID NO: 9043 - DNA, 20 bp, Artificial
  CRISPR gRNA sequence
acatccgtgcgagcatcagg

SEQ ID NO: 9044 - DNA, 20 bp, Artificial
  CRISPR gRNA sequence
catccgtgcgagcatcagga

SEQ ID NO: 9045 - DNA, 20 bp, Artificial
  CRISPR gRNA sequence
aggagggaatctccaccaat

SEQ ID NO: 9046 - DNA, 20 bp, Artificial
  CRISPR gRNA sequence
gagggaatctccaccaatta

SEQ ID NO: 9047 - DNA, 20 bp, Artificial
  CRISPR gRNA sequence
caattagagcattcacctgc

SEQ ID NO: 9048 - DNA, 20 bp, Artificial
  CRISPR gRNA sequence
tgccagccttattcgttcat

SEQ ID NO: 9049 - DNA, 20 bp, Artificial
  CRISPR gRNA sequence
attcgttcatcagctcttca

SEQ ID NO: 9050 - DNA, 20 bp, Artificial
  CRISPR gRNA sequence
tcgttcatcagctcttcatg

SEQ ID NO: 9051 - DNA, 20 bp, Artificial
  CRISPR gRNA sequence
ctctgtgccaactgctctgc

SEQ ID NO: 9052 - DNA, 20 bp, Artificial
  CRISPR gRNA sequence
tctgtgccaactgctctgct

SEQ ID NO: 9053 - DNA, 20 bp, Artificial
  CRISPR gRNA sequence
caactgctctgctaggtgct

SEQ ID NO: 9054 - DNA, 20 bp, Artificial
  CRISPR gRNA sequence
ctaggtgctaagaattccat

SEQ ID NO: 9055 - DNA, 20 bp, Artificial
  CRISPR gRNA sequence
taggtgctaagaattccatc

SEQ ID NO: 9056 - DNA, 20 bp, Artificial
  CRISPR gRNA sequence
aggtgctaagaattccatca

SEQ ID NO: 9057 - DNA, 20 bp, Artificial
  CRISPR gRNA sequence
tgctaagaattccatcaggg

SEQ ID NO: 9058 - DNA, 20 bp, Artificial
  CRISPR gRNA sequence
gctaagaattccatcagggc

SEQ ID NO: 9059 - DNA, 20 bp, Artificial
  CRISPR gRNA sequence
agaattccatcagggcagga

SEQ ID NO: 9060 - DNA, 20 bp, Artificial
  CRISPR gRNA sequence
ccatcagggcaggacagaaa

SEQ ID NO: 9061 - DNA, 20 bp, Artificial
  CRISPR gRNA sequence
acagaaacagctactgctct

SEQ ID NO: 9062 - DNA, 20 bp, Artificial
  CRISPR gRNA sequence
cagaaacagctactgctctt

SEQ ID NO: 9063 - DNA, 20 bp, Artificial
  CRISPR gRNA sequence
agaaacagctactgctctta

SEQ ID NO: 9064 - DNA, 20 bp, Artificial
  CRISPR gRNA sequence
gctactgctcttagggaaat

SEQ ID NO: 9065 - DNA, 20 bp, Artificial
  CRISPR gRNA sequence
ctactgctcttagggaaatt

SEQ ID NO: 9066 - DNA, 20 bp, Artificial
  CRISPR gRNA sequence
tactgctcttagggaaatta

SEQ ID NO: 9067 - DNA, 20 bp, Artificial
  CRISPR gRNA sequence
ttagggaaattagggccctt

SEQ ID NO: 9068 - DNA, 20 bp, Artificial
  CRISPR gRNA sequence
tagggaaattagggcccttt

SEQ ID NO: 9069 - DNA, 20 bp, Artificial
  CRISPR gRNA sequence
agggaaattagggcccttta

SEQ ID NO: 9070 - DNA, 20 bp, Artificial
  CRISPR gRNA sequence
gggaaattagggccctttag

SEQ ID NO: 9071 - DNA, 20 bp, Artificial
  CRISPR gRNA sequence
ggaaattagggccctttagg

SEQ ID NO: 9072 - DNA, 20 bp, Artificial
  CRISPR gRNA sequence
gaaattagggccctttaggg

SEQ ID NO: 9073 - DNA, 20 bp, Artificial
  CRISPR gRNA sequence
ttagggccctttaggggggt

SEQ ID NO: 9074 - DNA, 20 bp, Artificial
  CRISPR gRNA sequence
gggtcagacattaatcaaat

SEQ ID NO: 9075 - DNA, 20 bp, Artificial
  CRISPR gRNA sequence
gacattaatcaaataagcaa

SEQ ID NO: 9076 - DNA, 20 bp, Artificial
  CRISPR gRNA sequence
attaatcaaataagcaaaag

SEQ ID NO: 9077 - DNA, 20 bp, Artificial
  CRISPR gRNA sequence
caaaagcagaatcgcaaaca

SEQ ID NO: 9078 - DNA, 20 bp, Artificial
  CRISPR gRNA sequence
aaaagcagaatcgcaaacac

SEQ ID NO: 9079 - DNA, 20 bp, Artificial
  CRISPR gRNA sequence
cgcaaacacaggtgctatgc

SEQ ID NO: 9080 - DNA, 20 bp, Artificial
  CRISPR gRNA sequence
ctcactgcctttgtctcttg

SEQ ID NO: 9081 - DNA, 20 bp, Artificial
  CRISPR gRNA sequence
tctcttgcagtgcctttctc

SEQ ID NO: 9082 - DNA, 20 bp, Artificial
  CRISPR gRNA sequence
cctttctccagttcctcgtt

SEQ ID NO: 9083 - DNA, 20 bp, Artificial
  CRISPR gRNA sequence
tgagctgcctgaatctccct

SEQ ID NO: 9084 - DNA, 20 bp, Artificial
  CRISPR gRNA sequence
gagctgcctgaatctccctg

SEQ ID NO: 9085 - DNA, 20 bp, Artificial
  CRISPR gRNA sequence
agctgcctgaatctccctga

SEQ ID NO: 9086 - DNA, 20 bp, Artificial
  CRISPR gRNA sequence
atctccctgagggacccatc

SEQ ID NO: 9087 - DNA, 20 bp, Artificial
  CRISPR gRNA sequence
accatctccactctgcccca

SEQ ID NO: 9088 - DNA, 20 bp, Artificial
  CRISPR gRNA sequence
ccatctccactctgccccat

SEQ ID NO: 9089 - DNA, 20 bp, Artificial
  CRISPR gRNA sequence
ccactctgccccatgggctc

SEQ ID NO: 9090 - DNA, 20 bp, Artificial
  CRISPR gRNA sequence
atgggctctggcaaatctct

SEQ ID NO: 9091 - DNA, 20 bp, Artificial
  CRISPR gRNA sequence
tgggctctggcaaatctctg

SEQ ID NO: 9092 - DNA, 20 bp, Artificial
  CRISPR gRNA sequence
ctctggcaaatctctgaggc

SEQ ID NO: 9093 - DNA, 20 bp, Artificial
  CRISPR gRNA sequence
gcaaatctctgaggctggaa

SEQ ID NO: 9094 - DNA, 20 bp, Artificial
  CRISPR gRNA sequence
caaatctctgaggctggaac

SEQ ID NO: 9095 - DNA, 20 bp, Artificial
  CRISPR gRNA sequence
aaatctctgaggctggaaca

SEQ ID NO: 9096 - DNA, 20 bp, Artificial
  CRISPR gRNA sequence
aatctctgaggctggaacag

SEQ ID NO: 9097 - DNA, 20 bp, Artificial
  CRISPR gRNA sequence
gaggctggaacaggggtctc

SEQ ID NO: 9098 - DNA, 20 bp, Artificial
  CRISPR gRNA sequence
tccagtatattcatctacca

SEQ ID NO: 9099 - DNA, 20 bp, Artificial
  CRISPR gRNA sequence
gtatattcatctaccatggt

SEQ ID NO: 9100 - DNA, 20 bp, Artificial
  CRISPR gRNA sequence
ttcatctaccatggtgagtg

SEQ ID NO: 9101 - DNA, 20 bp, Artificial
  CRISPR gRNA sequence
tcatctaccatggtgagtgc

SEQ ID NO: 9102 - DNA, 20 bp, Artificial
  CRISPR gRNA sequence
catctaccatggtgagtgcg

SEQ ID NO: 9103 - DNA, 20 bp, Artificial
  CRISPR gRNA sequence
accatggtgagtgcggggcc

SEQ ID NO: 9104 - DNA, 20 bp, Artificial
  CRISPR gRNA sequence
ctccccatactccatgcact

SEQ ID NO: 9105 - DNA, 20 bp, Artificial
  CRISPR gRNA sequence
cccatactccatgcacttgg

SEQ ID NO: 9106 - DNA, 20 bp, Artificial
  CRISPR gRNA sequence
atactccatgcacttggcag

SEQ ID NO: 9107 - DNA, 20 bp, Artificial
  CRISPR gRNA sequence
tgcacttggcagtggtgccc

SEQ ID NO: 9108 - DNA, 20 bp, Artificial
  CRISPR gRNA sequence
ttctcatgatcctccctccc

SEQ ID NO: 9109 - DNA, 20 bp, Artificial
  CRISPR gRNA sequence
tccctatttcccaaaaatca

SEQ ID NO: 9110 - DNA, 20 bp, Artificial
  CRISPR gRNA sequence
ctatttcccaaaaatcaaag

SEQ ID NO: 9111 - DNA, 20 bp, Artificial
  CRISPR gRNA sequence
tttcccaaaaatcaaagcag

SEQ ID NO: 9112 - DNA, 20 bp, Artificial
  CRISPR gRNA sequence
tcccaaaaatcaaagcagaa

SEQ ID NO: 9113 - DNA, 20 bp, Artificial
  CRISPR gRNA sequence
caaaaatcaaagcagaagag

SEQ ID NO: 9114 - DNA, 20 bp, Artificial
  CRISPR gRNA sequence
aaaatcaaagcagaagagca

SEQ ID NO: 9115 - DNA, 20 bp, Artificial
  CRISPR gRNA sequence
gcagaagagcagagattcct

SEQ ID NO: 9116 - DNA, 20 bp, Artificial
  CRISPR gRNA sequence
cagaagagcagagattcctg

SEQ ID NO: 9117 - DNA, 20 bp, Artificial
  CRISPR gRNA sequence
aagagcagagattcctgagg

SEQ ID NO: 9118 - DNA, 20 bp, Artificial
  CRISPR gRNA sequence
cagagattcctgaggtggtc

SEQ ID NO: 9119 - DNA, 20 bp, Artificial
  CRISPR gRNA sequence
agagattcctgaggtggtct

SEQ ID NO: 9120 - DNA, 20 bp, Artificial
  CRISPR gRNA sequence
ggtggtctgggtgcatgacc

SEQ ID NO: 9121 - DNA, 20 bp, Artificial
  CRISPR gRNA sequence
tggtctgggtgcatgaccaa

SEQ ID NO: 9122 - DNA, 20 bp, Artificial
  CRISPR gRNA sequence
tctgggtgcatgaccaagag

SEQ ID NO: 9123 - DNA, 20 bp, Artificial
  CRISPR gRNA sequence
catgaccaagagtggttgtg

SEQ ID NO: 9124 - DNA, 20 bp, Artificial
  CRISPR gRNA sequence
tgctttccccttctgaccct

SEQ ID NO: 9125 - DNA, 20 bp, Artificial
  CRISPR gRNA sequence
atcaatacatgctcactaat

SEQ ID NO: 9126 - DNA, 20 bp, Artificial
  CRISPR gRNA sequence
ctcactaataagctaatgac

SEQ ID NO: 9127 - DNA, 20 bp, Artificial
  CRISPR gRNA sequence
taatgacaagtgatgtttac

SEQ ID NO: 9128 - DNA, 20 bp, Artificial
  CRISPR gRNA sequence
cactgtctctctcactcttt

SEQ ID NO: 9129 - DNA, 20 bp, Artificial
  CRISPR gRNA sequence
ttttagtatactgatgtgaa

SEQ ID NO: 9130 - DNA, 20 bp, Artificial
  CRISPR gRNA sequence
gtatactgatgtgaatagtt

SEQ ID NO: 9131 - DNA, 20 bp, Artificial
  CRISPR gRNA sequence
gtttggtgtgcatccttgca

SEQ ID NO: 9132 - DNA, 20 bp, Artificial
  CRISPR gRNA sequence
gatttgtcttgtttcctaat

SEQ ID NO: 9133 - DNA, 20 bp, Artificial
  CRISPR gRNA sequence
ttgtttcctaatcagtaaaa

SEQ ID NO: 9134 - DNA, 20 bp, Artificial
  CRISPR gRNA sequence
ccctactgacccaccacact

SEQ ID NO: 9135 - DNA, 20 bp, Artificial
  CRISPR gRNA sequence
cctactgacccaccacactg

SEQ ID NO: 9136 - DNA, 20 bp, Artificial
  CRISPR gRNA sequence
ctactgacccaccacactga

SEQ ID NO: 9137 - DNA, 20 bp, Artificial
  CRISPR gRNA sequence
tactgacccaccacactgag

SEQ ID NO: 9138 - DNA, 20 bp, Artificial
  CRISPR gRNA sequence
tgaggggttgtgacttgtct

SEQ ID NO: 9139 - DNA, 20 bp, Artificial
  CRISPR gRNA sequence
gaggggttgtgacttgtctc

SEQ ID NO: 9140 - DNA, 20 bp, Artificial
  CRISPR gRNA sequence
aggggttgtgacttgtctca

SEQ ID NO: 9141 - DNA, 20 bp, Artificial
  CRISPR gRNA sequence
ggttgtgacttgtctcaggg

SEQ ID NO: 9142 - DNA, 20 bp, Artificial
  CRISPR gRNA sequence
gttgtgacttgtctcaggga

SEQ ID NO: 9143 - DNA, 20 bp, Artificial
  CRISPR gRNA sequence
tgtctcagggaaggtgtgtt

SEQ ID NO: 9144 - DNA, 20 bp, Artificial
  CRISPR gRNA sequence
gtctcagggaaggtgtgttt

SEQ ID NO: 9145 - DNA, 20 bp, Artificial
  CRISPR gRNA sequence
ggaaggtgtgtttgggctgt

SEQ ID NO: 9146 - DNA, 20 bp, Artificial
  CRISPR gRNA sequence
gaaggtgtgtttgggctgtc

SEQ ID NO: 9147 - DNA, 20 bp, Artificial
  CRISPR gRNA sequence
aaggtgtgtttgggctgtca

SEQ ID NO: 9148 - DNA, 20 bp, Artificial
  CRISPR gRNA sequence
gtgtttgggctgtcagggat

SEQ ID NO: 9149 - DNA, 20 bp, Artificial
  CRISPR gRNA sequence
tgggctgtcagggatgagac

SEQ ID NO: 9150 - DNA, 20 bp, Artificial
  CRISPR gRNA sequence
gggctgtcagggatgagacc

SEQ ID NO: 9151 - DNA, 20 bp, Artificial
  CRISPR gRNA sequence
gctgtcagggatgagaccag

SEQ ID NO: 9152 - DNA, 20 bp, Artificial
  CRISPR gRNA sequence
ctgtcagggatgagaccagg

SEQ ID NO: 9153 - DNA, 20 bp, Artificial
  CRISPR gRNA sequence
ccaggaggatgcttccactc

SEQ ID NO: 9154 - DNA, 20 bp, Artificial
  CRISPR gRNA sequence
aggatgcttccactcaagtc

SEQ ID NO: 9155 - DNA, 20 bp, Artificial
  CRISPR gRNA sequence
gatgcttccactcaagtcca

SEQ ID NO: 9156 - DNA, 20 bp, Artificial
  CRISPR gRNA sequence
aagtccagagcatccattcc

SEQ ID NO: 9157 - DNA, 20 bp, Artificial
  CRISPR gRNA sequence
gagcatccattcctggttgc

SEQ ID NO: 9158 - DNA, 20 bp, Artificial
  CRISPR gRNA sequence
atccattcctggttgcaaga

SEQ ID NO: 9159 - DNA, 20 bp, Artificial
  CRISPR gRNA sequence
tcctggttgcaagacagttt

SEQ ID NO: 9160 - DNA, 20 bp, Artificial
  CRISPR gRNA sequence
acagtttcagtataacgcac

SEQ ID NO: 9161 - DNA, 20 bp, Artificial
  CRISPR gRNA sequence
agtataacgcactggtatct

SEQ ID NO: 9162 - DNA, 20 bp, Artificial
  CRISPR gRNA sequence
ataacgcactggtatctcag

SEQ ID NO: 9163 - DNA, 20 bp, Artificial
  CRISPR gRNA sequence
acgcactggtatctcagaag

SEQ ID NO: 9164 - DNA, 20 bp, Artificial
  CRISPR gRNA sequence
gcactggtatctcagaagca

SEQ ID NO: 9165 - DNA, 20 bp, Artificial
  CRISPR gRNA sequence
ctggtatctcagaagcagag

SEQ ID NO: 9166 - DNA, 20 bp, Artificial
  CRISPR gRNA sequence
gtatctcagaagcagagaag

SEQ ID NO: 9167 - DNA, 20 bp, Artificial
  CRISPR gRNA sequence
gagaagcagttcctgatatc

SEQ ID NO: 9168 - DNA, 20 bp, Artificial
  CRISPR gRNA sequence
agaagcagttcctgatatct

SEQ ID NO: 9169 - DNA, 20 bp, Artificial
  CRISPR gRNA sequence
ttcctgatatctaggaaaat

SEQ ID NO: 9170 - DNA, 20 bp, Artificial
  CRISPR gRNA sequence
gaaaatgagcactgaccaca

SEQ ID NO: 9171 - DNA, 20 bp, Artificial
  CRISPR gRNA sequence
aatgagcactgaccacacag

SEQ ID NO: 9172 - DNA, 20 bp, Artificial
  CRISPR gRNA sequence
atgagcactgaccacacagc

SEQ ID NO: 9173 - DNA, 20 bp, Artificial
  CRISPR gRNA sequence
agcactgaccacacagcagg

SEQ ID NO: 9174 - DNA, 20 bp, Artificial
  CRISPR gRNA sequence
cactgaccacacagcaggaa

SEQ ID NO: 9175 - DNA, 20 bp, Artificial
  CRISPR gRNA sequence
acacagcaggaagagtgcaa

SEQ ID NO: 9176 - DNA, 20 bp, Artificial
  CRISPR gRNA sequence
cagcaggaagagtgcaatag

SEQ ID NO: 9177 - DNA, 20 bp, Artificial
  CRISPR gRNA sequence
gcaatagtagtacctgccct

SEQ ID NO: 9178 - DNA, 20 bp, Artificial
  CRISPR gRNA sequence
acctgccctaagttccttat

SEQ ID NO: 9179 - DNA, 20 bp, Artificial
  CRISPR gRNA sequence
agctaattgcacccatttca

SEQ ID NO: 9180 - DNA, 20 bp, Artificial
  CRISPR gRNA sequence
attgcacccatttcacagat

SEQ ID NO: 9181 - DNA, 20 bp, Artificial
  CRISPR gRNA sequence
acccatttcacagattggaa

SEQ ID NO: 9182 - DNA, 20 bp, Artificial
  CRISPR gRNA sequence
atttcacagattggaaaagc

SEQ ID NO: 9183 - DNA, 20 bp, Artificial
  CRISPR gRNA sequence
tttcacagattggaaaagca

SEQ ID NO: 9184 - DNA, 20 bp, Artificial
  CRISPR gRNA sequence
agattggaaaagcaaggttc

SEQ ID NO: 9185 - DNA, 20 bp, Artificial
  CRISPR gRNA sequence
gattggaaaagcaaggttcc

SEQ ID NO: 9186 - DNA, 20 bp, Artificial
  CRISPR gRNA sequence
ttggaaaagcaaggttccag

SEQ ID NO: 9187 - DNA, 20 bp, Artificial
  CRISPR gRNA sequence
aaaagcaaggttccaggagc

SEQ ID NO: 9188 - DNA, 20 bp, Artificial
  CRISPR gRNA sequence
ccaggagctagatgtaactc

SEQ ID NO: 9189 - DNA, 20 bp, Artificial
  CRISPR gRNA sequence
aggagctagatgtaactcca

SEQ ID NO: 9190 - DNA, 20 bp, Artificial
  CRISPR gRNA sequence
taactccagagctctttctt

SEQ ID NO: 9191 - DNA, 20 bp, Artificial
  CRISPR gRNA sequence
tgtcctgaaatatcttcctt

SEQ ID NO: 9192 - DNA, 20 bp, Artificial
  CRISPR gRNA sequence
cctgaaatatcttcctttgg

SEQ ID NO: 9193 - DNA, 20 bp, Artificial
  CRISPR gRNA sequence
aagttctactctcttctctc

SEQ ID NO: 9194 - DNA, 20 bp, Artificial
  CRISPR gRNA sequence
ctcttctctccagacttcct

SEQ ID NO: 9195 - DNA, 20 bp, Artificial
  CRISPR gRNA sequence
tccagacttcctgagctcca

SEQ ID NO: 9196 - DNA, 20 bp, Artificial
  CRISPR gRNA sequence
acttcctgagctccacagcc

SEQ ID NO: 9197 - DNA, 20 bp, Artificial
  CRISPR gRNA sequence
ctgagctccacagcccagtt

SEQ ID NO: 9198 - DNA, 20 bp, Artificial
  CRISPR gRNA sequence
gagctccacagcccagtttg

SEQ ID NO: 9199 - DNA, 20 bp, Artificial
  CRISPR gRNA sequence
ctccacagcccagtttggag

SEQ ID NO: 9200 - DNA, 20 bp, Artificial
  CRISPR gRNA sequence
tccacagcccagtttggagt

SEQ ID NO: 9201 - DNA, 20 bp, Artificial
  CRISPR gRNA sequence
ccacagcccagtttggagta

SEQ ID NO: 9202 - DNA, 20 bp, Artificial
  CRISPR gRNA sequence
cacagcccagtttggagtag

SEQ ID NO: 9203 - DNA, 20 bp, Artificial
  CRISPR gRNA sequence
gtttggagtaggggtgaccc

SEQ ID NO: 9204 - DNA, 20 bp, Artificial
  CRISPR gRNA sequence
gggtgacccaagtgcatttc

SEQ ID NO: 9205 - DNA, 20 bp, Artificial
  CRISPR gRNA sequence
gcatttctggaatcaatacc

SEQ ID NO: 9206 - DNA, 20 bp, Artificial
  CRISPR gRNA sequence
accactctccacccccaatg

SEQ ID NO: 9207 - DNA, 20 bp, Artificial
  CRISPR gRNA sequence
ccactctccacccccaatgt

SEQ ID NO: 9208 - DNA, 20 bp, Artificial
  CRISPR gRNA sequence
tctccacccccaatgtaggt

SEQ ID NO: 9209 - DNA, 20 bp, Artificial
  CRISPR gRNA sequence
ctccacccccaatgtaggtg

SEQ ID NO: 9210 - DNA, 20 bp, Artificial
  CRISPR gRNA sequence
ccaatgtaggtgaggtgccc

SEQ ID NO: 9211 - DNA, 20 bp, Artificial
  CRISPR gRNA sequence
caatgtaggtgaggtgcccc

SEQ ID NO: 9212 - DNA, 20 bp, Artificial
  CRISPR gRNA sequence
gtaggtgaggtgccccaggc

SEQ ID NO: 9213 - DNA, 20 bp, Artificial
  CRISPR gRNA sequence
tgaggtgccccaggccagcc

SEQ ID NO: 9214 - DNA, 20 bp, Artificial
  CRISPR gRNA sequence
gccagccaagtaccccctcc

SEQ ID NO: 9215 - DNA, 20 bp, Artificial
  CRISPR gRNA sequence
agccaagtaccccctcccag

SEQ ID NO: 9216 - DNA, 20 bp, Artificial
  CRISPR gRNA sequence
cccagtggattcactgtcca

SEQ ID NO: 9217 - DNA, 20 bp, Artificial
  CRISPR gRNA sequence
ccacggcctcccaacatctc

SEQ ID NO: 9218 - DNA, 20 bp, Artificial
  CRISPR gRNA sequence
gcctcccaacatctccagac

SEQ ID NO: 9219 - DNA, 20 bp, Artificial
  CRISPR gRNA sequence
cccaacatctccagaccggc

SEQ ID NO: 9220 - DNA, 20 bp, Artificial
  CRISPR gRNA sequence
ccaacatctccagaccggcc

SEQ ID NO: 9221 - DNA, 20 bp, Artificial
  CRISPR gRNA sequence
ccagaccggccaggctccac

SEQ ID NO: 9222 - DNA, 20 bp, Artificial
  CRISPR gRNA sequence
caccagccccttcgctccat

SEQ ID NO: 9223 - DNA, 20 bp, Artificial
  CRISPR gRNA sequence
ccatcagccactgacctgcc

SEQ ID NO: 9224 - DNA, 20 bp, Artificial
  CRISPR gRNA sequence
tgaacctgccctgacctccc

SEQ ID NO: 9225 - DNA, 20 bp, Artificial
  CRISPR gRNA sequence
gacctcccgagcaaacatga

SEQ ID NO: 9226 - DNA, 20 bp, Artificial
  CRISPR gRNA sequence
acctcccgagcaaacatgac

SEQ ID NO: 9227 - DNA, 20 bp, Artificial
  CRISPR gRNA sequence
cccgagcaaacatgacaggt

SEQ ID NO: 9228 - DNA, 20 bp, Artificial
  CRISPR gRNA sequence
ccgagcaaacatgacaggta

SEQ ID NO: 9229 - DNA, 20 bp, Artificial
  CRISPR gRNA sequence
acatgacaggtaaggaccct

SEQ ID NO: 9230 - DNA, 20 bp, Artificial
  CRISPR gRNA sequence
catgacaggtaaggaccctt

SEQ ID NO: 9231 - DNA, 20 bp, Artificial
  CRISPR gRNA sequence
atgacaggtaaggaccctta

SEQ ID NO: 9232 - DNA, 20 bp, Artificial
  CRISPR gRNA sequence
taaggacccttagggcctgt

SEQ ID NO: 9233 - DNA, 20 bp, Artificial
  CRISPR gRNA sequence
aggacccttagggcctgtga

SEQ ID NO: 9234 - DNA, 20 bp, Artificial
  CRISPR gRNA sequence
ggacccttagggcctgtgag

SEQ ID NO: 9235 - DNA, 20 bp, Artificial
  CRISPR gRNA sequence
ttagggcctgtgagaggtac

SEQ ID NO: 9236 - DNA, 20 bp, Artificial
  CRISPR gRNA sequence
gggcctgtgagaggtactag

SEQ ID NO: 9237 - DNA, 20 bp, Artificial
  CRISPR gRNA sequence
cctgtgagaggtactagaag

SEQ ID NO: 9238 - DNA, 20 bp, Artificial
  CRISPR gRNA sequence
ctgtgagaggtactagaagc

SEQ ID NO: 9239 - DNA, 20 bp, Artificial
  CRISPR gRNA sequence
gaggtactagaagcaggatc

SEQ ID NO: 9240 - DNA, 20 bp, Artificial
  CRISPR gRNA sequence
aggtactagaagcaggatcg

SEQ ID NO: 9241 - DNA, 20 bp, Artificial
  CRISPR gRNA sequence
tagaagcaggatcgaggccc

SEQ ID NO: 9242 - DNA, 20 bp, Artificial
  CRISPR gRNA sequence
agaagcaggatcgaggccct

SEQ ID NO: 9243 - DNA, 20 bp, Artificial
  CRISPR gRNA sequence
gaagcaggatcgaggccctg

SEQ ID NO: 9244 - DNA, 20 bp, Artificial
  CRISPR gRNA sequence
gcaggatcgaggccctgggg

SEQ ID NO: 9245 - DNA, 20 bp, Artificial
  CRISPR gRNA sequence
caggatcgaggccctgggga

SEQ ID NO: 9246 - DNA, 20 bp, Artificial
  CRISPR gRNA sequence
gggaaggaattgtctcaaat

SEQ ID NO: 9247 - DNA, 20 bp, Artificial
  CRISPR gRNA sequence
ttgtctcaaataagatccac

SEQ ID NO: 9248 - DNA, 20 bp, Artificial
  CRISPR gRNA sequence
tcaaataagatccacaagca

SEQ ID NO: 9249 - DNA, 20 bp, Artificial
  CRISPR gRNA sequence
tccacaagcaaagctgcctg

SEQ ID NO: 9250 - DNA, 20 bp, Artificial
  CRISPR gRNA sequence
ccacaagcaaagctgcctgt

SEQ ID NO: 9251 - DNA, 20 bp, Artificial
  CRISPR gRNA sequence
cacaagcaaagctgcctgta

SEQ ID NO: 9252 - DNA, 20 bp, Artificial
  CRISPR gRNA sequence
aaagctgcctgtagggacaa

SEQ ID NO: 9253 - DNA, 20 bp, Artificial
  CRISPR gRNA sequence
aagctgcctgtagggacaac

SEQ ID NO: 9254 - DNA, 20 bp, Artificial
  CRISPR gRNA sequence
tagggacaacaggtcatgtt

SEQ ID NO: 9255 - DNA, 20 bp, Artificial
  CRISPR gRNA sequence
agggacaacaggtcatgttt

SEQ ID NO: 9256 - DNA, 20 bp, Artificial
  CRISPR gRNA sequence
gggacaacaggtcatgttta

SEQ ID NO: 9257 - DNA, 20 bp, Artificial
  CRISPR gRNA sequence
ggacaacaggtcatgtttag

SEQ ID NO: 9258 - DNA, 20 bp, Artificial
  CRISPR gRNA sequence
aacaggtcatgtttaggggt

SEQ ID NO: 9259 - DNA, 20 bp, Artificial
  CRISPR gRNA sequence
ggtcatgtttaggggtcagt

SEQ ID NO: 9260 - DNA, 20 bp, Artificial
  CRISPR gRNA sequence
gtcatgtttaggggtcagtc

SEQ ID NO: 9261 - DNA, 20 bp, Artificial
  CRISPR gRNA sequence
tgtttaggggtcagtcggga

SEQ ID NO: 9262 - DNA, 20 bp, Artificial
  CRISPR gRNA sequence
gtttaggggtcagtcgggac

SEQ ID NO: 9263 - DNA, 20 bp, Artificial
  CRISPR gRNA sequence
tttaggggtcagtcgggaca

SEQ ID NO: 9264 - DNA, 20 bp, Artificial
  CRISPR gRNA sequence
taggggtcagtcgggacagg

SEQ ID NO: 9265 - DNA, 20 bp, Artificial
  CRISPR gRNA sequence
aggggtcagtcgggacaggg

SEQ ID NO: 9266 - DNA, 20 bp, Artificial
  CRISPR gRNA sequence
ggggtcagtcgggacaggga

SEQ ID NO: 9267 - DNA, 20 bp, Artificial
  CRISPR gRNA sequence
gtcgggacagggagggtctc

SEQ ID NO: 9268 - DNA, 20 bp, Artificial
  CRISPR gRNA sequence
tcgggacagggagggtctcc

SEQ ID NO: 9269 - DNA, 20 bp, Artificial
  CRISPR gRNA sequence
cgggacagggagggtctcca

SEQ ID NO: 9270 - DNA, 20 bp, Artificial
  CRISPR gRNA sequence
ggacagggagggtctccagg

SEQ ID NO: 9271 - DNA, 20 bp, Artificial
  CRISPR gRNA sequence
cagggagggtctccagggag

SEQ ID NO: 9272 - DNA, 20 bp, Artificial
  CRISPR gRNA sequence
gggagggtctccagggagtg

SEQ ID NO: 9273 - DNA, 20 bp, Artificial
  CRISPR gRNA sequence
ggagggtctccagggagtgg

SEQ ID NO: 9274 - DNA, 20 bp, Artificial
  CRISPR gRNA sequence
gtctccagggagtggaggca

SEQ ID NO: 9275 - DNA, 20 bp, Artificial
  CRISPR gRNA sequence
agggagtggaggcatggttg

SEQ ID NO: 9276 - DNA, 20 bp, Artificial
  CRISPR gRNA sequence
gggagtggaggcatggttgt

SEQ ID NO: 9277 - DNA, 20 bp, Artificial
  CRISPR gRNA sequence
ggagtggaggcatggttgtg

SEQ ID NO: 9278 - DNA, 20 bp, Artificial
  CRISPR gRNA sequence
gagtggaggcatggttgtgg

SEQ ID NO: 9279 - DNA, 20 bp, Artificial
  CRISPR gRNA sequence
gaggcatggttgtgggggaa

SEQ ID NO: 9280 - DNA, 20 bp, Artificial
  CRISPR gRNA sequence
catggttgtgggggaatgga

SEQ ID NO: 9281 - DNA, 20 bp, Artificial
  CRISPR gRNA sequence
gttgtgggggaatggacagc

SEQ ID NO: 9282 - DNA, 20 bp, Artificial
  CRISPR gRNA sequence
tgtgggggaatggacagcta

SEQ ID NO: 9283 - DNA, 20 bp, Artificial
  CRISPR gRNA sequence
atccacatcccatccaaata

SEQ ID NO: 9284 - DNA, 20 bp, Artificial
  CRISPR gRNA sequence
tcccatccaaatacagccat

SEQ ID NO: 9285 - DNA, 20 bp, Artificial
  CRISPR gRNA sequence
caaatacagccatcagcctt

SEQ ID NO: 9286 - DNA, 20 bp, Artificial
  CRISPR gRNA sequence
gccttcagctgcttgttacc

SEQ ID NO: 9287 - DNA, 20 bp, Artificial
  CRISPR gRNA sequence
ttcagctgcttgttacccag

SEQ ID NO: 9288 - DNA, 20 bp, Artificial
  CRISPR gRNA sequence
ctgcttgttacccagcagaa

SEQ ID NO: 9289 - DNA, 20 bp, Artificial
  CRISPR gRNA sequence
ttgttacccagcagaaaagc

SEQ ID NO: 9290 - DNA, 20 bp, Artificial
  CRISPR gRNA sequence
agcagaaaagccagacaatg

SEQ ID NO: 9291 - DNA, 20 bp, Artificial
  CRISPR gRNA sequence
gaaaagccagacaatgtggt

SEQ ID NO: 9292 - DNA, 20 bp, Artificial
  CRISPR gRNA sequence
caatgtggtcagatcttttg

SEQ ID NO: 9293 - DNA, 20 bp, Artificial
  CRISPR gRNA sequence
tgaaaaccctgatttttaca

SEQ ID NO: 9294 - DNA, 20 bp, Artificial
  CRISPR gRNA sequence
tttattatttatttattgtt

SEQ ID NO: 9295 - DNA, 20 bp, Artificial
  CRISPR gRNA sequence
ttatttatttattgttgaga

SEQ ID NO: 9296 - DNA, 20 bp, Artificial
  CRISPR gRNA sequence
atttatttattgttgagatg

SEQ ID NO: 9297 - DNA, 20 bp, Artificial
  CRISPR gRNA sequence
tggagtctcactctgttgcc

SEQ ID NO: 9298 - DNA, 20 bp, Artificial
  CRISPR gRNA sequence
ggagtctcactctgttgccc

SEQ ID NO: 9299 - DNA, 20 bp, Artificial
  CRISPR gRNA sequence
tctcactctgttgcccaggc

SEQ ID NO: 9300 - DNA, 20 bp, Artificial
  CRISPR gRNA sequence
tcactctgttgcccaggcta

SEQ ID NO: 9301 - DNA, 20 bp, Artificial
  CRISPR gRNA sequence
ctgttgcccaggctagagtg

SEQ ID NO: 9302 - DNA, 20 bp, Artificial
  CRISPR gRNA sequence
ttgcccaggctagagtgcag

SEQ ID NO: 9303 - DNA, 20 bp, Artificial
  CRISPR gRNA sequence
agagtgcagtggtgcgatct

SEQ ID NO: 9304 - DNA, 20 bp, Artificial
  CRISPR gRNA sequence
tcactgcaacctccgcccta

SEQ ID NO: 9305 - DNA, 20 bp, Artificial
  CRISPR gRNA sequence
cactgcaacctccgccctac

SEQ ID NO: 9306 - DNA, 20 bp, Artificial
  CRISPR gRNA sequence
aacctccgccctacaggttc

SEQ ID NO: 9307 - DNA, 20 bp, Artificial
  CRISPR gRNA sequence
ttcaagtgattctcctgcct

SEQ ID NO: 9308 - DNA, 20 bp, Artificial
  CRISPR gRNA sequence
gattctcctgcctcagcctc

SEQ ID NO: 9309 - DNA, 20 bp, Artificial
  CRISPR gRNA sequence
ttctcctgcctcagcctccg

SEQ ID NO: 9310 - DNA, 20 bp, Artificial
  CRISPR gRNA sequence
tcctgcctcagcctccggag

SEQ ID NO: 9311 - DNA, 20 bp, Artificial
  CRISPR gRNA sequence
gcctcagcctccggagcagc

SEQ ID NO: 9312 - DNA, 20 bp, Artificial
  CRISPR gRNA sequence
ctccggagcagctggaatta

SEQ ID NO: 9313 - DNA, 20 bp, Artificial
  CRISPR gRNA sequence
tccggagcagctggaattac

SEQ ID NO: 9314 - DNA, 20 bp, Artificial
  CRISPR gRNA sequence
caggtgtgcaccgtcacacc

SEQ ID NO: 9315 - DNA, 20 bp, Artificial
  CRISPR gRNA sequence
ccagccaatttttgtaattt

SEQ ID NO: 9316 - DNA, 20 bp, Artificial
  CRISPR gRNA sequence
gccaatttttgtaatttcag

SEQ ID NO: 9317 - DNA, 20 bp, Artificial
  CRISPR gRNA sequence
caatttttgtaatttcagta

SEQ ID NO: 9318 - DNA, 20 bp, Artificial
  CRISPR gRNA sequence
tttgtaatttcagtagagac

SEQ ID NO: 9319 - DNA, 20 bp, Artificial
  CRISPR gRNA sequence
agagacaagtttaaccatgt

SEQ ID NO: 9320 - DNA, 20 bp, Artificial
  CRISPR gRNA sequence
acaagtttaaccatgttggc

SEQ ID NO: 9321 - DNA, 20 bp, Artificial
  CRISPR gRNA sequence
caagtttaaccatgttggcc

SEQ ID NO: 9322 - DNA, 20 bp, Artificial
  CRISPR gRNA sequence
tttaaccatgttggccaggc

SEQ ID NO: 9323 - DNA, 20 bp, Artificial
  CRISPR gRNA sequence
ggtctcgaactcctgatctc

SEQ ID NO: 9324 - DNA, 20 bp, Artificial
  CRISPR gRNA sequence
ccacctgcctcgacctccca

SEQ ID NO: 9325 - DNA, 20 bp, Artificial
  CRISPR gRNA sequence
gcctcgacctcccaaagtgc

SEQ ID NO: 9326 - DNA, 20 bp, Artificial
  CRISPR gRNA sequence
cctcgacctcccaaagtgct

SEQ ID NO: 9327 - DNA, 20 bp, Artificial
  CRISPR gRNA sequence
ctcccaaagtgctgggatta

SEQ ID NO: 9328 - DNA, 20 bp, Artificial
  CRISPR gRNA sequence
tcccaaagtgctgggattac

SEQ ID NO: 9329 - DNA, 20 bp, Artificial
  CRISPR gRNA sequence
agtgctgggattacaggtgt

SEQ ID NO: 9330 - DNA, 20 bp, Artificial
  CRISPR gRNA sequence
caggtgtgagccactgcacc

SEQ ID NO: 9331 - DNA, 20 bp, Artificial
  CRISPR gRNA sequence
cgattttcttttttaaacat

SEQ ID NO: 9332 - DNA, 20 bp, Artificial
  CRISPR gRNA sequence
aacatgagtgaaatttttaa

SEQ ID NO: 9333 - DNA, 20 bp, Artificial
  CRISPR gRNA sequence
gagtgaaatttttaaaagta

SEQ ID NO: 9334 - DNA, 20 bp, Artificial
  CRISPR gRNA sequence
gaaatttttaaaagtacagt

SEQ ID NO: 9335 - DNA, 20 bp, Artificial
  CRISPR gRNA sequence
tttaaaagtacagttggcca

SEQ ID NO: 9336 - DNA, 20 bp, Artificial
  CRISPR gRNA sequence
aaagtacagttggccaaaga

SEQ ID NO: 9337 - DNA, 20 bp, Artificial
  CRISPR gRNA sequence
ggccaaagaaagacatattt

SEQ ID NO: 9338 - DNA, 20 bp, Artificial
  CRISPR gRNA sequence
aaagaaagacatatttgagt

SEQ ID NO: 9339 - DNA, 20 bp, Artificial
  CRISPR gRNA sequence
agacatatttgagttagata

SEQ ID NO: 9340 - DNA, 20 bp, Artificial
  CRISPR gRNA sequence
atttgagttagatacagcct

SEQ ID NO: 9341 - DNA, 20 bp, Artificial
  CRISPR gRNA sequence
tttgagttagatacagcctc

SEQ ID NO: 9342 - DNA, 20 bp, Artificial
  CRISPR gRNA sequence
ctatcttataacctccatct

SEQ ID NO: 9343 - DNA, 20 bp, Artificial
  CRISPR gRNA sequence
tatcttataacctccatctt

SEQ ID NO: 9344 - DNA, 20 bp, Artificial
  CRISPR gRNA sequence
aacctccatcttgggaaact

SEQ ID NO: 9345 - DNA, 20 bp, Artificial
  CRISPR gRNA sequence
cttgggaaactcagcccatg

SEQ ID NO: 9346 - DNA, 20 bp, Artificial
  CRISPR gRNA sequence
ttgggaaactcagcccatga

SEQ ID NO: 9347 - DNA, 20 bp, Artificial
  CRISPR gRNA sequence
actcagcccatgaaggctgt

SEQ ID NO: 9348 - DNA, 20 bp, Artificial
  CRISPR gRNA sequence
ctcagcccatgaaggctgta

SEQ ID NO: 9349 - DNA, 20 bp, Artificial
  CRISPR gRNA sequence
ccatgaaggctgtaaggact

SEQ ID NO: 9350 - DNA, 20 bp, Artificial
  CRISPR gRNA sequence
tgaaggctgtaaggactaag

SEQ ID NO: 9351 - DNA, 20 bp, Artificial
  CRISPR gRNA sequence
gctgtaaggactaagtggcc

SEQ ID NO: 9352 - DNA, 20 bp, Artificial
  CRISPR gRNA sequence
tgtaaggactaagtggccca

SEQ ID NO: 9353 - DNA, 20 bp, Artificial
  CRISPR gRNA sequence
gtaaggactaagtggcccag

SEQ ID NO: 9354 - DNA, 20 bp, Artificial
  CRISPR gRNA sequence
taaggactaagtggcccaga

SEQ ID NO: 9355 - DNA, 20 bp, Artificial
  CRISPR gRNA sequence
aggactaagtggcccagagg

SEQ ID NO: 9356 - DNA, 20 bp, Artificial
  CRISPR gRNA sequence
ggactaagtggcccagaggg

SEQ ID NO: 9357 - DNA, 20 bp, Artificial
  CRISPR gRNA sequence
gactaagtggcccagaggga

SEQ ID NO: 9358 - DNA, 20 bp, Artificial
  CRISPR gRNA sequence
actaagtggcccagagggag

SEQ ID NO: 9359 - DNA, 20 bp, Artificial
  CRISPR gRNA sequence
ctaagtggcccagagggagg

SEQ ID NO: 9360 - DNA, 20 bp, Artificial
  CRISPR gRNA sequence
taagtggcccagagggaggg

SEQ ID NO: 9361 - DNA, 20 bp, Artificial
  CRISPR gRNA sequence
cccagagggaggggggtccc

SEQ ID NO: 9362 - DNA, 20 bp, Artificial
  CRISPR gRNA sequence
ccagagggaggggggtcccc

SEQ ID NO: 9363 - DNA, 20 bp, Artificial
  CRISPR gRNA sequence
cagagggaggggggtcccca

SEQ ID NO: 9364 - DNA, 20 bp, Artificial
  CRISPR gRNA sequence
agagggaggggggtccccag

SEQ ID NO: 9365 - DNA, 20 bp, Artificial
  CRISPR gRNA sequence
ggtaaccctcaccctaaatc

SEQ ID NO: 9366 - DNA, 20 bp, Artificial
  CRISPR gRNA sequence
ggcacctgcttctccatctc

SEQ ID NO: 9367 - DNA, 20 bp, Artificial
  CRISPR gRNA sequence
cacctgcttctccatctcca

SEQ ID NO: 9368 - DNA, 20 bp, Artificial
  CRISPR gRNA sequence
cttctccatctccagagcac

SEQ ID NO: 9369 - DNA, 20 bp, Artificial
  CRISPR gRNA sequence
gacgtcccccacccaatgcc

SEQ ID NO: 9370 - DNA, 20 bp, Artificial
  CRISPR gRNA sequence
gtcccccacccaatgcccgg

SEQ ID NO: 9371 - DNA, 20 bp, Artificial
  CRISPR gRNA sequence
cccacccaatgcccggcagc

SEQ ID NO: 9372 - DNA, 20 bp, Artificial
  CRISPR gRNA sequence
cacccaatgcccggcagctg

SEQ ID NO: 9373 - DNA, 20 bp, Artificial
  CRISPR gRNA sequence
cccaatgcccggcagctgga

SEQ ID NO: 9374 - DNA, 20 bp, Artificial
  CRISPR gRNA sequence
ccaatgcccggcagctggag

SEQ ID NO: 9375 - DNA, 20 bp, Artificial
  CRISPR gRNA sequence
cagctggagaggtctccaac

SEQ ID NO: 9376 - DNA, 20 bp, Artificial
  CRISPR gRNA sequence
tctccaacaagcttccaaaa

SEQ ID NO: 9377 - DNA, 20 bp, Artificial
  CRISPR gRNA sequence
aacaagcttccaaaatggcc

SEQ ID NO: 9378 - DNA, 20 bp, Artificial
  CRISPR gRNA sequence
agcttccaaaatggcctggt

SEQ ID NO: 9379 - DNA, 20 bp, Artificial
  CRISPR gRNA sequence
aaatggcctggtgagtgatg

SEQ ID NO: 9380 - DNA, 20 bp, Artificial
  CRISPR gRNA sequence
aatggcctggtgagtgatgc

SEQ ID NO: 9381 - DNA, 20 bp, Artificial
  CRISPR gRNA sequence
gatgcgggatctctctgccc

SEQ ID NO: 9382 - DNA, 20 bp, Artificial
  CRISPR gRNA sequence
atgcgggatctctctgccct

SEQ ID NO: 9383 - DNA, 20 bp, Artificial
  CRISPR gRNA sequence
cgggatctctctgccctggg

SEQ ID NO: 9384 - DNA, 20 bp, Artificial
  CRISPR gRNA sequence
gatctctctgccctgggtgg

SEQ ID NO: 9385 - DNA, 20 bp, Artificial
  CRISPR gRNA sequence
tctctctgccctgggtggtg

SEQ ID NO: 9386 - DNA, 20 bp, Artificial
  CRISPR gRNA sequence
tctgccctgggtggtggaga

SEQ ID NO: 9387 - DNA, 20 bp, Artificial
  CRISPR gRNA sequence
gccctgggtggtggagatgg

SEQ ID NO: 9388 - DNA, 20 bp, Artificial
  CRISPR gRNA sequence
tggagatggaagcccatatc

SEQ ID NO: 9389 - DNA, 20 bp, Artificial
  CRISPR gRNA sequence
ttattcaaccccttctttgt

SEQ ID NO: 9390 - DNA, 20 bp, Artificial
  CRISPR gRNA sequence
aatatttattgcccttcaat

SEQ ID NO: 9391 - DNA, 20 bp, Artificial
  CRISPR gRNA sequence
gcccttcaataagcctgcac

SEQ ID NO: 9392 - DNA, 20 bp, Artificial
  CRISPR gRNA sequence
cccttcaataagcctgcact

SEQ ID NO: 9393 - DNA, 20 bp, Artificial
  CRISPR gRNA sequence
gggtgttaacacttcattgt

SEQ ID NO: 9394 - DNA, 20 bp, Artificial
  CRISPR gRNA sequence
ggtgttaacacttcattgtc

SEQ ID NO: 9395 - DNA, 20 bp, Artificial
  CRISPR gRNA sequence
taacacttcattgtcaggct

SEQ ID NO: 9396 - DNA, 20 bp, Artificial
  CRISPR gRNA sequence
acacttcattgtcaggctga

SEQ ID NO: 9397 - DNA, 20 bp, Artificial
  CRISPR gRNA sequence
gtcaggctgagagaatgaat

SEQ ID NO: 9398 - DNA, 20 bp, Artificial
  CRISPR gRNA sequence
tcaggctgagagaatgaatg

SEQ ID NO: 9399 - DNA, 20 bp, Artificial
  CRISPR gRNA sequence
caggctgagagaatgaatga

SEQ ID NO: 9400 - DNA, 20 bp, Artificial
  CRISPR gRNA sequence
aggctgagagaatgaatgag

SEQ ID NO: 9401 - DNA, 20 bp, Artificial
  CRISPR gRNA sequence
tgagagaatgaatgaggggc

SEQ ID NO: 9402 - DNA, 20 bp, Artificial
  CRISPR gRNA sequence
tgaggggcaagcgaatgatg

SEQ ID NO: 9403 - DNA, 20 bp, Artificial
  CRISPR gRNA sequence
gggcaagcgaatgatgaagt

SEQ ID NO: 9404 - DNA, 20 bp, Artificial
  CRISPR gRNA sequence
aagcgaatgatgaagtgagt

SEQ ID NO: 9405 - DNA, 20 bp, Artificial
  CRISPR gRNA sequence
cgaatgatgaagtgagtgag

SEQ ID NO: 9406 - DNA, 20 bp, Artificial
  CRISPR gRNA sequence
atgaagtgagtgagtggatg

SEQ ID NO: 9407 - DNA, 20 bp, Artificial
  CRISPR gRNA sequence
agtgagtgagtggatgaagt

SEQ ID NO: 9408 - DNA, 20 bp, Artificial
  CRISPR gRNA sequence
gagtgagtggatgaagtgag

SEQ ID NO: 9409 - DNA, 20 bp, Artificial
  CRISPR gRNA sequence
ggatgaagtgagaagttgat

SEQ ID NO: 9410 - DNA, 20 bp, Artificial
  CRISPR gRNA sequence
gatgaagtgagaagttgatg

SEQ ID NO: 9411 - DNA, 20 bp, Artificial
  CRISPR gRNA sequence
aagtgagaagttgatgagga

SEQ ID NO: 9412 - DNA, 20 bp, Artificial
  CRISPR gRNA sequence
agtgagaagttgatgaggat

SEQ ID NO: 9413 - DNA, 20 bp, Artificial
  CRISPR gRNA sequence
tgagaagttgatgaggatgg

SEQ ID NO: 9414 - DNA, 20 bp, Artificial
  CRISPR gRNA sequence
gttgatgaggatgggagcaa

SEQ ID NO: 9415 - DNA, 20 bp, Artificial
  CRISPR gRNA sequence
atgaggatgggagcaatgga

SEQ ID NO: 9416 - DNA, 20 bp, Artificial
  CRISPR gRNA sequence
aggatgggagcaatggaaag

SEQ ID NO: 9417 - DNA, 20 bp, Artificial
  CRISPR gRNA sequence
ggatgggagcaatggaaagt

SEQ ID NO: 9418 - DNA, 20 bp, Artificial
  CRISPR gRNA sequence
aatggaaagtgggaataaac

SEQ ID NO: 9419 - DNA, 20 bp, Artificial
  CRISPR gRNA sequence
gtgggaataaaccagtgaat

SEQ ID NO: 9420 - DNA, 20 bp, Artificial
  CRISPR gRNA sequence
gggaataaaccagtgaataa

SEQ ID NO: 9421 - DNA, 20 bp, Artificial
  CRISPR gRNA sequence
aaatgcttactctcacatac

SEQ ID NO: 9422 - DNA, 20 bp, Artificial
  CRISPR gRNA sequence
ttactctcacatactggtct

SEQ ID NO: 9423 - DNA, 20 bp, Artificial
  CRISPR gRNA sequence
acatactggtctaagcatgt

SEQ ID NO: 9424 - DNA, 20 bp, Artificial
  CRISPR gRNA sequence
catactggtctaagcatgtt

SEQ ID NO: 9425 - DNA, 20 bp, Artificial
  CRISPR gRNA sequence
ccaatattatccccattttc

SEQ ID NO: 9426 - DNA, 20 bp, Artificial
  CRISPR gRNA sequence
attatccccattttccagat

SEQ ID NO: 9427 - DNA, 20 bp, Artificial
  CRISPR gRNA sequence
ttatccccattttccagatg

SEQ ID NO: 9428 - DNA, 20 bp, Artificial
  CRISPR gRNA sequence
attttccagatgaggctact

SEQ ID NO: 9429 - DNA, 20 bp, Artificial
  CRISPR gRNA sequence
ttttccagatgaggctactg

SEQ ID NO: 9430 - DNA, 20 bp, Artificial
  CRISPR gRNA sequence
cagatgaggctactgaggca

SEQ ID NO: 9431 - DNA, 20 bp, Artificial
  CRISPR gRNA sequence
atgaggctactgaggcatgg

SEQ ID NO: 9432 - DNA, 20 bp, Artificial
  CRISPR gRNA sequence
tgaggctactgaggcatggt

SEQ ID NO: 9433 - DNA, 20 bp, Artificial
  CRISPR gRNA sequence
ctgaggcatggtgggatgta

SEQ ID NO: 9434 - DNA, 20 bp, Artificial
  CRISPR gRNA sequence
ggtgggatgtatagcatgct

SEQ ID NO: 9435 - DNA, 20 bp, Artificial
  CRISPR gRNA sequence
tagcatgctcagaattgctc

SEQ ID NO: 9436 - DNA, 20 bp, Artificial
  CRISPR gRNA sequence
atgctcagaattgctccagc

SEQ ID NO: 9437 - DNA, 20 bp, Artificial
  CRISPR gRNA sequence
ctcagaattgctccagcaag

SEQ ID NO: 9438 - DNA, 20 bp, Artificial
  CRISPR gRNA sequence
agaattgctccagcaagtgg

SEQ ID NO: 9439 - DNA, 20 bp, Artificial
  CRISPR gRNA sequence
gctccagcaagtggtagaac

SEQ ID NO: 9440 - DNA, 20 bp, Artificial
  CRISPR gRNA sequence
ctccagcaagtggtagaacc

SEQ ID NO: 9441 - DNA, 20 bp, Artificial
  CRISPR gRNA sequence
gtagaaccgggatttgaacc

SEQ ID NO: 9442 - DNA, 20 bp, Artificial
  CRISPR gRNA sequence
gggatttgaacccagacacg

SEQ ID NO: 9443 - DNA, 20 bp, Artificial
  CRISPR gRNA sequence
ggatttgaacccagacacgt

SEQ ID NO: 9444 - DNA, 20 bp, Artificial
  CRISPR gRNA sequence
tccctcccatgacctcccca

SEQ ID NO: 9445 - DNA, 20 bp, Artificial
  CRISPR gRNA sequence
tcccatgacctccccatggt

SEQ ID NO: 9446 - DNA, 20 bp, Artificial
  CRISPR gRNA sequence
atgacctccccatggtgagt

SEQ ID NO: 9447 - DNA, 20 bp, Artificial
  CRISPR gRNA sequence
acctccccatggtgagtgag

SEQ ID NO: 9448 - DNA, 20 bp, Artificial
  CRISPR gRNA sequence
atggtgagtgagtagtgatc

SEQ ID NO: 9449 - DNA, 20 bp, Artificial
  CRISPR gRNA sequence
gagtgagtagtgatcaagcg

SEQ ID NO: 9450 - DNA, 20 bp, Artificial
  CRISPR gRNA sequence
gtagtgatcaagcgaagaaa

SEQ ID NO: 9451 - DNA, 20 bp, Artificial
  CRISPR gRNA sequence
gatcaagcgaagaaaaagct

SEQ ID NO: 9452 - DNA, 20 bp, Artificial
  CRISPR gRNA sequence
aagcgaagaaaaagcttagt

SEQ ID NO: 9453 - DNA, 20 bp, Artificial
  CRISPR gRNA sequence
aaaagcttagtgagtaaatg

SEQ ID NO: 9454 - DNA, 20 bp, Artificial
  CRISPR gRNA sequence
aaagcttagtgagtaaatga

SEQ ID NO: 9455 - DNA, 20 bp, Artificial
  CRISPR gRNA sequence
tagtgagtaaatgaaggaat

SEQ ID NO: 9456 - DNA, 20 bp, Artificial
  CRISPR gRNA sequence
agtaaatgaaggaatgagaa

SEQ ID NO: 9457 - DNA, 20 bp, Artificial
  CRISPR gRNA sequence
aatgaaggaatgagaaaaga

SEQ ID NO: 9458 - DNA, 20 bp, Artificial
  CRISPR gRNA sequence
tgagaaaagatggccatgca

SEQ ID NO: 9459 - DNA, 20 bp, Artificial
  CRISPR gRNA sequence
gtgccttatgcctgtaatcc

SEQ ID NO: 9460 - DNA, 20 bp, Artificial
  CRISPR gRNA sequence
tgcctgtaatcccagcactt

SEQ ID NO: 9461 - DNA, 20 bp, Artificial
  CRISPR gRNA sequence
gcctgtaatcccagcacttt

SEQ ID NO: 9462 - DNA, 20 bp, Artificial
  CRISPR gRNA sequence
ctgtaatcccagcactttgg

SEQ ID NO: 9463 - DNA, 20 bp, Artificial
  CRISPR gRNA sequence
tgtaatcccagcactttggg

SEQ ID NO: 9464 - DNA, 20 bp, Artificial
  CRISPR gRNA sequence
tcccagcactttgggaggcc

SEQ ID NO: 9465 - DNA, 20 bp, Artificial
  CRISPR gRNA sequence
cccagcactttgggaggcca

SEQ ID NO: 9466 - DNA, 20 bp, Artificial
  CRISPR gRNA sequence
agcactttgggaggccaagg

SEQ ID NO: 9467 - DNA, 20 bp, Artificial
  CRISPR gRNA sequence
gcactttgggaggccaaggc

SEQ ID NO: 9468 - DNA, 20 bp, Artificial
  CRISPR gRNA sequence
ctttgggaggccaaggcagg

SEQ ID NO: 9469 - DNA, 20 bp, Artificial
  CRISPR gRNA sequence
ccaaggcaggtggatcacct

SEQ ID NO: 9470 - DNA, 20 bp, Artificial
  CRISPR gRNA sequence
caaggcaggtggatcacctg

SEQ ID NO: 9471 - DNA, 20 bp, Artificial
  CRISPR gRNA sequence
gcaggtggatcacctgaggt

SEQ ID NO: 9472 - DNA, 20 bp, Artificial
  CRISPR gRNA sequence
caggtggatcacctgaggtc

SEQ ID NO: 9473 - DNA, 20 bp, Artificial
  CRISPR gRNA sequence
ggtggatcacctgaggtcag

SEQ ID NO: 9474 - DNA, 20 bp, Artificial
  CRISPR gRNA sequence
tcacctgaggtcaggagttc

SEQ ID NO: 9475 - DNA, 20 bp, Artificial
  CRISPR gRNA sequence
tgaggtcaggagttcgagac

SEQ ID NO: 9476 - DNA, 20 bp, Artificial
  CRISPR gRNA sequence
tcaggagttcgagaccagcc

SEQ ID NO: 9477 - DNA, 20 bp, Artificial
  CRISPR gRNA sequence
cgagaccagcctggccaaca

SEQ ID NO: 9478 - DNA, 20 bp, Artificial
  CRISPR gRNA sequence
ccattaaaaaatacaaaaat

SEQ ID NO: 9479 - DNA, 20 bp, Artificial
  CRISPR gRNA sequence
taaaaaatacaaaaattagc

SEQ ID NO: 9480 - DNA, 20 bp, Artificial
  CRISPR gRNA sequence
atacaaaaattagccagacg

SEQ ID NO: 9481 - DNA, 20 bp, Artificial
  CRISPR gRNA sequence
caaaaattagccagacgtgg

SEQ ID NO: 9482 - DNA, 20 bp, Artificial
  CRISPR gRNA sequence
aaattagccagacgtggtag

SEQ ID NO: 9483 - DNA, 20 bp, Artificial
  CRISPR gRNA sequence
aattagccagacgtggtagt

SEQ ID NO: 9484 - DNA, 20 bp, Artificial
  CRISPR gRNA sequence
gtagtgggtgcctgtaatcc

SEQ ID NO: 9485 - DNA, 20 bp, Artificial
  CRISPR gRNA sequence
tgcctgtaatcccagctact

SEQ ID NO: 9486 - DNA, 20 bp, Artificial
  CRISPR gRNA sequence
ctgtaatcccagctacttgg

SEQ ID NO: 9487 - DNA, 20 bp, Artificial
  CRISPR gRNA sequence
tgtaatcccagctacttggc

SEQ ID NO: 9488 - DNA, 20 bp, Artificial
  CRISPR gRNA sequence
tcccagctacttggcaggcc

SEQ ID NO: 9489 - DNA, 20 bp, Artificial
  CRISPR gRNA sequence
cccagctacttggcaggccg

SEQ ID NO: 9490 - DNA, 20 bp, Artificial
  CRISPR gRNA sequence
agctacttggcaggccgagg

SEQ ID NO: 9491 - DNA, 20 bp, Artificial
  CRISPR gRNA sequence
gctacttggcaggccgaggc

SEQ ID NO: 9492 - DNA, 20 bp, Artificial
  CRISPR gRNA sequence
tacttggcaggccgaggcag

SEQ ID NO: 9493 - DNA, 20 bp, Artificial
  CRISPR gRNA sequence
gcaggagaatcgcctaaacc

SEQ ID NO: 9494 - DNA, 20 bp, Artificial
  CRISPR gRNA sequence
caggagaatcgcctaaaccc

SEQ ID NO: 9495 - DNA, 20 bp, Artificial
  CRISPR gRNA sequence
ggagaatcgcctaaacccag

SEQ ID NO: 9496 - DNA, 20 bp, Artificial
  CRISPR gRNA sequence
gagaatcgcctaaacccagg

SEQ ID NO: 9497 - DNA, 20 bp, Artificial
  CRISPR gRNA sequence
aatcgcctaaacccaggagg

SEQ ID NO: 9498 - DNA, 20 bp, Artificial
  CRISPR gRNA sequence
tcgcctaaacccaggaggtg

SEQ ID NO: 9499 - DNA, 20 bp, Artificial
  CRISPR gRNA sequence
cgcctaaacccaggaggtgg

SEQ ID NO: 9500 - DNA, 20 bp, Artificial
  CRISPR gRNA sequence
caggaggtggaggttgccgt

SEQ ID NO: 9501 - DNA, 20 bp, Artificial
  CRISPR gRNA sequence
ggtggaggttgccgtgagct

SEQ ID NO: 9502 - DNA, 20 bp, Artificial
  CRISPR gRNA sequence
gccgtgagctgagattgcgc

SEQ ID NO: 9503 - DNA, 20 bp, Artificial
  CRISPR gRNA sequence
gagattgcgccagtgcactc

SEQ ID NO: 9504 - DNA, 20 bp, Artificial
  CRISPR gRNA sequence
tgcgccagtgcactccagcc

SEQ ID NO: 9505 - DNA, 20 bp, Artificial
  CRISPR gRNA sequence
gcgccagtgcactccagcct

SEQ ID NO: 9506 - DNA, 20 bp, Artificial
  CRISPR gRNA sequence
cgccagtgcactccagcctg

SEQ ID NO: 9507 - DNA, 20 bp, Artificial
  CRISPR gRNA sequence
gtgcactccagcctggggca

SEQ ID NO: 9508 - DNA, 20 bp, Artificial
  CRISPR gRNA sequence
tgcactccagcctggggcac

SEQ ID NO: 9509 - DNA, 20 bp, Artificial
  CRISPR gRNA sequence
gcactccagcctggggcaca

SEQ ID NO: 9510 - DNA, 20 bp, Artificial
  CRISPR gRNA sequence
ctccagcctggggcacaggg

SEQ ID NO: 9511 - DNA, 20 bp, Artificial
  CRISPR gRNA sequence
tccagcctggggcacagggc

SEQ ID NO: 9512 - DNA, 20 bp, Artificial
  CRISPR gRNA sequence
gatccatctcaaaaaaaaaa

SEQ ID NO: 9513 - DNA, 20 bp, Artificial
  CRISPR gRNA sequence
tccatctcaaaaaaaaaaaa

SEQ ID NO: 9514 - DNA, 20 bp, Artificial
  CRISPR gRNA sequence
catctcaaaaaaaaaaaaga

SEQ ID NO: 9515 - DNA, 20 bp, Artificial
  CRISPR gRNA sequence
caaaaaaaaaaaagagagaa

SEQ ID NO: 9516 - DNA, 20 bp, Artificial
  CRISPR gRNA sequence
aaaaaaaaaaaagagagaaa

SEQ ID NO: 9517 - DNA, 20 bp, Artificial
  CRISPR gRNA sequence
aaaagagagaaaaggtctaa

SEQ ID NO: 9518 - DNA, 20 bp, Artificial
  CRISPR gRNA sequence
aaagagagaaaaggtctaaa

SEQ ID NO: 9519 - DNA, 20 bp, Artificial
  CRISPR gRNA sequence
agagagaaaaggtctaaaag

SEQ ID NO: 9520 - DNA, 20 bp, Artificial
  CRISPR gRNA sequence
gagaaaaggtctaaaaggag

SEQ ID NO: 9521 - DNA, 20 bp, Artificial
  CRISPR gRNA sequence
aaaggagtggacacttaaac

SEQ ID NO: 9522 - DNA, 20 bp, Artificial
  CRISPR gRNA sequence
aggagtggacacttaaacaa

SEQ ID NO: 9523 - DNA, 20 bp, Artificial
  CRISPR gRNA sequence
gagtggacacttaaacaaga

SEQ ID NO: 9524 - DNA, 20 bp, Artificial
  CRISPR gRNA sequence
acttaaacaagagagacgat

SEQ ID NO: 9525 - DNA, 20 bp, Artificial
  CRISPR gRNA sequence
aacaagagagacgatgagtg

SEQ ID NO: 9526 - DNA, 20 bp, Artificial
  CRISPR gRNA sequence
acaagagagacgatgagtga

SEQ ID NO: 9527 - DNA, 20 bp, Artificial
  CRISPR gRNA sequence
agagacgatgagtgaaggaa

SEQ ID NO: 9528 - DNA, 20 bp, Artificial
  CRISPR gRNA sequence
gagacgatgagtgaaggaat

SEQ ID NO: 9529 - DNA, 20 bp, Artificial
  CRISPR gRNA sequence
gatgagtgaaggaatgggtg

SEQ ID NO: 9530 - DNA, 20 bp, Artificial
  CRISPR gRNA sequence
gaaggaatgggtgtggaaat

SEQ ID NO: 9531 - DNA, 20 bp, Artificial
  CRISPR gRNA sequence
aaatgagtgaactaatgaat

SEQ ID NO: 9532 - DNA, 20 bp, Artificial
  CRISPR gRNA sequence
tgagtgaactaatgaatgag

SEQ ID NO: 9533 - DNA, 20 bp, Artificial
  CRISPR gRNA sequence
gtgaactaatgaatgagtgg

SEQ ID NO: 9534 - DNA, 20 bp, Artificial
  CRISPR gRNA sequence
tgaactaatgaatgagtggt

SEQ ID NO: 9535 - DNA, 20 bp, Artificial
  CRISPR gRNA sequence
gagtggtgggtgactgaatg

SEQ ID NO: 9536 - DNA, 20 bp, Artificial
  CRISPR gRNA sequence
actgaatgaagcaaatgatg

SEQ ID NO: 9537 - DNA, 20 bp, Artificial
  CRISPR gRNA sequence
agcaaatgatgaagactgta

SEQ ID NO: 9538 - DNA, 20 bp, Artificial
  CRISPR gRNA sequence
gcaaatgatgaagactgtat

SEQ ID NO: 9539 - DNA, 20 bp, Artificial
  CRISPR gRNA sequence
caaatgatgaagactgtatg

SEQ ID NO: 9540 - DNA, 20 bp, Artificial
  CRISPR gRNA sequence
aaatgatgaagactgtatgg

SEQ ID NO: 9541 - DNA, 20 bp, Artificial
  CRISPR gRNA sequence
gatgaagactgtatgggggc

SEQ ID NO: 9542 - DNA, 20 bp, Artificial
  CRISPR gRNA sequence
gactgtatgggggccagatg

SEQ ID NO: 9543 - DNA, 20 bp, Artificial
  CRISPR gRNA sequence
tgtatgggggccagatgtgg

SEQ ID NO: 9544 - DNA, 20 bp, Artificial
  CRISPR gRNA sequence
gtggctcacacctgtaatcc

SEQ ID NO: 9545 - DNA, 20 bp, Artificial
  CRISPR gRNA sequence
cacctgtaatcccagcactt

SEQ ID NO: 9546 - DNA, 20 bp, Artificial
  CRISPR gRNA sequence
acctgtaatcccagcacttt

SEQ ID NO: 9547 - DNA, 20 bp, Artificial
  CRISPR gRNA sequence
ctgtaatcccagcactttgg

SEQ ID NO: 9548 - DNA, 20 bp, Artificial
  CRISPR gRNA sequence
tgtaatcccagcactttggg

SEQ ID NO: 9549 - DNA, 20 bp, Artificial
  CRISPR gRNA sequence
tcccagcactttgggaggcc

SEQ ID NO: 9550 - DNA, 20 bp, Artificial
  CRISPR gRNA sequence
cccagcactttgggaggcca

SEQ ID NO: 9551 - DNA, 20 bp, Artificial
  CRISPR gRNA sequence
agcactttgggaggccaagg

SEQ ID NO: 9552 - DNA, 20 bp, Artificial
  CRISPR gRNA sequence
ccaaggcggaacgattgctt

SEQ ID NO: 9553 - DNA, 20 bp, Artificial
  CRISPR gRNA sequence
gcggaacgattgcttgagcc

SEQ ID NO: 9554 - DNA, 20 bp, Artificial
  CRISPR gRNA sequence
cggaacgattgcttgagccc

SEQ ID NO: 9555 - DNA, 20 bp, Artificial
  CRISPR gRNA sequence
gaacgattgcttgagcccag

SEQ ID NO: 9556 - DNA, 20 bp, Artificial
  CRISPR gRNA sequence
ttgcttgagcccaggagctc

SEQ ID NO: 9557 - DNA, 20 bp, Artificial
  CRISPR gRNA sequence
tgagcccaggagctcaagac

SEQ ID NO: 9558 - DNA, 20 bp, Artificial
  CRISPR gRNA sequence
ccaggagctcaagaccagcc

SEQ ID NO: 9559 - DNA, 20 bp, Artificial
  CRISPR gRNA sequence
caggagctcaagaccagcct

SEQ ID NO: 9560 - DNA, 20 bp, Artificial
  CRISPR gRNA sequence
caagaccagcctgggcaaaa

SEQ ID NO: 9561 - DNA, 20 bp, Artificial
  CRISPR gRNA sequence
accagcctgggcaaaatagt

SEQ ID NO: 9562 - DNA, 20 bp, Artificial
  CRISPR gRNA sequence
atctccacaaaaaaacaaaa

SEQ ID NO: 9563 - DNA, 20 bp, Artificial
  CRISPR gRNA sequence
aaaaaacaaaaaagaaaaat

SEQ ID NO: 9564 - DNA, 20 bp, Artificial
  CRISPR gRNA sequence
aacaaaaaagaaaaattagc

SEQ ID NO: 9565 - DNA, 20 bp, Artificial
  CRISPR gRNA sequence
acaaaaaagaaaaattagcc

SEQ ID NO: 9566 - DNA, 20 bp, Artificial
  CRISPR gRNA sequence
aaagaaaaattagccaggca

SEQ ID NO: 9567 - DNA, 20 bp, Artificial
  CRISPR gRNA sequence
gaaaaattagccaggcatgg

SEQ ID NO: 9568 - DNA, 20 bp, Artificial
  CRISPR gRNA sequence
aaattagccaggcatggcag

SEQ ID NO: 9569 - DNA, 20 bp, Artificial
  CRISPR gRNA sequence
aattagccaggcatggcagt

SEQ ID NO: 9570 - DNA, 20 bp, Artificial
  CRISPR gRNA sequence
ggcatggcagtgggcgcctg

SEQ ID NO: 9571 - DNA, 20 bp, Artificial
  CRISPR gRNA sequence
gcagtgggcgcctgtagtcc

SEQ ID NO: 9572 - DNA, 20 bp, Artificial
  CRISPR gRNA sequence
cgcctgtagtcccagctact

SEQ ID NO: 9573 - DNA, 20 bp, Artificial
  CRISPR gRNA sequence
gcctgtagtcccagctactc

SEQ ID NO: 9574 - DNA, 20 bp, Artificial
  CRISPR gRNA sequence
ctgtagtcccagctactcag

SEQ ID NO: 9575 - DNA, 20 bp, Artificial
  CRISPR gRNA sequence
tgtagtcccagctactcagg

SEQ ID NO: 9576 - DNA, 20 bp, Artificial
  CRISPR gRNA sequence
tcccagctactcaggaggct

SEQ ID NO: 9577 - DNA, 20 bp, Artificial
  CRISPR gRNA sequence
cccagctactcaggaggctg

SEQ ID NO: 9578 - DNA, 20 bp, Artificial
  CRISPR gRNA sequence
agctactcaggaggctgagg

SEQ ID NO: 9579 - DNA, 20 bp, Artificial
  CRISPR gRNA sequence
gctactcaggaggctgaggt

SEQ ID NO: 9580 - DNA, 20 bp, Artificial
  CRISPR gRNA sequence
tactcaggaggctgaggtgg

SEQ ID NO: 9581 - DNA, 20 bp, Artificial
  CRISPR gRNA sequence
actcaggaggctgaggtggg

SEQ ID NO: 9582 - DNA, 20 bp, Artificial
  CRISPR gRNA sequence
ctgaggtgggaggattgctt

SEQ ID NO: 9583 - DNA, 20 bp, Artificial
  CRISPR gRNA sequence
ggaggattgcttgagcctgt

SEQ ID NO: 9584 - DNA, 20 bp, Artificial
  CRISPR gRNA sequence
gaggattgcttgagcctgtg

SEQ ID NO: 9585 - DNA, 20 bp, Artificial
  CRISPR gRNA sequence
tgcttgagcctgtgaggttg

SEQ ID NO: 9586 - DNA, 20 bp, Artificial
  CRISPR gRNA sequence
agcctgtgaggttgaagctg

SEQ ID NO: 9587 - DNA, 20 bp, Artificial
  CRISPR gRNA sequence
ctgtgaggttgaagctgtgg

SEQ ID NO: 9588 - DNA, 20 bp, Artificial
  CRISPR gRNA sequence
atgattgtgccattgcacgc

SEQ ID NO: 9589 - DNA, 20 bp, Artificial
  CRISPR gRNA sequence
tgtgccattgcacgccagcc

SEQ ID NO: 9590 - DNA, 20 bp, Artificial
  CRISPR gRNA sequence
gtgccattgcacgccagcct

SEQ ID NO: 9591 - DNA, 20 bp, Artificial
  CRISPR gRNA sequence
gcacgccagcctgggcgaca

SEQ ID NO: 9592 - DNA, 20 bp, Artificial
  CRISPR gRNA sequence
gccagcctgggcgacatagt

SEQ ID NO: 9593 - DNA, 20 bp, Artificial
  CRISPR gRNA sequence
aaaaaaatcaaaaaattatc

SEQ ID NO: 9594 - DNA, 20 bp, Artificial
  CRISPR gRNA sequence
aaaaaatcaaaaaattatct

SEQ ID NO: 9595 - DNA, 20 bp, Artificial
  CRISPR gRNA sequence
atcaaaaaattatctgggca

SEQ ID NO: 9596 - DNA, 20 bp, Artificial
  CRISPR gRNA sequence
ggcatggtgtcacatgtctg

SEQ ID NO: 9597 - DNA, 20 bp, Artificial
  CRISPR gRNA sequence
gtgtcacatgtctgtggtcc

SEQ ID NO: 9598 - DNA, 20 bp, Artificial
  CRISPR gRNA sequence
tgtctgtggtcccagctact

SEQ ID NO: 9599 - DNA, 20 bp, Artificial
  CRISPR gRNA sequence
gtctgtggtcccagctactt

SEQ ID NO: 9600 - DNA, 20 bp, Artificial
  CRISPR gRNA sequence
ctgtggtcccagctacttgg

SEQ ID NO: 9601 - DNA, 20 bp, Artificial
  CRISPR gRNA sequence
tgtggtcccagctacttggg

SEQ ID NO: 9602 - DNA, 20 bp, Artificial
  CRISPR gRNA sequence
ggtcccagctacttgggagg

SEQ ID NO: 9603 - DNA, 20 bp, Artificial
  CRISPR gRNA sequence
tcccagctacttgggaggtg

SEQ ID NO: 9604 - DNA, 20 bp, Artificial
  CRISPR gRNA sequence
agctacttgggaggtggagt

SEQ ID NO: 9605 - DNA, 20 bp, Artificial
  CRISPR gRNA sequence
gctacttgggaggtggagtc

SEQ ID NO: 9606 - DNA, 20 bp, Artificial
  CRISPR gRNA sequence
tacttgggaggtggagtcag

SEQ ID NO: 9607 - DNA, 20 bp, Artificial
  CRISPR gRNA sequence
acttgggaggtggagtcagg

SEQ ID NO: 9608 - DNA, 20 bp, Artificial
  CRISPR gRNA sequence
tggagtcaggaggatcgcat

SEQ ID NO: 9609 - DNA, 20 bp, Artificial
  CRISPR gRNA sequence
tcaggaggatcgcatgagcc

SEQ ID NO: 9610 - DNA, 20 bp, Artificial
  CRISPR gRNA sequence
caggaggatcgcatgagccc

SEQ ID NO: 9611 - DNA, 20 bp, Artificial
  CRISPR gRNA sequence
ggaggatcgcatgagcccag

SEQ ID NO: 9612 - DNA, 20 bp, Artificial
  CRISPR gRNA sequence
gaggatcgcatgagcccagg

SEQ ID NO: 9613 - DNA, 20 bp, Artificial
  CRISPR gRNA sequence
tcgcatgagcccaggaggtt

SEQ ID NO: 9614 - DNA, 20 bp, Artificial
  CRISPR gRNA sequence
cgcatgagcccaggaggttg

SEQ ID NO: 9615 - DNA, 20 bp, Artificial
  CRISPR gRNA sequence
agcccaggaggttgaggttg

SEQ ID NO: 9616 - DNA, 20 bp, Artificial
  CRISPR gRNA sequence
caggaggttgaggttgcagc

SEQ ID NO: 9617 - DNA, 20 bp, Artificial
  CRISPR gRNA sequence
gtgatcacaccactgcattc

SEQ ID NO: 9618 - DNA, 20 bp, Artificial
  CRISPR gRNA sequence
cacaccactgcattccagcc

SEQ ID NO: 9619 - DNA, 20 bp, Artificial
  CRISPR gRNA sequence
acaccactgcattccagcct

SEQ ID NO: 9620 - DNA, 20 bp, Artificial
  CRISPR gRNA sequence
gcattccagcctgggcaaaa

SEQ ID NO: 9621 - DNA, 20 bp, Artificial
  CRISPR gRNA sequence
tccagcctgggcaaaaaagc

SEQ ID NO: 9622 - DNA, 20 bp, Artificial
  CRISPR gRNA sequence
aaacaaacaaaaaaactgtg

SEQ ID NO: 9623 - DNA, 20 bp, Artificial
  CRISPR gRNA sequence
aacaaacaaaaaaactgtgt

SEQ ID NO: 9624 - DNA, 20 bp, Artificial
  CRISPR gRNA sequence
acaaacaaaaaaactgtgtg

SEQ ID NO: 9625 - DNA, 20 bp, Artificial
  CRISPR gRNA sequence
caaaaaaactgtgtggggaa

SEQ ID NO: 9626 - DNA, 20 bp, Artificial
  CRISPR gRNA sequence
tggggaacagatgtaaatga

SEQ ID NO: 9627 - DNA, 20 bp, Artificial
  CRISPR gRNA sequence
ggaacagatgtaaatgatgg

SEQ ID NO: 9628 - DNA, 20 bp, Artificial
  CRISPR gRNA sequence
acagatgtaaatgatggtgg

SEQ ID NO: 9629 - DNA, 20 bp, Artificial
  CRISPR gRNA sequence
gtaaatgatggtggcagtgc

SEQ ID NO: 9630 - DNA, 20 bp, Artificial
  CRISPR gRNA sequence
tggtggcagtgctggccttg

SEQ ID NO: 9631 - DNA, 20 bp, Artificial
  CRISPR gRNA sequence
tggcagtgctggccttgtgg

SEQ ID NO: 9632 - DNA, 20 bp, Artificial
  CRISPR gRNA sequence
agtgctggccttgtggtggc

SEQ ID NO: 9633 - DNA, 20 bp, Artificial
  CRISPR gRNA sequence
ggccttgtggtggctggccc

SEQ ID NO: 9634 - DNA, 20 bp, Artificial
  CRISPR gRNA sequence
cccccaccctgacacgcccc

SEQ ID NO: 9635 - DNA, 20 bp, Artificial
  CRISPR gRNA sequence
tgacacgcccctggcctttg

SEQ ID NO: 9636 - DNA, 20 bp, Artificial
  CRISPR gRNA sequence
acacgcccctggcctttgca

SEQ ID NO: 9637 - DNA, 20 bp, Artificial
  CRISPR gRNA sequence
gcccctggcctttgcagagc

SEQ ID NO: 9638 - DNA, 20 bp, Artificial
  CRISPR gRNA sequence
cctggcctttgcagagccgg

SEQ ID NO: 9639 - DNA, 20 bp, Artificial
  CRISPR gRNA sequence
tggcctttgcagagccggtg

SEQ ID NO: 9640 - DNA, 20 bp, Artificial
  CRISPR gRNA sequence
cctttgcagagccggtggag

SEQ ID NO: 9641 - DNA, 20 bp, Artificial
  CRISPR gRNA sequence
agcagttctaccgctcactg

SEQ ID NO: 9642 - DNA, 20 bp, Artificial
  CRISPR gRNA sequence
gcagttctaccgctcactgc

SEQ ID NO: 9643 - DNA, 20 bp, Artificial
  CRISPR gRNA sequence
cgctcactgcaggacacgta

SEQ ID NO: 9644 - DNA, 20 bp, Artificial
  CRISPR gRNA sequence
tgcaggacacgtatggtgcc

SEQ ID NO: 9645 - DNA, 20 bp, Artificial
  CRISPR gRNA sequence
cacgtatggtgccgagcccg

SEQ ID NO: 9646 - DNA, 20 bp, Artificial
  CRISPR gRNA sequence
acgtatggtgccgagcccgc

SEQ ID NO: 9647 - DNA, 20 bp, Artificial
  CRISPR gRNA sequence
tggtgccgagcccgcaggcc

SEQ ID NO: 9648 - DNA, 20 bp, Artificial
  CRISPR gRNA sequence
gccgagcccgcaggcccgga

SEQ ID NO: 9649 - DNA, 20 bp, Artificial
  CRISPR gRNA sequence
cgcaggcccggatggcatcc

SEQ ID NO: 9650 - DNA, 20 bp, Artificial
  CRISPR gRNA sequence
aggcccggatggcatcctag

SEQ ID NO: 9651 - DNA, 20 bp, Artificial
  CRISPR gRNA sequence
gcccggatggcatcctagtg

SEQ ID NO: 9652 - DNA, 20 bp, Artificial
  CRISPR gRNA sequence
cccggatggcatcctagtgg

SEQ ID NO: 9653 - DNA, 20 bp, Artificial
  CRISPR gRNA sequence
ggatggcatcctagtggagg

SEQ ID NO: 9654 - DNA, 20 bp, Artificial
  CRISPR gRNA sequence
catcctagtggaggtggatc

SEQ ID NO: 9655 - DNA, 20 bp, Artificial
  CRISPR gRNA sequence
tagtggaggtggatctggtg

SEQ ID NO: 9656 - DNA, 20 bp, Artificial
  CRISPR gRNA sequence
agtggaggtggatctggtgc

SEQ ID NO: 9657 - DNA, 20 bp, Artificial
  CRISPR gRNA sequence
gaggtggatctggtgcaggc

SEQ ID NO: 9658 - DNA, 20 bp, Artificial
  CRISPR gRNA sequence
aggtggatctggtgcaggcc

SEQ ID NO: 9659 - DNA, 20 bp, Artificial
  CRISPR gRNA sequence
ggatctggtgcaggccaggc

SEQ ID NO: 9660 - DNA, 20 bp, Artificial
  CRISPR gRNA sequence
atctggtgcaggccaggctg

SEQ ID NO: 9661 - DNA, 20 bp, Artificial
  CRISPR gRNA sequence
ctggtgcaggccaggctgga

SEQ ID NO: 9662 - DNA, 20 bp, Artificial
  CRISPR gRNA sequence
tggtgcaggccaggctggag

SEQ ID NO: 9663 - DNA, 20 bp, Artificial
  CRISPR gRNA sequence
gtgcaggccaggctggagag

SEQ ID NO: 9664 - DNA, 20 bp, Artificial
  CRISPR gRNA sequence
caggccaggctggagaggag

SEQ ID NO: 9665 - DNA, 20 bp, Artificial
  CRISPR gRNA sequence
gccaggctggagaggagcag

SEQ ID NO: 9666 - DNA, 20 bp, Artificial
  CRISPR gRNA sequence
ggctggagaggagcagcagc

SEQ ID NO: 9667 - DNA, 20 bp, Artificial
  CRISPR gRNA sequence
ctggagaggagcagcagcaa

SEQ ID NO: 9668 - DNA, 20 bp, Artificial
  CRISPR gRNA sequence
gaggagcagcagcaagagcc

SEQ ID NO: 9669 - DNA, 20 bp, Artificial
  CRISPR gRNA sequence
ggagcagcagcaagagcctg

SEQ ID NO: 9670 - DNA, 20 bp, Artificial
  CRISPR gRNA sequence
gcagcagcaagagcctggag

SEQ ID NO: 9671 - DNA, 20 bp, Artificial
  CRISPR gRNA sequence
cagcagcaagagcctggagc

SEQ ID NO: 9672 - DNA, 20 bp, Artificial
  CRISPR gRNA sequence
caagagcctggagcgggaac

SEQ ID NO: 9673 - DNA, 20 bp, Artificial
  CRISPR gRNA sequence
ggagcgggaactggccaccc

SEQ ID NO: 9674 - DNA, 20 bp, Artificial
  CRISPR gRNA sequence
gggaactggccaccccggac

SEQ ID NO: 9675 - DNA, 20 bp, Artificial
  CRISPR gRNA sequence
ggaactggccaccccggact

SEQ ID NO: 9676 - DNA, 20 bp, Artificial
  CRISPR gRNA sequence
actggccaccccggactggg

SEQ ID NO: 9677 - DNA, 20 bp, Artificial
  CRISPR gRNA sequence
ccaccccggactgggcagaa

SEQ ID NO: 9678 - DNA, 20 bp, Artificial
  CRISPR gRNA sequence
ccccggactgggcagaacgg

SEQ ID NO: 9679 - DNA, 20 bp, Artificial
  CRISPR gRNA sequence
ggactgggcagaacggcagc

SEQ ID NO: 9680 - DNA, 20 bp, Artificial
  CRISPR gRNA sequence
ggcagaacggcagctggccc

SEQ ID NO: 9681 - DNA, 20 bp, Artificial
  CRISPR gRNA sequence
gcagaacggcagctggccca

SEQ ID NO: 9682 - DNA, 20 bp, Artificial
  CRISPR gRNA sequence
agaacggcagctggcccaag

SEQ ID NO: 9683 - DNA, 20 bp, Artificial
  CRISPR gRNA sequence
gaacggcagctggcccaagg

SEQ ID NO: 9684 - DNA, 20 bp, Artificial
  CRISPR gRNA sequence
gcagctggcccaaggaggcc

SEQ ID NO: 9685 - DNA, 20 bp, Artificial
  CRISPR gRNA sequence
tggcccaaggaggcctggct

SEQ ID NO: 9686 - DNA, 20 bp, Artificial
  CRISPR gRNA sequence
ggcccaaggaggcctggctg

SEQ ID NO: 9687 - DNA, 20 bp, Artificial
  CRISPR gRNA sequence
aggcctggctgaggtgctgt

SEQ ID NO: 9688 - DNA, 20 bp, Artificial
  CRISPR gRNA sequence
ctgaggtgctgttggctgcc

SEQ ID NO: 9689 - DNA, 20 bp, Artificial
  CRISPR gRNA sequence
tgaggtgctgttggctgcca

SEQ ID NO: 9690 - DNA, 20 bp, Artificial
  CRISPR gRNA sequence
aggtgctgttggctgccaag

SEQ ID NO: 9691 - DNA, 20 bp, Artificial
  CRISPR gRNA sequence
tgttggctgccaaggagcac

SEQ ID NO: 9692 - DNA, 20 bp, Artificial
  CRISPR gRNA sequence
tggctgccaaggagcaccgg

SEQ ID NO: 9693 - DNA, 20 bp, Artificial
  CRISPR gRNA sequence
aggagcaccggcggccgcgt

SEQ ID NO: 9694 - DNA, 20 bp, Artificial
  CRISPR gRNA sequence
ccggcggccgcgtgagacac

SEQ ID NO: 9695 - DNA, 20 bp, Artificial
  CRISPR gRNA sequence
gacacgagtgattgctgtgc

SEQ ID NO: 9696 - DNA, 20 bp, Artificial
  CRISPR gRNA sequence
acacgagtgattgctgtgct

SEQ ID NO: 9697 - DNA, 20 bp, Artificial
  CRISPR gRNA sequence
agtgattgctgtgctgggca

SEQ ID NO: 9698 - DNA, 20 bp, Artificial
  CRISPR gRNA sequence
attgctgtgctgggcaaagc

SEQ ID NO: 9699 - DNA, 20 bp, Artificial
  CRISPR gRNA sequence
ctgtgctgggcaaagctggt

SEQ ID NO: 9700 - DNA, 20 bp, Artificial
  CRISPR gRNA sequence
tgtgctgggcaaagctggtc

SEQ ID NO: 9701 - DNA, 20 bp, Artificial
  CRISPR gRNA sequence
gtgctgggcaaagctggtca

SEQ ID NO: 9702 - DNA, 20 bp, Artificial
  CRISPR gRNA sequence
tgggcaaagctggtcagggc

SEQ ID NO: 9703 - DNA, 20 bp, Artificial
  CRISPR gRNA sequence
ggcaaagctggtcagggcaa

SEQ ID NO: 9704 - DNA, 20 bp, Artificial
  CRISPR gRNA sequence
ctggtcagggcaagagctat

SEQ ID NO: 9705 - DNA, 20 bp, Artificial
  CRISPR gRNA sequence
tggtcagggcaagagctatt

SEQ ID NO: 9706 - DNA, 20 bp, Artificial
  CRISPR gRNA sequence
cagggcaagagctattgggc

SEQ ID NO: 9707 - DNA, 20 bp, Artificial
  CRISPR gRNA sequence
agggcaagagctattgggct

SEQ ID NO: 9708 - DNA, 20 bp, Artificial
  CRISPR gRNA sequence
gggcaagagctattgggctg

SEQ ID NO: 9709 - DNA, 20 bp, Artificial
  CRISPR gRNA sequence
caagagctattgggctgggg

SEQ ID NO: 9710 - DNA, 20 bp, Artificial
  CRISPR gRNA sequence
agctattgggctggggcagt

SEQ ID NO: 9711 - DNA, 20 bp, Artificial
  CRISPR gRNA sequence
attgggctggggcagtgagc

SEQ ID NO: 9712 - DNA, 20 bp, Artificial
  CRISPR gRNA sequence
ttgggctggggcagtgagcc

SEQ ID NO: 9713 - DNA, 20 bp, Artificial
  CRISPR gRNA sequence
ctggggcagtgagccgggcc

SEQ ID NO: 9714 - DNA, 20 bp, Artificial
  CRISPR gRNA sequence
tggggcagtgagccgggcct

SEQ ID NO: 9715 - DNA, 20 bp, Artificial
  CRISPR gRNA sequence
gtgagccgggcctgggcttg

SEQ ID NO: 9716 - DNA, 20 bp, Artificial
  CRISPR gRNA sequence
gccgggcctgggcttgtggc

SEQ ID NO: 9717 - DNA, 20 bp, Artificial
  CRISPR gRNA sequence
gggcttgtggccggcttccc

SEQ ID NO: 9718 - DNA, 20 bp, Artificial
  CRISPR gRNA sequence
ctgccattgcttgaaccgtc

SEQ ID NO: 9719 - DNA, 20 bp, Artificial
  CRISPR gRNA sequence
tgccattgcttgaaccgtcc

SEQ ID NO: 9720 - DNA, 20 bp, Artificial
  CRISPR gRNA sequence
gccattgcttgaaccgtccg

SEQ ID NO: 9721 - DNA, 20 bp, Artificial
  CRISPR gRNA sequence
ccattgcttgaaccgtccgg

SEQ ID NO: 9722 - DNA, 20 bp, Artificial
  CRISPR gRNA sequence
aaccgtccgggggatgccta

SEQ ID NO: 9723 - DNA, 20 bp, Artificial
  CRISPR gRNA sequence
cgggggatgcctatggcctg

SEQ ID NO: 9724 - DNA, 20 bp, Artificial
  CRISPR gRNA sequence
gggggatgcctatggcctgc

SEQ ID NO: 9725 - DNA, 20 bp, Artificial
  CRISPR gRNA sequence
gcaggatctgctcttctccc

SEQ ID NO: 9726 - DNA, 20 bp, Artificial
  CRISPR gRNA sequence
caggatctgctcttctccct

SEQ ID NO: 9727 - DNA, 20 bp, Artificial
  CRISPR gRNA sequence
tgctcttctccctgggccca

SEQ ID NO: 9728 - DNA, 20 bp, Artificial
  CRISPR gRNA sequence
cctgggcccacagccactcg

SEQ ID NO: 9729 - DNA, 20 bp, Artificial
  CRISPR gRNA sequence
gggcccacagccactcgtgg

SEQ ID NO: 9730 - DNA, 20 bp, Artificial
  CRISPR gRNA sequence
agccactcgtggcggccgat

SEQ ID NO: 9731 - DNA, 20 bp, Artificial
  CRISPR gRNA sequence
gccactcgtggcggccgatg

SEQ ID NO: 9732 - DNA, 20 bp, Artificial
  CRISPR gRNA sequence
gtggcggccgatgaggtttt

SEQ ID NO: 9733 - DNA, 20 bp, Artificial
  CRISPR gRNA sequence
aggttttcagccacatcttg

SEQ ID NO: 9734 - DNA, 20 bp, Artificial
  CRISPR gRNA sequence
gttttcagccacatcttgaa

SEQ ID NO: 9735 - DNA, 20 bp, Artificial
  CRISPR gRNA sequence
tgaccgcgttctgctcatcc

SEQ ID NO: 9736 - DNA, 20 bp, Artificial
  CRISPR gRNA sequence
cgcgttctgctcatcctaga

SEQ ID NO: 9737 - DNA, 20 bp, Artificial
  CRISPR gRNA sequence
tgctcatcctagacggcttc

SEQ ID NO: 9738 - DNA, 20 bp, Artificial
  CRISPR gRNA sequence
gctcatcctagacggcttcg

SEQ ID NO: 9739 - DNA, 20 bp, Artificial
  CRISPR gRNA sequence
tcatcctagacggcttcgag

SEQ ID NO: 9740 - DNA, 20 bp, Artificial
  CRISPR gRNA sequence
cctagacggcttcgaggagc

SEQ ID NO: 9741 - DNA, 20 bp, Artificial
  CRISPR gRNA sequence
agacggcttcgaggagctgg

SEQ ID NO: 9742 - DNA, 20 bp, Artificial
  CRISPR gRNA sequence
cttcgaggagctggaagcgc

SEQ ID NO: 9743 - DNA, 20 bp, Artificial
  CRISPR gRNA sequence
gaggagctggaagcgcaaga

SEQ ID NO: 9744 - DNA, 20 bp, Artificial
  CRISPR gRNA sequence
gcgcaagatggcttcctgca

SEQ ID NO: 9745 - DNA, 20 bp, Artificial
  CRISPR gRNA sequence
ggcttcctgcacagcacgtg

SEQ ID NO: 9746 - DNA, 20 bp, Artificial
  CRISPR gRNA sequence
cctgcacagcacgtgcggac

SEQ ID NO: 9747 - DNA, 20 bp, Artificial
  CRISPR gRNA sequence
cagcacgtgcggaccggcac

SEQ ID NO: 9748 - DNA, 20 bp, Artificial
  CRISPR gRNA sequence
cacgtgcggaccggcaccgg

SEQ ID NO: 9749 - DNA, 20 bp, Artificial
  CRISPR gRNA sequence
cgtgcggaccggcaccggcg

SEQ ID NO: 9750 - DNA, 20 bp, Artificial
  CRISPR gRNA sequence
cggcggagccctgctccctc

SEQ ID NO: 9751 - DNA, 20 bp, Artificial
  CRISPR gRNA sequence
ggcggagccctgctccctcc

SEQ ID NO: 9752 - DNA, 20 bp, Artificial
  CRISPR gRNA sequence
gcggagccctgctccctccg

SEQ ID NO: 9753 - DNA, 20 bp, Artificial
  CRISPR gRNA sequence
cggagccctgctccctccgg

SEQ ID NO: 9754 - DNA, 20 bp, Artificial
  CRISPR gRNA sequence
ctgctccctccgggggctgc

SEQ ID NO: 9755 - DNA, 20 bp, Artificial
  CRISPR gRNA sequence
tccctccgggggctgctggc

SEQ ID NO: 9756 - DNA, 20 bp, Artificial
  CRISPR gRNA sequence
ggctgctggccggccttttc

SEQ ID NO: 9757 - DNA, 20 bp, Artificial
  CRISPR gRNA sequence
tgctggccggccttttccag

SEQ ID NO: 9758 - DNA, 20 bp, Artificial
  CRISPR gRNA sequence
tggccggccttttccagaag

SEQ ID NO: 9759 - DNA, 20 bp, Artificial
  CRISPR gRNA sequence
tttccagaagaagctgctcc

SEQ ID NO: 9760 - DNA, 20 bp, Artificial
  CRISPR gRNA sequence
ttccagaagaagctgctccg

SEQ ID NO: 9761 - DNA, 20 bp, Artificial
  CRISPR gRNA sequence
aggttgcaccctcctcctca

SEQ ID NO: 9762 - DNA, 20 bp, Artificial
  CRISPR gRNA sequence
gcaccctcctcctcacagcc

SEQ ID NO: 9763 - DNA, 20 bp, Artificial
  CRISPR gRNA sequence
tcctcctcacagcccggccc

SEQ ID NO: 9764 - DNA, 20 bp, Artificial
  CRISPR gRNA sequence
cctcctcacagcccggcccc

SEQ ID NO: 9765 - DNA, 20 bp, Artificial
  CRISPR gRNA sequence
ctcctcacagcccggccccg

SEQ ID NO: 9766 - DNA, 20 bp, Artificial
  CRISPR gRNA sequence
agcccggccccggggccgcc

SEQ ID NO: 9767 - DNA, 20 bp, Artificial
  CRISPR gRNA sequence
ggccccggggccgcctggtc

SEQ ID NO: 9768 - DNA, 20 bp, Artificial
  CRISPR gRNA sequence
ccccggggccgcctggtcca

SEQ ID NO: 9769 - DNA, 20 bp, Artificial
  CRISPR gRNA sequence
ggccgcctggtccagagcct

SEQ ID NO: 9770 - DNA, 20 bp, Artificial
  CRISPR gRNA sequence
gcctggtccagagcctgagc

SEQ ID NO: 9771 - DNA, 20 bp, Artificial
  CRISPR gRNA sequence
cctggtccagagcctgagca

SEQ ID NO: 9772 - DNA, 20 bp, Artificial
  CRISPR gRNA sequence
gcaaggccgacgccctattt

SEQ ID NO: 9773 - DNA, 20 bp, Artificial
  CRISPR gRNA sequence
gacgccctatttgagctgtc

SEQ ID NO: 9774 - DNA, 20 bp, Artificial
  CRISPR gRNA sequence
tgagctgtccggcttctcca

SEQ ID NO: 9775 - DNA, 20 bp, Artificial
  CRISPR gRNA sequence
agctgtccggcttctccatg

SEQ ID NO: 9776 - DNA, 20 bp, Artificial
  CRISPR gRNA sequence
tgtccggcttctccatggag

SEQ ID NO: 9777 - DNA, 20 bp, Artificial
  CRISPR gRNA sequence
gtccggcttctccatggagc

SEQ ID NO: 9778 - DNA, 20 bp, Artificial
  CRISPR gRNA sequence
gcttctccatggagcaggcc

SEQ ID NO: 9779 - DNA, 20 bp, Artificial
  CRISPR gRNA sequence
cttctccatggagcaggccc

SEQ ID NO: 9780 - DNA, 20 bp, Artificial
  CRISPR gRNA sequence
catacgtgatgcgctacttt

SEQ ID NO: 9781 - DNA, 20 bp, Artificial
  CRISPR gRNA sequence
tacgtgatgcgctactttga

SEQ ID NO: 9782 - DNA, 20 bp, Artificial
  CRISPR gRNA sequence
gatgcgctactttgagagct

SEQ ID NO: 9783 - DNA, 20 bp, Artificial
  CRISPR gRNA sequence
atgcgctactttgagagctc

SEQ ID NO: 9784 - DNA, 20 bp, Artificial
  CRISPR gRNA sequence
tgcgctactttgagagctca

SEQ ID NO: 9785 - DNA, 20 bp, Artificial
  CRISPR gRNA sequence
ctttgagagctcagggatga

SEQ ID NO: 9786 - DNA, 20 bp, Artificial
  CRISPR gRNA sequence
ttgagagctcagggatgaca

SEQ ID NO: 9787 - DNA, 20 bp, Artificial
  CRISPR gRNA sequence
ctcagggatgacagagcacc

SEQ ID NO: 9788 - DNA, 20 bp, Artificial
  CRISPR gRNA sequence
gggatgacagagcaccaaga

SEQ ID NO: 9789 - DNA, 20 bp, Artificial
  CRISPR gRNA sequence
gatgacagagcaccaagaca

SEQ ID NO: 9790 - DNA, 20 bp, Artificial
  CRISPR gRNA sequence
acagagccctgacgctcctc

SEQ ID NO: 9791 - DNA, 20 bp, Artificial
  CRISPR gRNA sequence
cagagccctgacgctcctcc

SEQ ID NO: 9792 - DNA, 20 bp, Artificial
  CRISPR gRNA sequence
ccctgacgctcctccgggac

SEQ ID NO: 9793 - DNA, 20 bp, Artificial
  CRISPR gRNA sequence
cgggaccggccacttcttct

SEQ ID NO: 9794 - DNA, 20 bp, Artificial
  CRISPR gRNA sequence
cggccacttcttctcagtca

SEQ ID NO: 9795 - DNA, 20 bp, Artificial
  CRISPR gRNA sequence
cttcttctcagtcacagcca

SEQ ID NO: 9796 - DNA, 20 bp, Artificial
  CRISPR gRNA sequence
gccacagccctactttgtgc

SEQ ID NO: 9797 - DNA, 20 bp, Artificial
  CRISPR gRNA sequence
ccacagccctactttgtgcc

SEQ ID NO: 9798 - DNA, 20 bp, Artificial
  CRISPR gRNA sequence
cagccctactttgtgccggg

SEQ ID NO: 9799 - DNA, 20 bp, Artificial
  CRISPR gRNA sequence
ctttgtgccgggcagtgtgc

SEQ ID NO: 9800 - DNA, 20 bp, Artificial
  CRISPR gRNA sequence
ccgggcagtgtgccagctct

SEQ ID NO: 9801 - DNA, 20 bp, Artificial
  CRISPR gRNA sequence
gggcagtgtgccagctctca

SEQ ID NO: 9802 - DNA, 20 bp, Artificial
  CRISPR gRNA sequence
ggcagtgtgccagctctcag

SEQ ID NO: 9803 - DNA, 20 bp, Artificial
  CRISPR gRNA sequence
ccagctctcagaggccctgc

SEQ ID NO: 9804 - DNA, 20 bp, Artificial
  CRISPR gRNA sequence
agctctcagaggccctgctg

SEQ ID NO: 9805 - DNA, 20 bp, Artificial
  CRISPR gRNA sequence
tcagaggccctgctggagct

SEQ ID NO: 9806 - DNA, 20 bp, Artificial
  CRISPR gRNA sequence
cagaggccctgctggagctt

SEQ ID NO: 9807 - DNA, 20 bp, Artificial
  CRISPR gRNA sequence
agaggccctgctggagcttg

SEQ ID NO: 9808 - DNA, 20 bp, Artificial
  CRISPR gRNA sequence
aggccctgctggagcttggg

SEQ ID NO: 9809 - DNA, 20 bp, Artificial
  CRISPR gRNA sequence
ggccctgctggagcttgggg

SEQ ID NO: 9810 - DNA, 20 bp, Artificial
  CRISPR gRNA sequence
tggagcttggggaggacgcc

SEQ ID NO: 9811 - DNA, 20 bp, Artificial
  CRISPR gRNA sequence
caagctgccctccacgctca

SEQ ID NO: 9812 - DNA, 20 bp, Artificial
  CRISPR gRNA sequence
aagctgccctccacgctcac

SEQ ID NO: 9813 - DNA, 20 bp, Artificial
  CRISPR gRNA sequence
acgctcacgggactctatgt

SEQ ID NO: 9814 - DNA, 20 bp, Artificial
  CRISPR gRNA sequence
gggactctatgtcggcctgc

SEQ ID NO: 9815 - DNA, 20 bp, Artificial
  CRISPR gRNA sequence
ggactctatgtcggcctgct

SEQ ID NO: 9816 - DNA, 20 bp, Artificial
  CRISPR gRNA sequence
tgtcggcctgctgggccgtg

SEQ ID NO: 9817 - DNA, 20 bp, Artificial
  CRISPR gRNA sequence
ctgggccgtgcagccctcga

SEQ ID NO: 9818 - DNA, 20 bp, Artificial
  CRISPR gRNA sequence
gcagccctcgacagcccccc

SEQ ID NO: 9819 - DNA, 20 bp, Artificial
  CRISPR gRNA sequence
cagccctcgacagccccccc

SEQ ID NO: 9820 - DNA, 20 bp, Artificial
  CRISPR gRNA sequence
agccctcgacagcccccccg

SEQ ID NO: 9821 - DNA, 20 bp, Artificial
  CRISPR gRNA sequence
cgacagcccccccggggccc

SEQ ID NO: 9822 - DNA, 20 bp, Artificial
  CRISPR gRNA sequence
cagcccccccggggccctgg

SEQ ID NO: 9823 - DNA, 20 bp, Artificial
  CRISPR gRNA sequence
gcccccccggggccctggca

SEQ ID NO: 9824 - DNA, 20 bp, Artificial
  CRISPR gRNA sequence
ccccggggccctggcagagc

SEQ ID NO: 9825 - DNA, 20 bp, Artificial
  CRISPR gRNA sequence
gggccctggcagagctggcc

SEQ ID NO: 9826 - DNA, 20 bp, Artificial
  CRISPR gRNA sequence
cctggcagagctggccaagc

SEQ ID NO: 9827 - DNA, 20 bp, Artificial
  CRISPR gRNA sequence
cagagctggccaagctggcc

SEQ ID NO: 9828 - DNA, 20 bp, Artificial
  CRISPR gRNA sequence
agagctggccaagctggcct

SEQ ID NO: 9829 - DNA, 20 bp, Artificial
  CRISPR gRNA sequence
agctggccaagctggcctgg

SEQ ID NO: 9830 - DNA, 20 bp, Artificial
  CRISPR gRNA sequence
ggccaagctggcctgggagc

SEQ ID NO: 9831 - DNA, 20 bp, Artificial
  CRISPR gRNA sequence
gccaagctggcctgggagct

SEQ ID NO: 9832 - DNA, 20 bp, Artificial
  CRISPR gRNA sequence
ctggcctgggagctgggccg

SEQ ID NO: 9833 - DNA, 20 bp, Artificial
  CRISPR gRNA sequence
gagctgggccgcagacatca

SEQ ID NO: 9834 - DNA, 20 bp, Artificial
  CRISPR gRNA sequence
gcagacatcaaagtacccta

SEQ ID NO: 9835 - DNA, 20 bp, Artificial
  CRISPR gRNA sequence
cagacatcaaagtaccctac

SEQ ID NO: 9836 - DNA, 20 bp, Artificial
  CRISPR gRNA sequence
gacatcaaagtaccctacag

SEQ ID NO: 9837 - DNA, 20 bp, Artificial
  CRISPR gRNA sequence
acatcaaagtaccctacagg

SEQ ID NO: 9838 - DNA, 20 bp, Artificial
  CRISPR gRNA sequence
aaagtaccctacaggaggac

SEQ ID NO: 9839 - DNA, 20 bp, Artificial
  CRISPR gRNA sequence
ggaggaccagttcccatccg

SEQ ID NO: 9840 - DNA, 20 bp, Artificial
  CRISPR gRNA sequence
cagttcccatccgcagacgt

SEQ ID NO: 9841 - DNA, 20 bp, Artificial
  CRISPR gRNA sequence
agttcccatccgcagacgtg

SEQ ID NO: 9842 - DNA, 20 bp, Artificial
  CRISPR gRNA sequence
catccgcagacgtgaggacc

SEQ ID NO: 9843 - DNA, 20 bp, Artificial
  CRISPR gRNA sequence
atccgcagacgtgaggacct

SEQ ID NO: 9844 - DNA, 20 bp, Artificial
  CRISPR gRNA sequence
agacgtgaggacctgggcga

SEQ ID NO: 9845 - DNA, 20 bp, Artificial
  CRISPR gRNA sequence
gaggacctgggcgatggcca

SEQ ID NO: 9846 - DNA, 20 bp, Artificial
  CRISPR gRNA sequence
aggacctgggcgatggccaa

SEQ ID NO: 9847 - DNA, 20 bp, Artificial
  CRISPR gRNA sequence
ctgggcgatggccaaaggct

SEQ ID NO: 9848 - DNA, 20 bp, Artificial
  CRISPR gRNA sequence
gcttagtccaacacccaccg

SEQ ID NO: 9849 - DNA, 20 bp, Artificial
  CRISPR gRNA sequence
cttagtccaacacccaccgc

SEQ ID NO: 9850 - DNA, 20 bp, Artificial
  CRISPR gRNA sequence
ccaacacccaccgcgggccg

SEQ ID NO: 9851 - DNA, 20 bp, Artificial
  CRISPR gRNA sequence
aacacccaccgcgggccgca

SEQ ID NO: 9852 - DNA, 20 bp, Artificial
  CRISPR gRNA sequence
caccgcgggccgcagagtcc

SEQ ID NO: 9853 - DNA, 20 bp, Artificial
  CRISPR gRNA sequence
gcgggccgcagagtccgagc

SEQ ID NO: 9854 - DNA, 20 bp, Artificial
  CRISPR gRNA sequence
gagtccgagctggccttccc

SEQ ID NO: 9855 - DNA, 20 bp, Artificial
  CRISPR gRNA sequence
cttcctcctgcaatgcttcc

SEQ ID NO: 9856 - DNA, 20 bp, Artificial
  CRISPR gRNA sequence
ttcctcctgcaatgcttcct

SEQ ID NO: 9857 - DNA, 20 bp, Artificial
  CRISPR gRNA sequence
tcctcctgcaatgcttcctg

SEQ ID NO: 9858 - DNA, 20 bp, Artificial
  CRISPR gRNA sequence
cctcctgcaatgcttcctgg

SEQ ID NO: 9859 - DNA, 20 bp, Artificial
  CRISPR gRNA sequence
aatgcttcctgggggccctg

SEQ ID NO: 9860 - DNA, 20 bp, Artificial
  CRISPR gRNA sequence
cttcctgggggccctgtggc

SEQ ID NO: 9861 - DNA, 20 bp, Artificial
  CRISPR gRNA sequence
ggggccctgtggctggctct

SEQ ID NO: 9862 - DNA, 20 bp, Artificial
  CRISPR gRNA sequence
gccctgtggctggctctgag

SEQ ID NO: 9863 - DNA, 20 bp, Artificial
  CRISPR gRNA sequence
tggctctgagtggcgaaatc

SEQ ID NO: 9864 - DNA, 20 bp, Artificial
  CRISPR gRNA sequence
ggctctgagtggcgaaatca

SEQ ID NO: 9865 - DNA, 20 bp, Artificial
  CRISPR gRNA sequence
tgagtggcgaaatcaaggac

SEQ ID NO: 9866 - DNA, 20 bp, Artificial
  CRISPR gRNA sequence
gagtggcgaaatcaaggaca

SEQ ID NO: 9867 - DNA, 20 bp, Artificial
  CRISPR gRNA sequence
gtggcgaaatcaaggacaag

SEQ ID NO: 9868 - DNA, 20 bp, Artificial
  CRISPR gRNA sequence
tcaaggacaaggagctcccg

SEQ ID NO: 9869 - DNA, 20 bp, Artificial
  CRISPR gRNA sequence
caaggagctcccgcagtacc

SEQ ID NO: 9870 - DNA, 20 bp, Artificial
  CRISPR gRNA sequence
cagtacctagcattgacccc

SEQ ID NO: 9871 - DNA, 20 bp, Artificial
  CRISPR gRNA sequence
agtacctagcattgacccca

SEQ ID NO: 9872 - DNA, 20 bp, Artificial
  CRISPR gRNA sequence
acctagcattgaccccaagg

SEQ ID NO: 9873 - DNA, 20 bp, Artificial
  CRISPR gRNA sequence
tagcattgaccccaaggaag

SEQ ID NO: 9874 - DNA, 20 bp, Artificial
  CRISPR gRNA sequence
gcattgaccccaaggaagaa

SEQ ID NO: 9875 - DNA, 20 bp, Artificial
  CRISPR gRNA sequence
cattgaccccaaggaagaag

SEQ ID NO: 9876 - DNA, 20 bp, Artificial
  CRISPR gRNA sequence
agaagaggccctatgacaac

SEQ ID NO: 9877 - DNA, 20 bp, Artificial
  CRISPR gRNA sequence
gaggccctatgacaactggc

SEQ ID NO: 9878 - DNA, 20 bp, Artificial
  CRISPR gRNA sequence
ggccctatgacaactggctg

SEQ ID NO: 9879 - DNA, 20 bp, Artificial
  CRISPR gRNA sequence
gccctatgacaactggctgg

SEQ ID NO: 9880 - DNA, 20 bp, Artificial
  CRISPR gRNA sequence
ccctatgacaactggctgga

SEQ ID NO: 9881 - DNA, 20 bp, Artificial
  CRISPR gRNA sequence
ggagggcgtgccacgctttc

SEQ ID NO: 9882 - DNA, 20 bp, Artificial
  CRISPR gRNA sequence
ggcgtgccacgctttctggc

SEQ ID NO: 9883 - DNA, 20 bp, Artificial
  CRISPR gRNA sequence
gcgtgccacgctttctggct

SEQ ID NO: 9884 - DNA, 20 bp, Artificial
  CRISPR gRNA sequence
ttctggctgggctgatcttc

SEQ ID NO: 9885 - DNA, 20 bp, Artificial
  CRISPR gRNA sequence
ccagcctcccgcccgctgcc

SEQ ID NO: 9886 - DNA, 20 bp, Artificial
  CRISPR gRNA sequence
cagcctcccgcccgctgcct

SEQ ID NO: 9887 - DNA, 20 bp, Artificial
  CRISPR gRNA sequence
gcctcccgcccgctgcctgg

SEQ ID NO: 9888 - DNA, 20 bp, Artificial
  CRISPR gRNA sequence
cgctgcctgggagccctact

SEQ ID NO: 9889 - DNA, 20 bp, Artificial
  CRISPR gRNA sequence
gctgcctgggagccctactc

SEQ ID NO: 9890 - DNA, 20 bp, Artificial
  CRISPR gRNA sequence
gggagccctactcgggccat

SEQ ID NO: 9891 - DNA, 20 bp, Artificial
  CRISPR gRNA sequence
agccctactcgggccatcgg

SEQ ID NO: 9892 - DNA, 20 bp, Artificial
  CRISPR gRNA sequence
cgggccatcggcggctgcct

SEQ ID NO: 9893 - DNA, 20 bp, Artificial
  CRISPR gRNA sequence
gccatcggcggctgcctcgg

SEQ ID NO: 9894 - DNA, 20 bp, Artificial
  CRISPR gRNA sequence
tcggcggctgcctcggtgga

SEQ ID NO: 9895 - DNA, 20 bp, Artificial
  CRISPR gRNA sequence
cggcggctgcctcggtggac

SEQ ID NO: 9896 - DNA, 20 bp, Artificial
  CRISPR gRNA sequence
cggctgcctcggtggacagg

SEQ ID NO: 9897 - DNA, 20 bp, Artificial
  CRISPR gRNA sequence
ctgcctcggtggacaggaag

SEQ ID NO: 9898 - DNA, 20 bp, Artificial
  CRISPR gRNA sequence
cctcggtggacaggaagcag

SEQ ID NO: 9899 - DNA, 20 bp, Artificial
  CRISPR gRNA sequence
ctcggtggacaggaagcaga

SEQ ID NO: 9900 - DNA, 20 bp, Artificial
  CRISPR gRNA sequence
aggaagcagaaggtgcttgc

SEQ ID NO: 9901 - DNA, 20 bp, Artificial
  CRISPR gRNA sequence
ggaagcagaaggtgcttgcg

SEQ ID NO: 9902 - DNA, 20 bp, Artificial
  CRISPR gRNA sequence
aggtgcttgcgaggtacctg

SEQ ID NO: 9903 - DNA, 20 bp, Artificial
  CRISPR gRNA sequence
tgcttgcgaggtacctgaag

SEQ ID NO: 9904 - DNA, 20 bp, Artificial
  CRISPR gRNA sequence
cgaggtacctgaagcggctg

SEQ ID NO: 9905 - DNA, 20 bp, Artificial
  CRISPR gRNA sequence
gtacctgaagcggctgcagc

SEQ ID NO: 9906 - DNA, 20 bp, Artificial
  CRISPR gRNA sequence
tacctgaagcggctgcagcc

SEQ ID NO: 9907 - DNA, 20 bp, Artificial
  CRISPR gRNA sequence
acctgaagcggctgcagccg

SEQ ID NO: 9908 - DNA, 20 bp, Artificial
  CRISPR gRNA sequence
ggctgcagccggggacactg

SEQ ID NO: 9909 - DNA, 20 bp, Artificial
  CRISPR gRNA sequence
gctgcagccggggacactgc

SEQ ID NO: 9910 - DNA, 20 bp, Artificial
  CRISPR gRNA sequence
agccggggacactgcgggcg

SEQ ID NO: 9911 - DNA, 20 bp, Artificial
  CRISPR gRNA sequence
cggggacactgcgggcgcgg

SEQ ID NO: 9912 - DNA, 20 bp, Artificial
  CRISPR gRNA sequence
actgcgggcgcggcagctgc

SEQ ID NO: 9913 - DNA, 20 bp, Artificial
  CRISPR gRNA sequence
tgcgggcgcggcagctgctg

SEQ ID NO: 9914 - DNA, 20 bp, Artificial
  CRISPR gRNA sequence
agctgctgcactgcgcccac

SEQ ID NO: 9915 - DNA, 20 bp, Artificial
  CRISPR gRNA sequence
gctgctgcactgcgcccacg

SEQ ID NO: 9916 - DNA, 20 bp, Artificial
  CRISPR gRNA sequence
tgcactgcgcccacgaggcc

SEQ ID NO: 9917 - DNA, 20 bp, Artificial
  CRISPR gRNA sequence
gcactgcgcccacgaggccg

SEQ ID NO: 9918 - DNA, 20 bp, Artificial
  CRISPR gRNA sequence
actgcgcccacgaggccgag

SEQ ID NO: 9919 - DNA, 20 bp, Artificial
  CRISPR gRNA sequence
ctgcgcccacgaggccgagg

SEQ ID NO: 9920 - DNA, 20 bp, Artificial
  CRISPR gRNA sequence
gcccacgaggccgaggaggc

SEQ ID NO: 9921 - DNA, 20 bp, Artificial
  CRISPR gRNA sequence
aggccgaggaggctggaatt

SEQ ID NO: 9922 - DNA, 20 bp, Artificial
  CRISPR gRNA sequence
ccgaggaggctggaatttgg

SEQ ID NO: 9923 - DNA, 20 bp, Artificial
  CRISPR gRNA sequence
ggctggaatttggcagcacg

SEQ ID NO: 9924 - DNA, 20 bp, Artificial
  CRISPR gRNA sequence
gaatttggcagcacgtggta

SEQ ID NO: 9925 - DNA, 20 bp, Artificial
  CRISPR gRNA sequence
aatttggcagcacgtggtac

SEQ ID NO: 9926 - DNA, 20 bp, Artificial
  CRISPR gRNA sequence
tttggcagcacgtggtacag

SEQ ID NO: 9927 - DNA, 20 bp, Artificial
  CRISPR gRNA sequence
cacgtggtacaggagctccc

SEQ ID NO: 9928 - DNA, 20 bp, Artificial
  CRISPR gRNA sequence
ccccggccgcctctcttttc

SEQ ID NO: 9929 - DNA, 20 bp, Artificial
  CRISPR gRNA sequence
cccggccgcctctcttttct

SEQ ID NO: 9930 - DNA, 20 bp, Artificial
  CRISPR gRNA sequence
gcctcctgatgcacatgtac

SEQ ID NO: 9931 - DNA, 20 bp, Artificial
  CRISPR gRNA sequence
cctcctgatgcacatgtact

SEQ ID NO: 9932 - DNA, 20 bp, Artificial
  CRISPR gRNA sequence
ctgatgcacatgtactgggc

SEQ ID NO: 9933 - DNA, 20 bp, Artificial
  CRISPR gRNA sequence
tgatgcacatgtactgggca

SEQ ID NO: 9934 - DNA, 20 bp, Artificial
  CRISPR gRNA sequence
acatgtactgggcaaggcct

SEQ ID NO: 9935 - DNA, 20 bp, Artificial
  CRISPR gRNA sequence
atgtactgggcaaggccttg

SEQ ID NO: 9936 - DNA, 20 bp, Artificial
  CRISPR gRNA sequence
tgtactgggcaaggccttgg

SEQ ID NO: 9937 - DNA, 20 bp, Artificial
  CRISPR gRNA sequence
actgggcaaggccttggagg

SEQ ID NO: 9938 - DNA, 20 bp, Artificial
  CRISPR gRNA sequence
gggcaaggccttggaggcgg

SEQ ID NO: 9939 - DNA, 20 bp, Artificial
  CRISPR gRNA sequence
ggcaaggccttggaggcggc

SEQ ID NO: 9940 - DNA, 20 bp, Artificial
  CRISPR gRNA sequence
ggccttggaggcggcgggcc

SEQ ID NO: 9941 - DNA, 20 bp, Artificial
  CRISPR gRNA sequence
ggcgggccaagacttctccc

SEQ ID NO: 9942 - DNA, 20 bp, Artificial
  CRISPR gRNA sequence
gacttctccctggacctccg

SEQ ID NO: 9943 - DNA, 20 bp, Artificial
  CRISPR gRNA sequence
tccctggacctccgcagcac

SEQ ID NO: 9944 - DNA, 20 bp, Artificial
  CRISPR gRNA sequence
agcactggcatttgcccctc

SEQ ID NO: 9945 - DNA, 20 bp, Artificial
  CRISPR gRNA sequence
tggcatttgcccctctggat

SEQ ID NO: 9946 - DNA, 20 bp, Artificial
  CRISPR gRNA sequence
ggcatttgcccctctggatt

SEQ ID NO: 9947 - DNA, 20 bp, Artificial
  CRISPR gRNA sequence
gcatttgcccctctggattg

SEQ ID NO: 9948 - DNA, 20 bp, Artificial
  CRISPR gRNA sequence
atttgcccctctggattggg

SEQ ID NO: 9949 - DNA, 20 bp, Artificial
  CRISPR gRNA sequence
ctctggattggggagcctcg

SEQ ID NO: 9950 - DNA, 20 bp, Artificial
  CRISPR gRNA sequence
tctggattggggagcctcgt

SEQ ID NO: 9951 - DNA, 20 bp, Artificial
  CRISPR gRNA sequence
ttggggagcctcgtgggact

SEQ ID NO: 9952 - DNA, 20 bp, Artificial
  CRISPR gRNA sequence
ctcagctgtgtcacccgttt

SEQ ID NO: 9953 - DNA, 20 bp, Artificial
  CRISPR gRNA sequence
tcagctgtgtcacccgtttc

SEQ ID NO: 9954 - DNA, 20 bp, Artificial
  CRISPR gRNA sequence
gctgtgtcacccgtttcagg

SEQ ID NO: 9955 - DNA, 20 bp, Artificial
  CRISPR gRNA sequence
ctgtgtcacccgtttcaggt

SEQ ID NO: 9956 - DNA, 20 bp, Artificial
  CRISPR gRNA sequence
tgtgtcacccgtttcaggtg

SEQ ID NO: 9957 - DNA, 20 bp, Artificial
  CRISPR gRNA sequence
tcacccgtttcaggtggggt

SEQ ID NO: 9958 - DNA, 20 bp, Artificial
  CRISPR gRNA sequence
cacccgtttcaggtggggtg

SEQ ID NO: 9959 - DNA, 20 bp, Artificial
  CRISPR gRNA sequence
acccgtttcaggtggggtga

SEQ ID NO: 9960 - DNA, 20 bp, Artificial
  CRISPR gRNA sequence
cccgtttcaggtggggtgag

SEQ ID NO: 9961 - DNA, 20 bp, Artificial
  CRISPR gRNA sequence
ttcaggtggggtgaggggct

SEQ ID NO: 9962 - DNA, 20 bp, Artificial
  CRISPR gRNA sequence
tcaggtggggtgaggggctt

SEQ ID NO: 9963 - DNA, 20 bp, Artificial
  CRISPR gRNA sequence
caggtggggtgaggggcttg

SEQ ID NO: 9964 - DNA, 20 bp, Artificial
  CRISPR gRNA sequence
gtggggtgaggggcttgggg

SEQ ID NO: 9965 - DNA, 20 bp, Artificial
  CRISPR gRNA sequence
ggggtgaggggcttggggaa

SEQ ID NO: 9966 - DNA, 20 bp, Artificial
  CRISPR gRNA sequence
gggaagagacatccttgtgt

SEQ ID NO: 9967 - DNA, 20 bp, Artificial
  CRISPR gRNA sequence
ggaagagacatccttgtgtt

SEQ ID NO: 9968 - DNA, 20 bp, Artificial
  CRISPR gRNA sequence
cttgtgttgggcattaactg

SEQ ID NO: 9969 - DNA, 20 bp, Artificial
  CRISPR gRNA sequence
ttgggcattaactgcggtct

SEQ ID NO: 9970 - DNA, 20 bp, Artificial
  CRISPR gRNA sequence
ttaactgcggtcttggtgcc

SEQ ID NO: 9971 - DNA, 20 bp, Artificial
  CRISPR gRNA sequence
tgcggtcttggtgccaagcc

SEQ ID NO: 9972 - DNA, 20 bp, Artificial
  CRISPR gRNA sequence
gtgccaagcccagtgctctg

SEQ ID NO: 9973 - DNA, 20 bp, Artificial
  CRISPR gRNA sequence
tgccaagcccagtgctctgt

SEQ ID NO: 9974 - DNA, 20 bp, Artificial
  CRISPR gRNA sequence
gccaagcccagtgctctgtg

SEQ ID NO: 9975 - DNA, 20 bp, Artificial
  CRISPR gRNA sequence
gtgctctgtggggtctcttt

SEQ ID NO: 9976 - DNA, 20 bp, Artificial
  CRISPR gRNA sequence
gtggggtctcttttagtatg

SEQ ID NO: 9977 - DNA, 20 bp, Artificial
  CRISPR gRNA sequence
ggggtctcttttagtatgca

SEQ ID NO: 9978 - DNA, 20 bp, Artificial
  CRISPR gRNA sequence
gtctcttttagtatgcagag

SEQ ID NO: 9979 - DNA, 20 bp, Artificial
  CRISPR gRNA sequence
cttttagtatgcagagcagc

SEQ ID NO: 9980 - DNA, 20 bp, Artificial
  CRISPR gRNA sequence
ttttagtatgcagagcagcc

SEQ ID NO: 9981 - DNA, 20 bp, Artificial
  CRISPR gRNA sequence
tagtatgcagagcagccggg

SEQ ID NO: 9982 - DNA, 20 bp, Artificial
  CRISPR gRNA sequence
agtatgcagagcagccgggt

SEQ ID NO: 9983 - DNA, 20 bp, Artificial
  CRISPR gRNA sequence
gtatgcagagcagccgggtg

SEQ ID NO: 9984 - DNA, 20 bp, Artificial
  CRISPR gRNA sequence
tgcagagcagccgggtgggg

SEQ ID NO: 9985 - DNA, 20 bp, Artificial
  CRISPR gRNA sequence
agcagccgggtggggcagaa

SEQ ID NO: 9986 - DNA, 20 bp, Artificial
  CRISPR gRNA sequence
aatggattctctccattttt

SEQ ID NO: 9987 - DNA, 20 bp, Artificial
  CRISPR gRNA sequence
attctctccatttttaagat

SEQ ID NO: 9988 - DNA, 20 bp, Artificial
  CRISPR gRNA sequence
ttctctccatttttaagatg

SEQ ID NO: 9989 - DNA, 20 bp, Artificial
  CRISPR gRNA sequence
atttttaagatgaggatgtt

SEQ ID NO: 9990 - DNA, 20 bp, Artificial
  CRISPR gRNA sequence
tttttaagatgaggatgttg

SEQ ID NO: 9991 - DNA, 20 bp, Artificial
  CRISPR gRNA sequence
aagatgaggatgttgaggct

SEQ ID NO: 9992 - DNA, 20 bp, Artificial
  CRISPR gRNA sequence
gatgaggatgttgaggctca

SEQ ID NO: 9993 - DNA, 20 bp, Artificial
  CRISPR gRNA sequence
tgaggatgttgaggctcaga

SEQ ID NO: 9994 - DNA, 20 bp, Artificial
  CRISPR gRNA sequence
gaggatgttgaggctcagag

SEQ ID NO: 9995 - DNA, 20 bp, Artificial
  CRISPR gRNA sequence
aggatgttgaggctcagaga

SEQ ID NO: 9996 - DNA, 20 bp, Artificial
  CRISPR gRNA sequence
ggatgttgaggctcagagag

SEQ ID NO: 9997 - DNA, 20 bp, Artificial
  CRISPR gRNA sequence
tgttgaggctcagagagggg

SEQ ID NO: 9998 - DNA, 20 bp, Artificial
  CRISPR gRNA sequence
aggggcagccacttgccaca

SEQ ID NO: 9999 - DNA, 20 bp, Artificial
  CRISPR gRNA sequence
gcagccacttgccacacagc

SEQ ID NO: 10000 - DNA, 20 bp, Artificial
  CRISPR gRNA sequence
ccacttgccacacagcaagt

SEQ ID NO: 10001 - DNA, 20 bp, Artificial
  CRISPR gRNA sequence
acttgccacacagcaagtga

SEQ ID NO: 10002 - DNA, 20 bp, Artificial
  CRISPR gRNA sequence
cttgccacacagcaagtgag

SEQ ID NO: 10003 - DNA, 20 bp, Artificial
  CRISPR gRNA sequence
acacagcaagtgagaggcaa

SEQ ID NO: 10004 - DNA, 20 bp, Artificial
  CRISPR gRNA sequence
gagaggcaatggcattctcc

SEQ ID NO: 10005 - DNA, 20 bp, Artificial
  CRISPR gRNA sequence
attctcccagtcaatatttg

SEQ ID NO: 10006 - DNA, 20 bp, Artificial
  CRISPR gRNA sequence
ttctcccagtcaatatttga

SEQ ID NO: 10007 - DNA, 20 bp, Artificial
  CRISPR gRNA sequence
tttgaaggcccgccatgtgc

SEQ ID NO: 10008 - DNA, 20 bp, Artificial
  CRISPR gRNA sequence
gcccgccatgtgccagtcac

SEQ ID NO: 10009 - DNA, 20 bp, Artificial
  CRISPR gRNA sequence
cccgccatgtgccagtcact

SEQ ID NO: 10010 - DNA, 20 bp, Artificial
  CRISPR gRNA sequence
ccgccatgtgccagtcactg

SEQ ID NO: 10011 - DNA, 20 bp, Artificial
  CRISPR gRNA sequence
gccagtcactggggtatgtc

SEQ ID NO: 10012 - DNA, 20 bp, Artificial
  CRISPR gRNA sequence
ctggggtatgtctagaatct

SEQ ID NO: 10013 - DNA, 20 bp, Artificial
  CRISPR gRNA sequence
tctagaatctgagactgacc

SEQ ID NO: 10014 - DNA, 20 bp, Artificial
  CRISPR gRNA sequence
ctagaatctgagactgacct

SEQ ID NO: 10015 - DNA, 20 bp, Artificial
  CRISPR gRNA sequence
ttttattctttccaccccct

SEQ ID NO: 10016 - DNA, 20 bp, Artificial
  CRISPR gRNA sequence
cgccaccgttttcttatgct

SEQ ID NO: 10017 - DNA, 20 bp, Artificial
  CRISPR gRNA sequence
ccaccgttttcttatgctaa

SEQ ID NO: 10018 - DNA, 20 bp, Artificial
  CRISPR gRNA sequence
gttttcttatgctaagagta

SEQ ID NO: 10019 - DNA, 20 bp, Artificial
  CRISPR gRNA sequence
ttatgctaagagtaaagcca

SEQ ID NO: 10020 - DNA, 20 bp, Artificial
  CRISPR gRNA sequence
gtaaagccatggcctcccct

SEQ ID NO: 10021 - DNA, 20 bp, Artificial
  CRISPR gRNA sequence
cttccactccattttgtatt

SEQ ID NO: 10022 - DNA, 20 bp, Artificial
  CRISPR gRNA sequence
tccattttgtattcagcaac

SEQ ID NO: 10023 - DNA, 20 bp, Artificial
  CRISPR gRNA sequence
agcaaccagaccaatcttct

SEQ ID NO: 10024 - DNA, 20 bp, Artificial
  CRISPR gRNA sequence
catccctgcttacaatcctt

SEQ ID NO: 10025 - DNA, 20 bp, Artificial
  CRISPR gRNA sequence
atccctgcttacaatccttc

SEQ ID NO: 10026 - DNA, 20 bp, Artificial
  CRISPR gRNA sequence
tccctgcttacaatccttca

SEQ ID NO: 10027 - DNA, 20 bp, Artificial
  CRISPR gRNA sequence
cagggacactccaccactgt

SEQ ID NO: 10028 - DNA, 20 bp, Artificial
  CRISPR gRNA sequence
agggacactccaccactgtc

SEQ ID NO: 10029 - DNA, 20 bp, Artificial
  CRISPR gRNA sequence
actccaccactgtcaggatg

SEQ ID NO: 10030 - DNA, 20 bp, Artificial
  CRISPR gRNA sequence
ctccaccactgtcaggatga

SEQ ID NO: 10031 - DNA, 20 bp, Artificial
  CRISPR gRNA sequence
gaaggctaaattccttaatt

SEQ ID NO: 10032 - DNA, 20 bp, Artificial
  CRISPR gRNA sequence
ttccttaatttggtttcatt

SEQ ID NO: 10033 - DNA, 20 bp, Artificial
  CRISPR gRNA sequence
ttaatttggtttcattaagt

SEQ ID NO: 10034 - DNA, 20 bp, Artificial
  CRISPR gRNA sequence
agtcggtctgcaatctgctt

SEQ ID NO: 10035 - DNA, 20 bp, Artificial
  CRISPR gRNA sequence
tgcaatctgcttgagcattt

SEQ ID NO: 10036 - DNA, 20 bp, Artificial
  CRISPR gRNA sequence
gagcatttcagcttaatcgc

SEQ ID NO: 10037 - DNA, 20 bp, Artificial
  CRISPR gRNA sequence
gcatttcagcttaatcgcca

SEQ ID NO: 10038 - DNA, 20 bp, Artificial
  CRISPR gRNA sequence
catttcagcttaatcgccag

SEQ ID NO: 10039 - DNA, 20 bp, Artificial
  CRISPR gRNA sequence
cccctaaacatactttaccc

SEQ ID NO: 10040 - DNA, 20 bp, Artificial
  CRISPR gRNA sequence
acatactttacccaagctgt

SEQ ID NO: 10041 - DNA, 20 bp, Artificial
  CRISPR gRNA sequence
catactttacccaagctgta

SEQ ID NO: 10042 - DNA, 20 bp, Artificial
  CRISPR gRNA sequence
acataattgtgccaataatt

SEQ ID NO: 10043 - DNA, 20 bp, Artificial
  CRISPR gRNA sequence
taattgtgccaataatttag

SEQ ID NO: 10044 - DNA, 20 bp, Artificial
  CRISPR gRNA sequence
tgtgccaataatttagcagt

SEQ ID NO: 10045 - DNA, 20 bp, Artificial
  CRISPR gRNA sequence
taatttagcagtgagcttcc

SEQ ID NO: 10046 - DNA, 20 bp, Artificial
  CRISPR gRNA sequence
tttagcagtgagcttcctgg

SEQ ID NO: 10047 - DNA, 20 bp, Artificial
  CRISPR gRNA sequence
agtgagcttcctggtagccg

SEQ ID NO: 10048 - DNA, 20 bp, Artificial
  CRISPR gRNA sequence
ttcctggtagccgaagcaaa

SEQ ID NO: 10049 - DNA, 20 bp, Artificial
  CRISPR gRNA sequence
tcctggtagccgaagcaaaa

SEQ ID NO: 10050 - DNA, 20 bp, Artificial
  CRISPR gRNA sequence
cctggtagccgaagcaaaaa

SEQ ID NO: 10051 - DNA, 20 bp, Artificial
  CRISPR gRNA sequence
gtagccgaagcaaaaaggga

SEQ ID NO: 10052 - DNA, 20 bp, Artificial
  CRISPR gRNA sequence
gggaaagaaaaccactgtgt

SEQ ID NO: 10053 - DNA, 20 bp, Artificial
  CRISPR gRNA sequence
aaaaccactgtgtgagttgt

SEQ ID NO: 10054 - DNA, 20 bp, Artificial
  CRISPR gRNA sequence
ccactgtgtgagttgtgaga

SEQ ID NO: 10055 - DNA, 20 bp, Artificial
  CRISPR gRNA sequence
ctgtgtgagttgtgagaaag

SEQ ID NO: 10056 - DNA, 20 bp, Artificial
  CRISPR gRNA sequence
tgtgtgagttgtgagaaagt

SEQ ID NO: 10057 - DNA, 20 bp, Artificial
  CRISPR gRNA sequence
tgagaaagtaggaatcaata

SEQ ID NO: 10058 - DNA, 20 bp, Artificial
  CRISPR gRNA sequence
gagaaagtaggaatcaataa

SEQ ID NO: 10059 - DNA, 20 bp, Artificial
  CRISPR gRNA sequence
aagtaggaatcaataaaggc

SEQ ID NO: 10060 - DNA, 20 bp, Artificial
  CRISPR gRNA sequence
gtaggaatcaataaaggctg

SEQ ID NO: 10061 - DNA, 20 bp, Artificial
  CRISPR gRNA sequence
ggaatcaataaaggctggag

SEQ ID NO: 10062 - DNA, 20 bp, Artificial
  CRISPR gRNA sequence
aataaaggctggagtggtca

SEQ ID NO: 10063 - DNA, 20 bp, Artificial
  CRISPR gRNA sequence
aaaggctggagtggtcatgg

SEQ ID NO: 10064 - DNA, 20 bp, Artificial
  CRISPR gRNA sequence
aaggctggagtggtcatgga

SEQ ID NO: 10065 - DNA, 20 bp, Artificial
  CRISPR gRNA sequence
agtggtcatggaaggctttc

SEQ ID NO: 10066 - DNA, 20 bp, Artificial
  CRISPR gRNA sequence
gtggtcatggaaggctttct

SEQ ID NO: 10067 - DNA, 20 bp, Artificial
  CRISPR gRNA sequence
tcatggaaggctttctggga

SEQ ID NO: 10068 - DNA, 20 bp, Artificial
  CRISPR gRNA sequence
catggaaggctttctgggaa

SEQ ID NO: 10069 - DNA, 20 bp, Artificial
  CRISPR gRNA sequence
ggaaggctttctgggaaagg

SEQ ID NO: 10070 - DNA, 20 bp, Artificial
  CRISPR gRNA sequence
aaggctttctgggaaaggta

SEQ ID NO: 10071 - DNA, 20 bp, Artificial
  CRISPR gRNA sequence
aggctttctgggaaaggtag

SEQ ID NO: 10072 - DNA, 20 bp, Artificial
  CRISPR gRNA sequence
ttctgggaaaggtagaggtt

SEQ ID NO: 10073 - DNA, 20 bp, Artificial
  CRISPR gRNA sequence
ggaaaggtagaggttgagct

SEQ ID NO: 10074 - DNA, 20 bp, Artificial
  CRISPR gRNA sequence
gaaaggtagaggttgagcta

SEQ ID NO: 10075 - DNA, 20 bp, Artificial
  CRISPR gRNA sequence
ggtagaggttgagctaagga

SEQ ID NO: 10076 - DNA, 20 bp, Artificial
  CRISPR gRNA sequence
gaggttgagctaaggaaaga

SEQ ID NO: 10077 - DNA, 20 bp, Artificial
  CRISPR gRNA sequence
aaggaaagaaagtattttaa

SEQ ID NO: 10078 - DNA, 20 bp, Artificial
  CRISPR gRNA sequence
aggaaagaaagtattttaat

SEQ ID NO: 10079 - DNA, 20 bp, Artificial
  CRISPR gRNA sequence
aaagaaagtattttaatagg

SEQ ID NO: 10080 - DNA, 20 bp, Artificial
  CRISPR gRNA sequence
aagaaagtattttaataggt

SEQ ID NO: 10081 - DNA, 20 bp, Artificial
  CRISPR gRNA sequence
gaaagtattttaataggtag

SEQ ID NO: 10082 - DNA, 20 bp, Artificial
  CRISPR gRNA sequence
aaagtattttaataggtagg

SEQ ID NO: 10083 - DNA, 20 bp, Artificial
  CRISPR gRNA sequence
ataggtaggaggacccttca

SEQ ID NO: 10084 - DNA, 20 bp, Artificial
  CRISPR gRNA sequence
aggtaggaggacccttcatg

SEQ ID NO: 10085 - DNA, 20 bp, Artificial
  CRISPR gRNA sequence
catggagctgcccttccatt

SEQ ID NO: 10086 - DNA, 20 bp, Artificial
  CRISPR gRNA sequence
atggagctgcccttccatta

SEQ ID NO: 10087 - DNA, 20 bp, Artificial
  CRISPR gRNA sequence
gctgcccttccattaaggtc

SEQ ID NO: 10088 - DNA, 20 bp, Artificial
  CRISPR gRNA sequence
ccttccattaaggtctagcc

SEQ ID NO: 10089 - DNA, 20 bp, Artificial
  CRISPR gRNA sequence
tctagcctggtcaccgtgcc

SEQ ID NO: 10090 - DNA, 20 bp, Artificial
  CRISPR gRNA sequence
ctagcctggtcaccgtgcct

SEQ ID NO: 10091 - DNA, 20 bp, Artificial
  CRISPR gRNA sequence
tggtcaccgtgcctgggtct

SEQ ID NO: 10092 - DNA, 20 bp, Artificial
  CRISPR gRNA sequence
ggtcaccgtgcctgggtctg

SEQ ID NO: 10093 - DNA, 20 bp, Artificial
  CRISPR gRNA sequence
ggtctgaggccctccctcca

SEQ ID NO: 10094 - DNA, 20 bp, Artificial
  CRISPR gRNA sequence
gtctgaggccctccctccac

SEQ ID NO: 10095 - DNA, 20 bp, Artificial
  CRISPR gRNA sequence
tctgaggccctccctccaca

SEQ ID NO: 10096 - DNA, 20 bp, Artificial
  CRISPR gRNA sequence
tccctccacagggctgcctt

SEQ ID NO: 10097 - DNA, 20 bp, Artificial
  CRISPR gRNA sequence
cagggctgccttgagcgaca

SEQ ID NO: 10098 - DNA, 20 bp, Artificial
  CRISPR gRNA sequence
ggctgccttgagcgacacgg

SEQ ID NO: 10099 - DNA, 20 bp, Artificial
  CRISPR gRNA sequence
tgagcgacacggtggcgctg

SEQ ID NO: 10100 - DNA, 20 bp, Artificial
  CRISPR gRNA sequence
gagcgacacggtggcgctgt

SEQ ID NO: 10101 - DNA, 20 bp, Artificial
  CRISPR gRNA sequence
gcgacacggtggcgctgtgg

SEQ ID NO: 10102 - DNA, 20 bp, Artificial
  CRISPR gRNA sequence
tggcgctgtgggagtccctg

SEQ ID NO: 10103 - DNA, 20 bp, Artificial
  CRISPR gRNA sequence
cgctgtgggagtccctgcag

SEQ ID NO: 10104 - DNA, 20 bp, Artificial
  CRISPR gRNA sequence
tgggagtccctgcagcagca

SEQ ID NO: 10105 - DNA, 20 bp, Artificial
  CRISPR gRNA sequence
gggagtccctgcagcagcat

SEQ ID NO: 10106 - DNA, 20 bp, Artificial
  CRISPR gRNA sequence
ggagtccctgcagcagcatg

SEQ ID NO: 10107 - DNA, 20 bp, Artificial
  CRISPR gRNA sequence
agtccctgcagcagcatggg

SEQ ID NO: 10108 - DNA, 20 bp, Artificial
  CRISPR gRNA sequence
tgcagcagcatggggagacc

SEQ ID NO: 10109 - DNA, 20 bp, Artificial
  CRISPR gRNA sequence
atggggagaccaagctactt

SEQ ID NO: 10110 - DNA, 20 bp, Artificial
  CRISPR gRNA sequence
tggggagaccaagctacttc

SEQ ID NO: 10111 - DNA, 20 bp, Artificial
  CRISPR gRNA sequence
ggagaccaagctacttcagg

SEQ ID NO: 10112 - DNA, 20 bp, Artificial
  CRISPR gRNA sequence
gaccaagctacttcaggcag

SEQ ID NO: 10113 - DNA, 20 bp, Artificial
  CRISPR gRNA sequence
ccaagctacttcaggcagca

SEQ ID NO: 10114 - DNA, 20 bp, Artificial
  CRISPR gRNA sequence
caagctacttcaggcagcag

SEQ ID NO: 10115 - DNA, 20 bp, Artificial
  CRISPR gRNA sequence
agctacttcaggcagcagag

SEQ ID NO: 10116 - DNA, 20 bp, Artificial
  CRISPR gRNA sequence
tacttcaggcagcagaggag

SEQ ID NO: 10117 - DNA, 20 bp, Artificial
  CRISPR gRNA sequence
cagaggagaagttcaccatc

SEQ ID NO: 10118 - DNA, 20 bp, Artificial
  CRISPR gRNA sequence
gttcaccatcgagcctttca

SEQ ID NO: 10119 - DNA, 20 bp, Artificial
  CRISPR gRNA sequence
ccatcgagcctttcaaagcc

SEQ ID NO: 10120 - DNA, 20 bp, Artificial
  CRISPR gRNA sequence
ctttcaaagccaagtccctg

SEQ ID NO: 10121 - DNA, 20 bp, Artificial
  CRISPR gRNA sequence
tttcaaagccaagtccctga

SEQ ID NO: 10122 - DNA, 20 bp, Artificial
  CRISPR gRNA sequence
agccaagtccctgaaggatg

SEQ ID NO: 10123 - DNA, 20 bp, Artificial
  CRISPR gRNA sequence
caagtccctgaaggatgtgg

SEQ ID NO: 10124 - DNA, 20 bp, Artificial
  CRISPR gRNA sequence
cctgaaggatgtggaagacc

SEQ ID NO: 10125 - DNA, 20 bp, Artificial
  CRISPR gRNA sequence
ctgaaggatgtggaagacct

SEQ ID NO: 10126 - DNA, 20 bp, Artificial
  CRISPR gRNA sequence
aggatgtggaagacctggga

SEQ ID NO: 10127 - DNA, 20 bp, Artificial
  CRISPR gRNA sequence
aagacctgggaaagcttgtg

SEQ ID NO: 10128 - DNA, 20 bp, Artificial
  CRISPR gRNA sequence
tgggaaagcttgtgcagact

SEQ ID NO: 10129 - DNA, 20 bp, Artificial
  CRISPR gRNA sequence
ggaaagcttgtgcagactca

SEQ ID NO: 10130 - DNA, 20 bp, Artificial
  CRISPR gRNA sequence
gaaagcttgtgcagactcag

SEQ ID NO: 10131 - DNA, 20 bp, Artificial
  CRISPR gRNA sequence
gcttgtgcagactcagaggt

SEQ ID NO: 10132 - DNA, 20 bp, Artificial
  CRISPR gRNA sequence
ttgtgcagactcagaggtga

SEQ ID NO: 10133 - DNA, 20 bp, Artificial
  CRISPR gRNA sequence
tgtgcagactcagaggtgag

SEQ ID NO: 10134 - DNA, 20 bp, Artificial
  CRISPR gRNA sequence
tgcagactcagaggtgagag

SEQ ID NO: 10135 - DNA, 20 bp, Artificial
  CRISPR gRNA sequence
cagactcagaggtgagagga

SEQ ID NO: 10136 - DNA, 20 bp, Artificial
  CRISPR gRNA sequence
agactcagaggtgagaggag

SEQ ID NO: 10137 - DNA, 20 bp, Artificial
  CRISPR gRNA sequence
ctcagaggtgagaggagagg

SEQ ID NO: 10138 - DNA, 20 bp, Artificial
  CRISPR gRNA sequence
gaggtgagaggagaggcgga

SEQ ID NO: 10139 - DNA, 20 bp, Artificial
  CRISPR gRNA sequence
aggtgagaggagaggcggat

SEQ ID NO: 10140 - DNA, 20 bp, Artificial
  CRISPR gRNA sequence
gtgagaggagaggcggatgg

SEQ ID NO: 10141 - DNA, 20 bp, Artificial
  CRISPR gRNA sequence
tgagaggagaggcggatggg

SEQ ID NO: 10142 - DNA, 20 bp, Artificial
  CRISPR gRNA sequence
gaggagaggcggatgggagg

SEQ ID NO: 10143 - DNA, 20 bp, Artificial
  CRISPR gRNA sequence
gggaggtggttcacgccatg

SEQ ID NO: 10144 - DNA, 20 bp, Artificial
  CRISPR gRNA sequence
ggaggtggttcacgccatgc

SEQ ID NO: 10145 - DNA, 20 bp, Artificial
  CRISPR gRNA sequence
tggttcacgccatgcaggtt

SEQ ID NO: 10146 - DNA, 20 bp, Artificial
  CRISPR gRNA sequence
ggttcacgccatgcaggttg

SEQ ID NO: 10147 - DNA, 20 bp, Artificial
  CRISPR gRNA sequence
ccatgcaggttgaggacatg

SEQ ID NO: 10148 - DNA, 20 bp, Artificial
  CRISPR gRNA sequence
catgcaggttgaggacatgt

SEQ ID NO: 10149 - DNA, 20 bp, Artificial
  CRISPR gRNA sequence
gacatgtaggacccattctc

SEQ ID NO: 10150 - DNA, 20 bp, Artificial
  CRISPR gRNA sequence
acccattctcaagtttgtca

SEQ ID NO: 10151 - DNA, 20 bp, Artificial
  CRISPR gRNA sequence
cccattctcaagtttgtcat

SEQ ID NO: 10152 - DNA, 20 bp, Artificial
  CRISPR gRNA sequence
aagtttgtcatgggcatttc

SEQ ID NO: 10153 - DNA, 20 bp, Artificial
  CRISPR gRNA sequence
ttccagtgccccctgtcctc

SEQ ID NO: 10154 - DNA, 20 bp, Artificial
  CRISPR gRNA sequence
tccagtgccccctgtcctct

SEQ ID NO: 10155 - DNA, 20 bp, Artificial
  CRISPR gRNA sequence
gacaccccatgccctctttc

SEQ ID NO: 10156 - DNA, 20 bp, Artificial
  CRISPR gRNA sequence
acaccccatgccctctttct

SEQ ID NO: 10157 - DNA, 20 bp, Artificial
  CRISPR gRNA sequence
catgccctctttctgggcaa

SEQ ID NO: 10158 - DNA, 20 bp, Artificial
  CRISPR gRNA sequence
ctttctgggcaatggctaac

SEQ ID NO: 10159 - DNA, 20 bp, Artificial
  CRISPR gRNA sequence
ttctgggcaatggctaacca

SEQ ID NO: 10160 - DNA, 20 bp, Artificial
  CRISPR gRNA sequence
ctctcactgcactcgctgcc

SEQ ID NO: 10161 - DNA, 20 bp, Artificial
  CRISPR gRNA sequence
tctcactgcactcgctgccc

SEQ ID NO: 10162 - DNA, 20 bp, Artificial
  CRISPR gRNA sequence
cactgcactcgctgcccagg

SEQ ID NO: 10163 - DNA, 20 bp, Artificial
  CRISPR gRNA sequence
ctgcactcgctgcccaggcg

SEQ ID NO: 10164 - DNA, 20 bp, Artificial
  CRISPR gRNA sequence
cgctgcccaggcggagcctc

SEQ ID NO: 10165 - DNA, 20 bp, Artificial
  CRISPR gRNA sequence
aaacctgccatcatgtgccc

SEQ ID NO: 10166 - DNA, 20 bp, Artificial
  CRISPR gRNA sequence
gccatcatgtgcccaagtct

SEQ ID NO: 10167 - DNA, 20 bp, Artificial
  CRISPR gRNA sequence
atgtgcccaagtcttagcta

SEQ ID NO: 10168 - DNA, 20 bp, Artificial
  CRISPR gRNA sequence
ccaagtcttagctaaagcca

SEQ ID NO: 10169 - DNA, 20 bp, Artificial
  CRISPR gRNA sequence
aagtcttagctaaagccatg

SEQ ID NO: 10170 - DNA, 20 bp, Artificial
  CRISPR gRNA sequence
atggagaacctctccccttc

SEQ ID NO: 10171 - DNA, 20 bp, Artificial
  CRISPR gRNA sequence
tggagaacctctccccttct

SEQ ID NO: 10172 - DNA, 20 bp, Artificial
  CRISPR gRNA sequence
gagaacctctccccttctag

SEQ ID NO: 10173 - DNA, 20 bp, Artificial
  CRISPR gRNA sequence
ctccccttctaggagttaac

SEQ ID NO: 10174 - DNA, 20 bp, Artificial
  CRISPR gRNA sequence
tccccttctaggagttaaca

SEQ ID NO: 10175 - DNA, 20 bp, Artificial
  CRISPR gRNA sequence
acaaggatgccttgtgcacc

SEQ ID NO: 10176 - DNA, 20 bp, Artificial
  CRISPR gRNA sequence
atgccttgtgcacctagtaa

SEQ ID NO: 10177 - DNA, 20 bp, Artificial
  CRISPR gRNA sequence
ccttgtgcacctagtaacag

SEQ ID NO: 10178 - DNA, 20 bp, Artificial
  CRISPR gRNA sequence
gacacctactgccacccttt

SEQ ID NO: 10179 - DNA, 20 bp, Artificial
  CRISPR gRNA sequence
acacctactgccaccctttg

SEQ ID NO: 10180 - DNA, 20 bp, Artificial
  CRISPR gRNA sequence
ctgccaccctttgaggcatt

SEQ ID NO: 10181 - DNA, 20 bp, Artificial
  CRISPR gRNA sequence
tgccaccctttgaggcattt

SEQ ID NO: 10182 - DNA, 20 bp, Artificial
  CRISPR gRNA sequence
caactgttgtcccaaattta

SEQ ID NO: 10183 - DNA, 20 bp, Artificial
  CRISPR gRNA sequence
tgttgtcccaaatttataga

SEQ ID NO: 10184 - DNA, 20 bp, Artificial
  CRISPR gRNA sequence
tgtcccaaatttatagacgg

SEQ ID NO: 10185 - DNA, 20 bp, Artificial
  CRISPR gRNA sequence
tcccaaatttatagacggca

SEQ ID NO: 10186 - DNA, 20 bp, Artificial
  CRISPR gRNA sequence
aatttatagacggcagagct

SEQ ID NO: 10187 - DNA, 20 bp, Artificial
  CRISPR gRNA sequence
atttatagacggcagagcta

SEQ ID NO: 10188 - DNA, 20 bp, Artificial
  CRISPR gRNA sequence
tagacggcagagctaaggtc

SEQ ID NO: 10189 - DNA, 20 bp, Artificial
  CRISPR gRNA sequence
acggcagagctaaggtccag

SEQ ID NO: 10190 - DNA, 20 bp, Artificial
  CRISPR gRNA sequence
cggcagagctaaggtccaga

SEQ ID NO: 10191 - DNA, 20 bp, Artificial
  CRISPR gRNA sequence
cagagctaaggtccagaagg

SEQ ID NO: 10192 - DNA, 20 bp, Artificial
  CRISPR gRNA sequence
aggcagacaaaacttgatta

SEQ ID NO: 10193 - DNA, 20 bp, Artificial
  CRISPR gRNA sequence
acaaaacttgattacagaac

SEQ ID NO: 10194 - DNA, 20 bp, Artificial
  CRISPR gRNA sequence
tccttcatcacacattgttt

SEQ ID NO: 10195 - DNA, 20 bp, Artificial
  CRISPR gRNA sequence
acattgtttgagcgcctctt

SEQ ID NO: 10196 - DNA, 20 bp, Artificial
  CRISPR gRNA sequence
agcgcctcttaagtgctgtc

SEQ ID NO: 10197 - DNA, 20 bp, Artificial
  CRISPR gRNA sequence
gcgcctcttaagtgctgtct

SEQ ID NO: 10198 - DNA, 20 bp, Artificial
  CRISPR gRNA sequence
ctcttaagtgctgtctggga

SEQ ID NO: 10199 - DNA, 20 bp, Artificial
  CRISPR gRNA sequence
tcttaagtgctgtctgggat

SEQ ID NO: 10200 - DNA, 20 bp, Artificial
  CRISPR gRNA sequence
gtgctgtctgggataggtac

SEQ ID NO: 10201 - DNA, 20 bp, Artificial
  CRISPR gRNA sequence
tgtctgggataggtactggt

SEQ ID NO: 10202 - DNA, 20 bp, Artificial
  CRISPR gRNA sequence
tactggtaagtgcctaatct

SEQ ID NO: 10203 - DNA, 20 bp, Artificial
  CRISPR gRNA sequence
actggtaagtgcctaatctg

SEQ ID NO: 10204 - DNA, 20 bp, Artificial
  CRISPR gRNA sequence
tctgaggctcatttccatga

SEQ ID NO: 10205 - DNA, 20 bp, Artificial
  CRISPR gRNA sequence
gctcatttccatgaaagata

SEQ ID NO: 10206 - DNA, 20 bp, Artificial
  CRISPR gRNA sequence
tccatgaaagatacagtcct

SEQ ID NO: 10207 - DNA, 20 bp, Artificial
  CRISPR gRNA sequence
tttatttttattatttctta

SEQ ID NO: 10208 - DNA, 20 bp, Artificial
  CRISPR gRNA sequence
tttttattatttcttaaaga

SEQ ID NO: 10209 - DNA, 20 bp, Artificial
  CRISPR gRNA sequence
ttttattatttcttaaagac

SEQ ID NO: 10210 - DNA, 20 bp, Artificial
  CRISPR gRNA sequence
tttattatttcttaaagaca

SEQ ID NO: 10211 - DNA, 20 bp, Artificial
  CRISPR gRNA sequence
cagggtctcgctgtgtctac

SEQ ID NO: 10212 - DNA, 20 bp, Artificial
  CRISPR gRNA sequence
agggtctcgctgtgtctacc

SEQ ID NO: 10213 - DNA, 20 bp, Artificial
  CRISPR gRNA sequence
tctcgctgtgtctaccaggc

SEQ ID NO: 10214 - DNA, 20 bp, Artificial
  CRISPR gRNA sequence
gtgtctaccaggctagaata

SEQ ID NO: 10215 - DNA, 20 bp, Artificial
  CRISPR gRNA sequence
tctaccaggctagaatacag

SEQ ID NO: 10216 - DNA, 20 bp, Artificial
  CRISPR gRNA sequence
agaatacagtagtgcgatca

SEQ ID NO: 10217 - DNA, 20 bp, Artificial
  CRISPR gRNA sequence
agtgcgatcatagcttactg

SEQ ID NO: 10218 - DNA, 20 bp, Artificial
  CRISPR gRNA sequence
atcatagcttactgtagctt

SEQ ID NO: 10219 - DNA, 20 bp, Artificial
  CRISPR gRNA sequence
actgtagcttcggaactcct

SEQ ID NO: 10220 - DNA, 20 bp, Artificial
  CRISPR gRNA sequence
gcttcggaactcctgagctc

SEQ ID NO: 10221 - DNA, 20 bp, Artificial
  CRISPR gRNA sequence
ctcaagcgatcctcctgcct

SEQ ID NO: 10222 - DNA, 20 bp, Artificial
  CRISPR gRNA sequence
tcctcctgcctcagcctccc

SEQ ID NO: 10223 - DNA, 20 bp, Artificial
  CRISPR gRNA sequence
tcctgcctcagcctcccaag

SEQ ID NO: 10224 - DNA, 20 bp, Artificial
  CRISPR gRNA sequence
gcctcagcctcccaagtagc

SEQ ID NO: 10225 - DNA, 20 bp, Artificial
  CRISPR gRNA sequence
cctcagcctcccaagtagct

SEQ ID NO: 10226 - DNA, 20 bp, Artificial
  CRISPR gRNA sequence
ctcccaagtagctgggatta

SEQ ID NO: 10227 - DNA, 20 bp, Artificial
  CRISPR gRNA sequence
tcccaagtagctgggattat

SEQ ID NO: 10228 - DNA, 20 bp, Artificial
  CRISPR gRNA sequence
ataggtgcacgtcatcacac

SEQ ID NO: 10229 - DNA, 20 bp, Artificial
  CRISPR gRNA sequence
atcacaccggatgatttttt

SEQ ID NO: 10230 - DNA, 20 bp, Artificial
  CRISPR gRNA sequence
gatgattttttaagtttttg

SEQ ID NO: 10231 - DNA, 20 bp, Artificial
  CRISPR gRNA sequence
tttttaagtttttgtagaca

SEQ ID NO: 10232 - DNA, 20 bp, Artificial
  CRISPR gRNA sequence
ttttaagtttttgtagacac

SEQ ID NO: 10233 - DNA, 20 bp, Artificial
  CRISPR gRNA sequence
tttaagtttttgtagacaca

SEQ ID NO: 10234 - DNA, 20 bp, Artificial
  CRISPR gRNA sequence
agggatcttgctatgttgcc

SEQ ID NO: 10235 - DNA, 20 bp, Artificial
  CRISPR gRNA sequence
gggatcttgctatgttgccc

SEQ ID NO: 10236 - DNA, 20 bp, Artificial
  CRISPR gRNA sequence
tcttgctatgttgcccaggc

SEQ ID NO: 10237 - DNA, 20 bp, Artificial
  CRISPR gRNA sequence
ccaggctggtcttgaactcc

SEQ ID NO: 10238 - DNA, 20 bp, Artificial
  CRISPR gRNA sequence
ggtcttgaactcctggcctc

SEQ ID NO: 10239 - DNA, 20 bp, Artificial
  CRISPR gRNA sequence
ctcaagcaatcctcctgcct

SEQ ID NO: 10240 - DNA, 20 bp, Artificial
  CRISPR gRNA sequence
cctcctgcctcagcctccca

SEQ ID NO: 10241 - DNA, 20 bp, Artificial
  CRISPR gRNA sequence
gcctcagcctcccaaagtgc

SEQ ID NO: 10242 - DNA, 20 bp, Artificial
  CRISPR gRNA sequence
cctcagcctcccaaagtgct

SEQ ID NO: 10243 - DNA, 20 bp, Artificial
  CRISPR gRNA sequence
ctcccaaagtgctgggacta

SEQ ID NO: 10244 - DNA, 20 bp, Artificial
  CRISPR gRNA sequence
agtgctgggactacagtcac

SEQ ID NO: 10245 - DNA, 20 bp, Artificial
  CRISPR gRNA sequence
gtgctgggactacagtcacg

SEQ ID NO: 10246 - DNA, 20 bp, Artificial
  CRISPR gRNA sequence
cagtcacgaggcaccgcacc

SEQ ID NO: 10247 - DNA, 20 bp, Artificial
  CRISPR gRNA sequence
cacgaggcaccgcacccaga

SEQ ID NO: 10248 - DNA, 20 bp, Artificial
  CRISPR gRNA sequence
ccagacagatcttttttttt

SEQ ID NO: 10249 - DNA, 20 bp, Artificial
  CRISPR gRNA sequence
agacagatctttttttttaa

SEQ ID NO: 10250 - DNA, 20 bp, Artificial
  CRISPR gRNA sequence
gacagatctttttttttaag

SEQ ID NO: 10251 - DNA, 20 bp, Artificial
  CRISPR gRNA sequence
acagatctttttttttaaga

SEQ ID NO: 10252 - DNA, 20 bp, Artificial
  CRISPR gRNA sequence
cagatctttttttttaagag

SEQ ID NO: 10253 - DNA, 20 bp, Artificial
  CRISPR gRNA sequence
agatctttttttttaagagg

SEQ ID NO: 10254 - DNA, 20 bp, Artificial
  CRISPR gRNA sequence
tttttttaagagggggacaa

SEQ ID NO: 10255 - DNA, 20 bp, Artificial
  CRISPR gRNA sequence
agggggacaacagttgcccc

SEQ ID NO: 10256 - DNA, 20 bp, Artificial
  CRISPR gRNA sequence
gggggacaacagttgcccca

SEQ ID NO: 10257 - DNA, 20 bp, Artificial
  CRISPR gRNA sequence
gacaacagttgccccaagga

SEQ ID NO: 10258 - DNA, 20 bp, Artificial
  CRISPR gRNA sequence
cccaaggaaagcaatccccc

SEQ ID NO: 10259 - DNA, 20 bp, Artificial
  CRISPR gRNA sequence
ccaaggaaagcaatccccct

SEQ ID NO: 10260 - DNA, 20 bp, Artificial
  CRISPR gRNA sequence
caaggaaagcaatccccctg

SEQ ID NO: 10261 - DNA, 20 bp, Artificial
  CRISPR gRNA sequence
agcaatccccctggggaatt

SEQ ID NO: 10262 - DNA, 20 bp, Artificial
  CRISPR gRNA sequence
gcaatccccctggggaattt

SEQ ID NO: 10263 - DNA, 20 bp, Artificial
  CRISPR gRNA sequence
caatccccctggggaatttg

SEQ ID NO: 10264 - DNA, 20 bp, Artificial
  CRISPR gRNA sequence
ccctggggaatttggggcac

SEQ ID NO: 10265 - DNA, 20 bp, Artificial
  CRISPR gRNA sequence
cctggggaatttggggcact

SEQ ID NO: 10266 - DNA, 20 bp, Artificial
  CRISPR gRNA sequence
ctggggaatttggggcactg

SEQ ID NO: 10267 - DNA, 20 bp, Artificial
  CRISPR gRNA sequence
gggaatttggggcactgggg

SEQ ID NO: 10268 - DNA, 20 bp, Artificial
  CRISPR gRNA sequence
gggcactggggcagccatca

SEQ ID NO: 10269 - DNA, 20 bp, Artificial
  CRISPR gRNA sequence
ggcactggggcagccatcat

SEQ ID NO: 10270 - DNA, 20 bp, Artificial
  CRISPR gRNA sequence
ggcagccatcatgggaccca

SEQ ID NO: 10271 - DNA, 20 bp, Artificial
  CRISPR gRNA sequence
gcagccatcatgggacccat

SEQ ID NO: 10272 - DNA, 20 bp, Artificial
  CRISPR gRNA sequence
ccatcatgggacccatgggt

SEQ ID NO: 10273 - DNA, 20 bp, Artificial
  CRISPR gRNA sequence
catcatgggacccatgggta

SEQ ID NO: 10274 - DNA, 20 bp, Artificial
  CRISPR gRNA sequence
atcatgggacccatgggtaa

SEQ ID NO: 10275 - DNA, 20 bp, Artificial
  CRISPR gRNA sequence
gggacccatgggtaagggct

SEQ ID NO: 10276 - DNA, 20 bp, Artificial
  CRISPR gRNA sequence
catgggtaagggctcagtga

SEQ ID NO: 10277 - DNA, 20 bp, Artificial
  CRISPR gRNA sequence
gggtaagggctcagtgacag

SEQ ID NO: 10278 - DNA, 20 bp, Artificial
  CRISPR gRNA sequence
ctaacattgcctgttctctc

SEQ ID NO: 10279 - DNA, 20 bp, Artificial
  CRISPR gRNA sequence
taacattgcctgttctctcc

SEQ ID NO: 10280 - DNA, 20 bp, Artificial
  CRISPR gRNA sequence
ttgcctgttctctccaggac

SEQ ID NO: 10281 - DNA, 20 bp, Artificial
  CRISPR gRNA sequence
cctgttctctccaggacgag

SEQ ID NO: 10282 - DNA, 20 bp, Artificial
  CRISPR gRNA sequence
ctccaggacgagaagttcct

SEQ ID NO: 10283 - DNA, 20 bp, Artificial
  CRISPR gRNA sequence
caggacgagaagttcctcgg

SEQ ID NO: 10284 - DNA, 20 bp, Artificial
  CRISPR gRNA sequence
gagaagttcctcggaagaca

SEQ ID NO: 10285 - DNA, 20 bp, Artificial
  CRISPR gRNA sequence
agttcctcggaagacacagc

SEQ ID NO: 10286 - DNA, 20 bp, Artificial
  CRISPR gRNA sequence
gttcctcggaagacacagct

SEQ ID NO: 10287 - DNA, 20 bp, Artificial
  CRISPR gRNA sequence
ttcctcggaagacacagctg

SEQ ID NO: 10288 - DNA, 20 bp, Artificial
  CRISPR gRNA sequence
cctcggaagacacagctggg

SEQ ID NO: 10289 - DNA, 20 bp, Artificial
  CRISPR gRNA sequence
ctggggagctccctgctgtt

SEQ ID NO: 10290 - DNA, 20 bp, Artificial
  CRISPR gRNA sequence
tggggagctccctgctgttc

SEQ ID NO: 10291 - DNA, 20 bp, Artificial
  CRISPR gRNA sequence
tccctgctgttcgggaccta

SEQ ID NO: 10292 - DNA, 20 bp, Artificial
  CRISPR gRNA sequence
tgttcgggacctaaagaaac

SEQ ID NO: 10293 - DNA, 20 bp, Artificial
  CRISPR gRNA sequence
ttcgggacctaaagaaactg

SEQ ID NO: 10294 - DNA, 20 bp, Artificial
  CRISPR gRNA sequence
aaagaaactggagtttgcgt

SEQ ID NO: 10295 - DNA, 20 bp, Artificial
  CRISPR gRNA sequence
aactggagtttgcgtaagca

SEQ ID NO: 10296 - DNA, 20 bp, Artificial
  CRISPR gRNA sequence
actggagtttgcgtaagcaa

SEQ ID NO: 10297 - DNA, 20 bp, Artificial
  CRISPR gRNA sequence
ctggagtttgcgtaagcaaa

SEQ ID NO: 10298 - DNA, 20 bp, Artificial
  CRISPR gRNA sequence
tggagtttgcgtaagcaaag

SEQ ID NO: 10299 - DNA, 20 bp, Artificial
  CRISPR gRNA sequence
agtttgcgtaagcaaagggg

SEQ ID NO: 10300 - DNA, 20 bp, Artificial
  CRISPR gRNA sequence
caaaggggtggattgtcttg

SEQ ID NO: 10301 - DNA, 20 bp, Artificial
  CRISPR gRNA sequence
aaaggggtggattgtcttgt

SEQ ID NO: 10302 - DNA, 20 bp, Artificial
  CRISPR gRNA sequence
attgtcttgtgggtctgcgc

SEQ ID NO: 10303 - DNA, 20 bp, Artificial
  CRISPR gRNA sequence
ttgtcttgtgggtctgcgca

SEQ ID NO: 10304 - DNA, 20 bp, Artificial
  CRISPR gRNA sequence
tctgcgcaaggtttcccctg

SEQ ID NO: 10305 - DNA, 20 bp, Artificial
  CRISPR gRNA sequence
caaggtttcccctgcagcat

SEQ ID NO: 10306 - DNA, 20 bp, Artificial
  CRISPR gRNA sequence
gtttcccctgcagcattagc

SEQ ID NO: 10307 - DNA, 20 bp, Artificial
  CRISPR gRNA sequence
tttcccctgcagcattagct

SEQ ID NO: 10308 - DNA, 20 bp, Artificial
  CRISPR gRNA sequence
ctgggcttgtaccacctgaa

SEQ ID NO: 10309 - DNA, 20 bp, Artificial
  CRISPR gRNA sequence
gggcttgtaccacctgaatg

SEQ ID NO: 10310 - DNA, 20 bp, Artificial
  CRISPR gRNA sequence
ttgtaccacctgaatggaga

SEQ ID NO: 10311 - DNA, 20 bp, Artificial
  CRISPR gRNA sequence
cctgaatggagatagatctc

SEQ ID NO: 10312 - DNA, 20 bp, Artificial
  CRISPR gRNA sequence
taccctcttgcccaccactt

SEQ ID NO: 10313 - DNA, 20 bp, Artificial
  CRISPR gRNA sequence
cttgcccaccactttggaaa

SEQ ID NO: 10314 - DNA, 20 bp, Artificial
  CRISPR gRNA sequence
accactttggaaatagcttc

SEQ ID NO: 10315 - DNA, 20 bp, Artificial
  CRISPR gRNA sequence
actttggaaatagcttccag

SEQ ID NO: 10316 - DNA, 20 bp, Artificial
  CRISPR gRNA sequence
tggaaatagcttccagcagc

SEQ ID NO: 10317 - DNA, 20 bp, Artificial
  CRISPR gRNA sequence
aatagcttccagcagctgga

SEQ ID NO: 10318 - DNA, 20 bp, Artificial
  CRISPR gRNA sequence
tccagcagctggaaagtgac

SEQ ID NO: 10319 - DNA, 20 bp, Artificial
  CRISPR gRNA sequence
cagctggaaagtgaccagtg

SEQ ID NO: 10320 - DNA, 20 bp, Artificial
  CRISPR gRNA sequence
agctggaaagtgaccagtgt

SEQ ID NO: 10321 - DNA, 20 bp, Artificial
  CRISPR gRNA sequence
tgaccagtgtgggcaaatgc

SEQ ID NO: 10322 - DNA, 20 bp, Artificial
  CRISPR gRNA sequence
accagtgtgggcaaatgctg

SEQ ID NO: 10323 - DNA, 20 bp, Artificial
  CRISPR gRNA sequence
ccagtgtgggcaaatgctgg

SEQ ID NO: 10324 - DNA, 20 bp, Artificial
  CRISPR gRNA sequence
gggcaaatgctggaggttct

SEQ ID NO: 10325 - DNA, 20 bp, Artificial
  CRISPR gRNA sequence
gctggaggttctcagatttg

SEQ ID NO: 10326 - DNA, 20 bp, Artificial
  CRISPR gRNA sequence
gttctcagatttgaagctaa

SEQ ID NO: 10327 - DNA, 20 bp, Artificial
  CRISPR gRNA sequence
aagctaatggacccgtttgc

SEQ ID NO: 10328 - DNA, 20 bp, Artificial
  CRISPR gRNA sequence
gacccgtttgctggttaaca

SEQ ID NO: 10329 - DNA, 20 bp, Artificial
  CRISPR gRNA sequence
cattcccatcactcattcaa

SEQ ID NO: 10330 - DNA, 20 bp, Artificial
  CRISPR gRNA sequence
ttcccatcactcattcaaca

SEQ ID NO: 10331 - DNA, 20 bp, Artificial
  CRISPR gRNA sequence
tcccatcactcattcaacag

SEQ ID NO: 10332 - DNA, 20 bp, Artificial
  CRISPR gRNA sequence
actcattcaacagaggtatt

SEQ ID NO: 10333 - DNA, 20 bp, Artificial
  CRISPR gRNA sequence
tattgagcacttgaatgact

SEQ ID NO: 10334 - DNA, 20 bp, Artificial
  CRISPR gRNA sequence
attgagcacttgaatgactg

SEQ ID NO: 10335 - DNA, 20 bp, Artificial
  CRISPR gRNA sequence
actgaggctgctgtcctcat

SEQ ID NO: 10336 - DNA, 20 bp, Artificial
  CRISPR gRNA sequence
ctgctgtcctcatgagctga

SEQ ID NO: 10337 - DNA, 20 bp, Artificial
  CRISPR gRNA sequence
cagtctaatcaactcccctc

SEQ ID NO: 10338 - DNA, 20 bp, Artificial
  CRISPR gRNA sequence
gtctaatcaactcccctctg

SEQ ID NO: 10339 - DNA, 20 bp, Artificial
  CRISPR gRNA sequence
tctaatcaactcccctctgg

SEQ ID NO: 10340 - DNA, 20 bp, Artificial
  CRISPR gRNA sequence
taatcaactcccctctggag

SEQ ID NO: 10341 - DNA, 20 bp, Artificial
  CRISPR gRNA sequence
aatcaactcccctctggagg

SEQ ID NO: 10342 - DNA, 20 bp, Artificial
  CRISPR gRNA sequence
aactcccctctggaggaggt

SEQ ID NO: 10343 - DNA, 20 bp, Artificial
  CRISPR gRNA sequence
actcccctctggaggaggtc

SEQ ID NO: 10344 - DNA, 20 bp, Artificial
  CRISPR gRNA sequence
ctcccctctggaggaggtca

SEQ ID NO: 10345 - DNA, 20 bp, Artificial
  CRISPR gRNA sequence
tcccctctggaggaggtcag

SEQ ID NO: 10346 - DNA, 20 bp, Artificial
  CRISPR gRNA sequence
cccctctggaggaggtcagg

SEQ ID NO: 10347 - DNA, 20 bp, Artificial
  CRISPR gRNA sequence
aggaggtcagggggacttcc

SEQ ID NO: 10348 - DNA, 20 bp, Artificial
  CRISPR gRNA sequence
gaggtcagggggacttcctg

SEQ ID NO: 10349 - DNA, 20 bp, Artificial
  CRISPR gRNA sequence
aggtcagggggacttcctgg

SEQ ID NO: 10350 - DNA, 20 bp, Artificial
  CRISPR gRNA sequence
gtcagggggacttcctggag

SEQ ID NO: 10351 - DNA, 20 bp, Artificial
  CRISPR gRNA sequence
tcagggggacttcctggagg

SEQ ID NO: 10352 - DNA, 20 bp, Artificial
  CRISPR gRNA sequence
aggaggtgatatctgcactg

SEQ ID NO: 10353 - DNA, 20 bp, Artificial
  CRISPR gRNA sequence
tgatatctgcactgaagctt

SEQ ID NO: 10354 - DNA, 20 bp, Artificial
  CRISPR gRNA sequence
atctgcactgaagcttcagt

SEQ ID NO: 10355 - DNA, 20 bp, Artificial
  CRISPR gRNA sequence
tctgcactgaagcttcagtg

SEQ ID NO: 10356 - DNA, 20 bp, Artificial
  CRISPR gRNA sequence
actgaagcttcagtgaggat

SEQ ID NO: 10357 - DNA, 20 bp, Artificial
  CRISPR gRNA sequence
ctgaagcttcagtgaggata

SEQ ID NO: 10358 - DNA, 20 bp, Artificial
  CRISPR gRNA sequence
cttcagtgaggataaggaat

SEQ ID NO: 10359 - DNA, 20 bp, Artificial
  CRISPR gRNA sequence
gtgaggataaggaatgagct

SEQ ID NO: 10360 - DNA, 20 bp, Artificial
  CRISPR gRNA sequence
aggataaggaatgagctgag

SEQ ID NO: 10361 - DNA, 20 bp, Artificial
  CRISPR gRNA sequence
ggataaggaatgagctgagt

SEQ ID NO: 10362 - DNA, 20 bp, Artificial
  CRISPR gRNA sequence
gataaggaatgagctgagtg

SEQ ID NO: 10363 - DNA, 20 bp, Artificial
  CRISPR gRNA sequence
taaggaatgagctgagtggg

SEQ ID NO: 10364 - DNA, 20 bp, Artificial
  CRISPR gRNA sequence
aggaatgagctgagtgggga

SEQ ID NO: 10365 - DNA, 20 bp, Artificial
  CRISPR gRNA sequence
ggaatgagctgagtggggag

SEQ ID NO: 10366 - DNA, 20 bp, Artificial
  CRISPR gRNA sequence
gaatgagctgagtggggaga

SEQ ID NO: 10367 - DNA, 20 bp, Artificial
  CRISPR gRNA sequence
aatgagctgagtggggagag

SEQ ID NO: 10368 - DNA, 20 bp, Artificial
  CRISPR gRNA sequence
tgagctgagtggggagaggg

SEQ ID NO: 10369 - DNA, 20 bp, Artificial
  CRISPR gRNA sequence
ctgagtggggagaggggagt

SEQ ID NO: 10370 - DNA, 20 bp, Artificial
  CRISPR gRNA sequence
gtggggagaggggagtaaga

SEQ ID NO: 10371 - DNA, 20 bp, Artificial
  CRISPR gRNA sequence
tggggagaggggagtaagaa

SEQ ID NO: 10372 - DNA, 20 bp, Artificial
  CRISPR gRNA sequence
ggggagtaagaaaggctttc

SEQ ID NO: 10373 - DNA, 20 bp, Artificial
  CRISPR gRNA sequence
gggagtaagaaaggctttcc

SEQ ID NO: 10374 - DNA, 20 bp, Artificial
  CRISPR gRNA sequence
tccaggaattgtaatttcgc

SEQ ID NO: 10375 - DNA, 20 bp, Artificial
  CRISPR gRNA sequence
ccaggaattgtaatttcgcc

SEQ ID NO: 10376 - DNA, 20 bp, Artificial
  CRISPR gRNA sequence
caggaattgtaatttcgcca

SEQ ID NO: 10377 - DNA, 20 bp, Artificial
  CRISPR gRNA sequence
attgtaatttcgccagggat

SEQ ID NO: 10378 - DNA, 20 bp, Artificial
  CRISPR gRNA sequence
aatttcgccagggatcagaa

SEQ ID NO: 10379 - DNA, 20 bp, Artificial
  CRISPR gRNA sequence
atttcgccagggatcagaaa

SEQ ID NO: 10380 - DNA, 20 bp, Artificial
  CRISPR gRNA sequence
aatgtgtccccaaccttcca

SEQ ID NO: 10381 - DNA, 20 bp, Artificial
  CRISPR gRNA sequence
atgtgtccccaaccttccat

SEQ ID NO: 10382 - DNA, 20 bp, Artificial
  CRISPR gRNA sequence
gtgtccccaaccttccatag

SEQ ID NO: 10383 - DNA, 20 bp, Artificial
  CRISPR gRNA sequence
tgtccccaaccttccatagg

SEQ ID NO: 10384 - DNA, 20 bp, Artificial
  CRISPR gRNA sequence
ggaggatgccactatgacta

SEQ ID NO: 10385 - DNA, 20 bp, Artificial
  CRISPR gRNA sequence
aggatgccactatgactatg

SEQ ID NO: 10386 - DNA, 20 bp, Artificial
  CRISPR gRNA sequence
tggagtccttttccctcctg

SEQ ID NO: 10387 - DNA, 20 bp, Artificial
  CRISPR gRNA sequence
gtccttttccctcctgtggc

SEQ ID NO: 10388 - DNA, 20 bp, Artificial
  CRISPR gRNA sequence
tccttttccctcctgtggcc

SEQ ID NO: 10389 - DNA, 20 bp, Artificial
  CRISPR gRNA sequence
gcacaacgtcccttgtgcct

SEQ ID NO: 10390 - DNA, 20 bp, Artificial
  CRISPR gRNA sequence
cctgagcttgtttacttcca

SEQ ID NO: 10391 - DNA, 20 bp, Artificial
  CRISPR gRNA sequence
gcttgtttacttccacagcc

SEQ ID NO: 10392 - DNA, 20 bp, Artificial
  CRISPR gRNA sequence
cttgtttacttccacagcca

SEQ ID NO: 10393 - DNA, 20 bp, Artificial
  CRISPR gRNA sequence
ttgtttacttccacagccaa

SEQ ID NO: 10394 - DNA, 20 bp, Artificial
  CRISPR gRNA sequence
ttacttccacagccaaggga

SEQ ID NO: 10395 - DNA, 20 bp, Artificial
  CRISPR gRNA sequence
cagccaagggatggcctccc

SEQ ID NO: 10396 - DNA, 20 bp, Artificial
  CRISPR gRNA sequence
agccaagggatggcctcccc

SEQ ID NO: 10397 - DNA, 20 bp, Artificial
  CRISPR gRNA sequence
gccaagggatggcctcccca

SEQ ID NO: 10398 - DNA, 20 bp, Artificial
  CRISPR gRNA sequence
caagggatggcctccccagg

SEQ ID NO: 10399 - DNA, 20 bp, Artificial
  CRISPR gRNA sequence
ttcccccattttgaaattcc

SEQ ID NO: 10400 - DNA, 20 bp, Artificial
  CRISPR gRNA sequence
tcccccattttgaaattccc

SEQ ID NO: 10401 - DNA, 20 bp, Artificial
  CRISPR gRNA sequence
ccccattttgaaattcccag

SEQ ID NO: 10402 - DNA, 20 bp, Artificial
  CRISPR gRNA sequence
tcccaggagcttttgatgtg

SEQ ID NO: 10403 - DNA, 20 bp, Artificial
  CRISPR gRNA sequence
aggagcttttgatgtgcagc

SEQ ID NO: 10404 - DNA, 20 bp, Artificial
  CRISPR gRNA sequence
ggagcttttgatgtgcagct

SEQ ID NO: 10405 - DNA, 20 bp, Artificial
  CRISPR gRNA sequence
gatgtgcagctaggatgaaa

SEQ ID NO: 10406 - DNA, 20 bp, Artificial
  CRISPR gRNA sequence
aaaaagcaaccctacttgcc

SEQ ID NO: 10407 - DNA, 20 bp, Artificial
  CRISPR gRNA sequence
aaaagcaaccctacttgcct

SEQ ID NO: 10408 - DNA, 20 bp, Artificial
  CRISPR gRNA sequence
ctacttgcctgggactatcc

SEQ ID NO: 10409 - DNA, 20 bp, Artificial
  CRISPR gRNA sequence
tatcctggtttgaaaactga

SEQ ID NO: 10410 - DNA, 20 bp, Artificial
  CRISPR gRNA sequence
aactgaaagtcttgcatccc

SEQ ID NO: 10411 - DNA, 20 bp, Artificial
  CRISPR gRNA sequence
tgaaagtcttgcatcccaag

SEQ ID NO: 10412 - DNA, 20 bp, Artificial
  CRISPR gRNA sequence
ttgcatcccaagaagcccct

SEQ ID NO: 10413 - DNA, 20 bp, Artificial
  CRISPR gRNA sequence
cccaagaagccccttagtcc

SEQ ID NO: 10414 - DNA, 20 bp, Artificial
  CRISPR gRNA sequence
ccaagaagccccttagtccc

SEQ ID NO: 10415 - DNA, 20 bp, Artificial
  CRISPR gRNA sequence
ccccttagtcccaggcaaac

SEQ ID NO: 10416 - DNA, 20 bp, Artificial
  CRISPR gRNA sequence
cccttagtcccaggcaaact

SEQ ID NO: 10417 - DNA, 20 bp, Artificial
  CRISPR gRNA sequence
tagtcccaggcaaactggga

SEQ ID NO: 10418 - DNA, 20 bp, Artificial
  CRISPR gRNA sequence
cccaggcaaactgggacagt

SEQ ID NO: 10419 - DNA, 20 bp, Artificial
  CRISPR gRNA sequence
acagttggttgctctatgtg

SEQ ID NO: 10420 - DNA, 20 bp, Artificial
  CRISPR gRNA sequence
ttggttgctctatgtgtggc

SEQ ID NO: 10421 - DNA, 20 bp, Artificial
  CRISPR gRNA sequence
tggttgctctatgtgtggcc

SEQ ID NO: 10422 - DNA, 20 bp, Artificial
  CRISPR gRNA sequence
ggttgctctatgtgtggcca

SEQ ID NO: 10423 - DNA, 20 bp, Artificial
  CRISPR gRNA sequence
gctctatgtgtggccagggc

SEQ ID NO: 10424 - DNA, 20 bp, Artificial
  CRISPR gRNA sequence
ctctatgtgtggccagggct

SEQ ID NO: 10425 - DNA, 20 bp, Artificial
  CRISPR gRNA sequence
tctatgtgtggccagggctg

SEQ ID NO: 10426 - DNA, 20 bp, Artificial
  CRISPR gRNA sequence
ctatgtgtggccagggctgg

SEQ ID NO: 10427 - DNA, 20 bp, Artificial
  CRISPR gRNA sequence
cagggctgggggccacaccc

SEQ ID NO: 10428 - DNA, 20 bp, Artificial
  CRISPR gRNA sequence
agggctgggggccacaccct

SEQ ID NO: 10429 - DNA, 20 bp, Artificial
  CRISPR gRNA sequence
gctgggggccacaccctagg

SEQ ID NO: 10430 - DNA, 20 bp, Artificial
  CRISPR gRNA sequence
cacaccctaggcagtgttgc

SEQ ID NO: 10431 - DNA, 20 bp, Artificial
  CRISPR gRNA sequence
acaccctaggcagtgttgct

SEQ ID NO: 10432 - DNA, 20 bp, Artificial
  CRISPR gRNA sequence
caccctaggcagtgttgctg

SEQ ID NO: 10433 - DNA, 20 bp, Artificial
  CRISPR gRNA sequence
aggcagtgttgctggggtga

SEQ ID NO: 10434 - DNA, 20 bp, Artificial
  CRISPR gRNA sequence
tgttgctggggtgacagaaa

SEQ ID NO: 10435 - DNA, 20 bp, Artificial
  CRISPR gRNA sequence
ttgctggggtgacagaaatg

SEQ ID NO: 10436 - DNA, 20 bp, Artificial
  CRISPR gRNA sequence
gggtgacagaaatggagacc

SEQ ID NO: 10437 - DNA, 20 bp, Artificial
  CRISPR gRNA sequence
ggtgacagaaatggagacct

SEQ ID NO: 10438 - DNA, 20 bp, Artificial
  CRISPR gRNA sequence
acagaaatggagacctaggc

SEQ ID NO: 10439 - DNA, 20 bp, Artificial
  CRISPR gRNA sequence
cagaaatggagacctaggca

SEQ ID NO: 10440 - DNA, 20 bp, Artificial
  CRISPR gRNA sequence
tggagacctaggcaaggctc

SEQ ID NO: 10441 - DNA, 20 bp, Artificial
  CRISPR gRNA sequence
ggagacctaggcaaggctct

SEQ ID NO: 10442 - DNA, 20 bp, Artificial
  CRISPR gRNA sequence
gagacctaggcaaggctcta

SEQ ID NO: 10443 - DNA, 20 bp, Artificial
  CRISPR gRNA sequence
gacctaggcaaggctctagg

SEQ ID NO: 10444 - DNA, 20 bp, Artificial
  CRISPR gRNA sequence
aggcaaggctctagggagtc

SEQ ID NO: 10445 - DNA, 20 bp, Artificial
  CRISPR gRNA sequence
ctagggagtccagttgtgtc

SEQ ID NO: 10446 - DNA, 20 bp, Artificial
  CRISPR gRNA sequence
tagggagtccagttgtgtct

SEQ ID NO: 10447 - DNA, 20 bp, Artificial
  CRISPR gRNA sequence
ccagttgtgtctgggtcact

SEQ ID NO: 10448 - DNA, 20 bp, Artificial
  CRISPR gRNA sequence
cagttgtgtctgggtcactg

SEQ ID NO: 10449 - DNA, 20 bp, Artificial
  CRISPR gRNA sequence
gttgtgtctgggtcactgag

SEQ ID NO: 10450 - DNA, 20 bp, Artificial
  CRISPR gRNA sequence
ttgtgtctgggtcactgagg

SEQ ID NO: 10451 - DNA, 20 bp, Artificial
  CRISPR gRNA sequence
tgtgtctgggtcactgagga

SEQ ID NO: 10452 - DNA, 20 bp, Artificial
  CRISPR gRNA sequence
gtgtctgggtcactgaggag

SEQ ID NO: 10453 - DNA, 20 bp, Artificial
  CRISPR gRNA sequence
tctgggtcactgaggagggg

SEQ ID NO: 10454 - DNA, 20 bp, Artificial
  CRISPR gRNA sequence
gaggggcagcccaccataca

SEQ ID NO: 10455 - DNA, 20 bp, Artificial
  CRISPR gRNA sequence
aggggcagcccaccatacat

SEQ ID NO: 10456 - DNA, 20 bp, Artificial
  CRISPR gRNA sequence
gcccaccatacatgggcccc

SEQ ID NO: 10457 - DNA, 20 bp, Artificial
  CRISPR gRNA sequence
accatacatgggccccaaga

SEQ ID NO: 10458 - DNA, 20 bp, Artificial
  CRISPR gRNA sequence
agcacaataattattatatt

SEQ ID NO: 10459 - DNA, 20 bp, Artificial
  CRISPR gRNA sequence
attattatatttagatctgt

SEQ ID NO: 10460 - DNA, 20 bp, Artificial
  CRISPR gRNA sequence
tatttagatctgtcagaata

SEQ ID NO: 10461 - DNA, 20 bp, Artificial
  CRISPR gRNA sequence
ttccttttcttttctttctt

SEQ ID NO: 10462 - DNA, 20 bp, Artificial
  CRISPR gRNA sequence
tccttttcttttctttcttg

SEQ ID NO: 10463 - DNA, 20 bp, Artificial
  CRISPR gRNA sequence
ttttcttttctttcttgagg

SEQ ID NO: 10464 - DNA, 20 bp, Artificial
  CRISPR gRNA sequence
ttcttttctttcttgaggca

SEQ ID NO: 10465 - DNA, 20 bp, Artificial
  CRISPR gRNA sequence
cagagtcttactctgtccct

SEQ ID NO: 10466 - DNA, 20 bp, Artificial
  CRISPR gRNA sequence
agagtcttactctgtccctc

SEQ ID NO: 10467 - DNA, 20 bp, Artificial
  CRISPR gRNA sequence
tcttactctgtccctcaggc

SEQ ID NO: 10468 - DNA, 20 bp, Artificial
  CRISPR gRNA sequence
ttactctgtccctcaggctg

SEQ ID NO: 10469 - DNA, 20 bp, Artificial
  CRISPR gRNA sequence
ctgtccctcaggctggagtt

SEQ ID NO: 10470 - DNA, 20 bp, Artificial
  CRISPR gRNA sequence
tccctcaggctggagttcag

SEQ ID NO: 10471 - DNA, 20 bp, Artificial
  CRISPR gRNA sequence
ggagttcagtggcacaatca

SEQ ID NO: 10472 - DNA, 20 bp, Artificial
  CRISPR gRNA sequence
ggcacaatcacagctcacca

SEQ ID NO: 10473 - DNA, 20 bp, Artificial
  CRISPR gRNA sequence
caccacagcctcaacctccc

SEQ ID NO: 10474 - DNA, 20 bp, Artificial
  CRISPR gRNA sequence
accacagcctcaacctccct

SEQ ID NO: 10475 - DNA, 20 bp, Artificial
  CRISPR gRNA sequence
gcctcaacctccctaggctc

SEQ ID NO: 10476 - DNA, 20 bp, Artificial
  CRISPR gRNA sequence
ctcaagtgatcctcccacct

SEQ ID NO: 10477 - DNA, 20 bp, Artificial
  CRISPR gRNA sequence
tcctcccacctcagcctccc

SEQ ID NO: 10478 - DNA, 20 bp, Artificial
  CRISPR gRNA sequence
tcccacctcagcctccctag

SEQ ID NO: 10479 - DNA, 20 bp, Artificial
  CRISPR gRNA sequence
acctcagcctccctagtagc

SEQ ID NO: 10480 - DNA, 20 bp, Artificial
  CRISPR gRNA sequence
cctcagcctccctagtagct

SEQ ID NO: 10481 - DNA, 20 bp, Artificial
  CRISPR gRNA sequence
ctccctagtagctgggacta

SEQ ID NO: 10482 - DNA, 20 bp, Artificial
  CRISPR gRNA sequence
tccctagtagctgggactac

SEQ ID NO: 10483 - DNA, 20 bp, Artificial
  CRISPR gRNA sequence
actaatttttgtattttttg

SEQ ID NO: 10484 - DNA, 20 bp, Artificial
  CRISPR gRNA sequence
taatttttgtattttttgta

SEQ ID NO: 10485 - DNA, 20 bp, Artificial
  CRISPR gRNA sequence
ttttgtattttttgtagaga

SEQ ID NO: 10486 - DNA, 20 bp, Artificial
  CRISPR gRNA sequence
tttgtattttttgtagagac

SEQ ID NO: 10487 - DNA, 20 bp, Artificial
  CRISPR gRNA sequence
caggatttcaccatgttgcc

SEQ ID NO: 10488 - DNA, 20 bp, Artificial
  CRISPR gRNA sequence
tttcaccatgttgcccagtc

SEQ ID NO: 10489 - DNA, 20 bp, Artificial
  CRISPR gRNA sequence
atgttgcccagtctggtctc

SEQ ID NO: 10490 - DNA, 20 bp, Artificial
  CRISPR gRNA sequence
ccagtctggtctcgagctcc

SEQ ID NO: 10491 - DNA, 20 bp, Artificial
  CRISPR gRNA sequence
cagtctggtctcgagctcct

SEQ ID NO: 10492 - DNA, 20 bp, Artificial
  CRISPR gRNA sequence
ggtctcgagctcctgggctc

SEQ ID NO: 10493 - DNA, 20 bp, Artificial
  CRISPR gRNA sequence
ctcaagcaatcctcccacct

SEQ ID NO: 10494 - DNA, 20 bp, Artificial
  CRISPR gRNA sequence
cctcccacctcagcctccca

SEQ ID NO: 10495 - DNA, 20 bp, Artificial
  CRISPR gRNA sequence
acctcagcctcccaaagtgc

SEQ ID NO: 10496 - DNA, 20 bp, Artificial
  CRISPR gRNA sequence
cctcagcctcccaaagtgct

SEQ ID NO: 10497 - DNA, 20 bp, Artificial
  CRISPR gRNA sequence
ctcccaaagtgctaggatta

SEQ ID NO: 10498 - DNA, 20 bp, Artificial
  CRISPR gRNA sequence
tcccaaagtgctaggattac

SEQ ID NO: 10499 - DNA, 20 bp, Artificial
  CRISPR gRNA sequence
agtgctaggattacaggtgc

SEQ ID NO: 10500 - DNA, 20 bp, Artificial
  CRISPR gRNA sequence
caggtgcgagctcccgcacc

SEQ ID NO: 10501 - DNA, 20 bp, Artificial
  CRISPR gRNA sequence
tgcgagctcccgcacctggc

SEQ ID NO: 10502 - DNA, 20 bp, Artificial
  CRISPR gRNA sequence
gctcccgcacctggccagaa

SEQ ID NO: 10503 - DNA, 20 bp, Artificial
  CRISPR gRNA sequence
ctcccgcacctggccagaac

SEQ ID NO: 10504 - DNA, 20 bp, Artificial
  CRISPR gRNA sequence
agaacaggcttttaaatttg

SEQ ID NO: 10505 - DNA, 20 bp, Artificial
  CRISPR gRNA sequence
accttccatctcaattatct

SEQ ID NO: 10506 - DNA, 20 bp, Artificial
  CRISPR gRNA sequence
ccttccatctcaattatctc

SEQ ID NO: 10507 - DNA, 20 bp, Artificial
  CRISPR gRNA sequence
tctcaggccaccctcctcta

SEQ ID NO: 10508 - DNA, 20 bp, Artificial
  CRISPR gRNA sequence
ctcaggccaccctcctctac

SEQ ID NO: 10509 - DNA, 20 bp, Artificial
  CRISPR gRNA sequence
tcatctccccattgtacaaa

SEQ ID NO: 10510 - DNA, 20 bp, Artificial
  CRISPR gRNA sequence
attgtacaaatggcaatgct

SEQ ID NO: 10511 - DNA, 20 bp, Artificial
  CRISPR gRNA sequence
caaatggcaatgctgagaac

SEQ ID NO: 10512 - DNA, 20 bp, Artificial
  CRISPR gRNA sequence
aatggcaatgctgagaacaa

SEQ ID NO: 10513 - DNA, 20 bp, Artificial
  CRISPR gRNA sequence
gactttaaattgtttatcca

SEQ ID NO: 10514 - DNA, 20 bp, Artificial
  CRISPR gRNA sequence
attgtttatccaaagtcata

SEQ ID NO: 10515 - DNA, 20 bp, Artificial
  CRISPR gRNA sequence
ttgtttatccaaagtcataa

SEQ ID NO: 10516 - DNA, 20 bp, Artificial
  CRISPR gRNA sequence
ttatccaaagtcataaaggt

SEQ ID NO: 10517 - DNA, 20 bp, Artificial
  CRISPR gRNA sequence
tatccaaagtcataaaggtc

SEQ ID NO: 10518 - DNA, 20 bp, Artificial
  CRISPR gRNA sequence
caaagtcataaaggtcaggt

SEQ ID NO: 10519 - DNA, 20 bp, Artificial
  CRISPR gRNA sequence
tcataaaggtcaggtcagcc

SEQ ID NO: 10520 - DNA, 20 bp, Artificial
  CRISPR gRNA sequence
ggtcaggtcagcctggccct

SEQ ID NO: 10521 - DNA, 20 bp, Artificial
  CRISPR gRNA sequence
ctggccctaagctccttcca

SEQ ID NO: 10522 - DNA, 20 bp, Artificial
  CRISPR gRNA sequence
ctaagctccttccacagaaa

SEQ ID NO: 10523 - DNA, 20 bp, Artificial
  CRISPR gRNA sequence
ctaaatgaatgtttgttcct

SEQ ID NO: 10524 - DNA, 20 bp, Artificial
  CRISPR gRNA sequence
aatgaatgtttgttccttgg

SEQ ID NO: 10525 - DNA, 20 bp, Artificial
  CRISPR gRNA sequence
atgaatgtttgttccttggt

SEQ ID NO: 10526 - DNA, 20 bp, Artificial
  CRISPR gRNA sequence
tgaatgtttgttccttggta

SEQ ID NO: 10527 - DNA, 20 bp, Artificial
  CRISPR gRNA sequence
gaatgtttgttccttggtag

SEQ ID NO: 10528 - DNA, 20 bp, Artificial
  CRISPR gRNA sequence
tttgttccttggtaggggtc

SEQ ID NO: 10529 - DNA, 20 bp, Artificial
  CRISPR gRNA sequence
ggtctagatcatctaatgat

SEQ ID NO: 10530 - DNA, 20 bp, Artificial
  CRISPR gRNA sequence
gtctagatcatctaatgatt

SEQ ID NO: 10531 - DNA, 20 bp, Artificial
  CRISPR gRNA sequence
tagatcatctaatgattagg

SEQ ID NO: 10532 - DNA, 20 bp, Artificial
  CRISPR gRNA sequence
agatcatctaatgattagga

SEQ ID NO: 10533 - DNA, 20 bp, Artificial
  CRISPR gRNA sequence
atcatctaatgattaggaag

SEQ ID NO: 10534 - DNA, 20 bp, Artificial
  CRISPR gRNA sequence
ggaaggagttgttatgcctg

SEQ ID NO: 10535 - DNA, 20 bp, Artificial
  CRISPR gRNA sequence
tgttatgcctgtggtatatt

SEQ ID NO: 10536 - DNA, 20 bp, Artificial
  CRISPR gRNA sequence
tattcggtgctgtttttttt

SEQ ID NO: 10537 - DNA, 20 bp, Artificial
  CRISPR gRNA sequence
ttcggtgctgtttttttttg

SEQ ID NO: 10538 - DNA, 20 bp, Artificial
  CRISPR gRNA sequence
gtgctgtttttttttggaga

SEQ ID NO: 10539 - DNA, 20 bp, Artificial
  CRISPR gRNA sequence
tgctgtttttttttggagat

SEQ ID NO: 10540 - DNA, 20 bp, Artificial
  CRISPR gRNA sequence
gctgtttttttttggagatg

SEQ ID NO: 10541 - DNA, 20 bp, Artificial
  CRISPR gRNA sequence
tggggtcttgctctgtcacc

SEQ ID NO: 10542 - DNA, 20 bp, Artificial
  CRISPR gRNA sequence
ggggtcttgctctgtcaccc

SEQ ID NO: 10543 - DNA, 20 bp, Artificial
  CRISPR gRNA sequence
tcttgctctgtcacccaggc

SEQ ID NO: 10544 - DNA, 20 bp, Artificial
  CRISPR gRNA sequence
ctgtcacccaggctagaatg

SEQ ID NO: 10545 - DNA, 20 bp, Artificial
  CRISPR gRNA sequence
tcacccaggctagaatgcag

SEQ ID NO: 10546 - DNA, 20 bp, Artificial
  CRISPR gRNA sequence
agaatgcagtggtatgatct

SEQ ID NO: 10547 - DNA, 20 bp, Artificial
  CRISPR gRNA sequence
tcactgcaatctccacctct

SEQ ID NO: 10548 - DNA, 20 bp, Artificial
  CRISPR gRNA sequence
caatctccacctctcggttc

SEQ ID NO: 10549 - DNA, 20 bp, Artificial
  CRISPR gRNA sequence
ttcaagcaattttcctgcct

SEQ ID NO: 10550 - DNA, 20 bp, Artificial
  CRISPR gRNA sequence
ttttcctgcctcagcctccc

SEQ ID NO: 10551 - DNA, 20 bp, Artificial
  CRISPR gRNA sequence
tcctgcctcagcctcccgag

SEQ ID NO: 10552 - DNA, 20 bp, Artificial
  CRISPR gRNA sequence
gcctcagcctcccgagtagc

SEQ ID NO: 10553 - DNA, 20 bp, Artificial
  CRISPR gRNA sequence
cctcagcctcccgagtagct

SEQ ID NO: 10554 - DNA, 20 bp, Artificial
  CRISPR gRNA sequence
ctcccgagtagctgggatta

SEQ ID NO: 10555 - DNA, 20 bp, Artificial
  CRISPR gRNA sequence
tcccgagtagctgggattac

SEQ ID NO: 10556 - DNA, 20 bp, Artificial
  CRISPR gRNA sequence
caggtgtacaccactacacc

SEQ ID NO: 10557 - DNA, 20 bp, Artificial
  CRISPR gRNA sequence
ctggctaatttttgtatttt

SEQ ID NO: 10558 - DNA, 20 bp, Artificial
  CRISPR gRNA sequence
gctaatttttgtatttttag

SEQ ID NO: 10559 - DNA, 20 bp, Artificial
  CRISPR gRNA sequence
taatttttgtatttttagta

SEQ ID NO: 10560 - DNA, 20 bp, Artificial
  CRISPR gRNA sequence
ttttgtatttttagtagaga

SEQ ID NO: 10561 - DNA, 20 bp, Artificial
  CRISPR gRNA sequence
tttgtatttttagtagagac

SEQ ID NO: 10562 - DNA, 20 bp, Artificial
  CRISPR gRNA sequence
gagacgggctttaaccatgt

SEQ ID NO: 10563 - DNA, 20 bp, Artificial
  CRISPR gRNA sequence
cgggctttaaccatgttggc

SEQ ID NO: 10564 - DNA, 20 bp, Artificial
  CRISPR gRNA sequence
gggctttaaccatgttggcc

SEQ ID NO: 10565 - DNA, 20 bp, Artificial
  CRISPR gRNA sequence
tttaaccatgttggccaggc

SEQ ID NO: 10566 - DNA, 20 bp, Artificial
  CRISPR gRNA sequence
ccaggctggtcttgaactcc

SEQ ID NO: 10567 - DNA, 20 bp, Artificial
  CRISPR gRNA sequence
tggtcttgaactcctggcct

SEQ ID NO: 10568 - DNA, 20 bp, Artificial
  CRISPR gRNA sequence
ctcagatgttcctcccacct

SEQ ID NO: 10569 - DNA, 20 bp, Artificial
  CRISPR gRNA sequence
cctcccacctcagcctccca

SEQ ID NO: 10570 - DNA, 20 bp, Artificial
  CRISPR gRNA sequence
acctcagcctcccaaagtgc

SEQ ID NO: 10571 - DNA, 20 bp, Artificial
  CRISPR gRNA sequence
cctcagcctcccaaagtgct

SEQ ID NO: 10572 - DNA, 20 bp, Artificial
  CRISPR gRNA sequence
ctcccaaagtgctgggatta

SEQ ID NO: 10573 - DNA, 20 bp, Artificial
  CRISPR gRNA sequence
tcccaaagtgctgggattac

SEQ ID NO: 10574 - DNA, 20 bp, Artificial
  CRISPR gRNA sequence
agtgctgggattacaggtgt

SEQ ID NO: 10575 - DNA, 20 bp, Artificial
  CRISPR gRNA sequence
caggtgtaagccaccatgcc

SEQ ID NO: 10576 - DNA, 20 bp, Artificial
  CRISPR gRNA sequence
accatgcccagcttataatt

SEQ ID NO: 10577 - DNA, 20 bp, Artificial
  CRISPR gRNA sequence
tatataatctcattaatctc

SEQ ID NO: 10578 - DNA, 20 bp, Artificial
  CRISPR gRNA sequence
tataatctcattaatctcaa

SEQ ID NO: 10579 - DNA, 20 bp, Artificial
  CRISPR gRNA sequence
attaatctcaagagctactg

SEQ ID NO: 10580 - DNA, 20 bp, Artificial
  CRISPR gRNA sequence
aatctcaagagctactgtgg

SEQ ID NO: 10581 - DNA, 20 bp, Artificial
  CRISPR gRNA sequence
tcaagagctactgtggaaga

SEQ ID NO: 10582 - DNA, 20 bp, Artificial
  CRISPR gRNA sequence
gagctactgtggaagacaga

SEQ ID NO: 10583 - DNA, 20 bp, Artificial
  CRISPR gRNA sequence
tcatcatcttccccatttta

SEQ ID NO: 10584 - DNA, 20 bp, Artificial
  CRISPR gRNA sequence
atcttccccattttacagat

SEQ ID NO: 10585 - DNA, 20 bp, Artificial
  CRISPR gRNA sequence
tcttccccattttacagatg

SEQ ID NO: 10586 - DNA, 20 bp, Artificial
  CRISPR gRNA sequence
ttccccattttacagatgag

SEQ ID NO: 10587 - DNA, 20 bp, Artificial
  CRISPR gRNA sequence
ccattttacagatgaggaga

SEQ ID NO: 10588 - DNA, 20 bp, Artificial
  CRISPR gRNA sequence
attttacagatgaggagacg

SEQ ID NO: 10589 - DNA, 20 bp, Artificial
  CRISPR gRNA sequence
ttttacagatgaggagacgg

SEQ ID NO: 10590 - DNA, 20 bp, Artificial
  CRISPR gRNA sequence
cagatgaggagacggaggcc

SEQ ID NO: 10591 - DNA, 20 bp, Artificial
  CRISPR gRNA sequence
tgaggagacggaggcctggt

SEQ ID NO: 10592 - DNA, 20 bp, Artificial
  CRISPR gRNA sequence
gaggagacggaggcctggtg

SEQ ID NO: 10593 - DNA, 20 bp, Artificial
  CRISPR gRNA sequence
gacggaggcctggtgaggtt

SEQ ID NO: 10594 - DNA, 20 bp, Artificial
  CRISPR gRNA sequence
gaggttaagtgacttgcccg

SEQ ID NO: 10595 - DNA, 20 bp, Artificial
  CRISPR gRNA sequence
gtgacttgcccgtggtcccc

SEQ ID NO: 10596 - DNA, 20 bp, Artificial
  CRISPR gRNA sequence
cttgcccgtggtcccccagc

SEQ ID NO: 10597 - DNA, 20 bp, Artificial
  CRISPR gRNA sequence
tcccccagctggtcacccac

SEQ ID NO: 10598 - DNA, 20 bp, Artificial
  CRISPR gRNA sequence
gctggtcacccacaagctat

SEQ ID NO: 10599 - DNA, 20 bp, Artificial
  CRISPR gRNA sequence
atcactgctcccctgtgccc

SEQ ID NO: 10600 - DNA, 20 bp, Artificial
  CRISPR gRNA sequence
ctcccctgtgccccagaaaa

SEQ ID NO: 10601 - DNA, 20 bp, Artificial
  CRISPR gRNA sequence
cctgtgccccagaaaaaagc

SEQ ID NO: 10602 - DNA, 20 bp, Artificial
  CRISPR gRNA sequence
ccagtgtctcttgttttgaa

SEQ ID NO: 10603 - DNA, 20 bp, Artificial
  CRISPR gRNA sequence
agtgtctcttgttttgaaca

SEQ ID NO: 10604 - DNA, 20 bp, Artificial
  CRISPR gRNA sequence
ctcttgttttgaacagagac

SEQ ID NO: 10605 - DNA, 20 bp, Artificial
  CRISPR gRNA sequence
tcttgttttgaacagagaca

SEQ ID NO: 10606 - DNA, 20 bp, Artificial
  CRISPR gRNA sequence
gacaaggtgctaaatttgtc

SEQ ID NO: 10607 - DNA, 20 bp, Artificial
  CRISPR gRNA sequence
caaggtgctaaatttgtcca

SEQ ID NO: 10608 - DNA, 20 bp, Artificial
  CRISPR gRNA sequence
aaggtgctaaatttgtccag

SEQ ID NO: 10609 - DNA, 20 bp, Artificial
  CRISPR gRNA sequence
gaggtaaaaatgatgctgaa

SEQ ID NO: 10610 - DNA, 20 bp, Artificial
  CRISPR gRNA sequence
aggtaaaaatgatgctgaaa

SEQ ID NO: 10611 - DNA, 20 bp, Artificial
  CRISPR gRNA sequence
ggtaaaaatgatgctgaaaa

SEQ ID NO: 10612 - DNA, 20 bp, Artificial
  CRISPR gRNA sequence
gtaaaaatgatgctgaaaag

SEQ ID NO: 10613 - DNA, 20 bp, Artificial
  CRISPR gRNA sequence
aatgtctgaaaacaataact

SEQ ID NO: 10614 - DNA, 20 bp, Artificial
  CRISPR gRNA sequence
atgtctgaaaacaataactg

SEQ ID NO: 10615 - DNA, 20 bp, Artificial
  CRISPR gRNA sequence
tgtctgaaaacaataactga

SEQ ID NO: 10616 - DNA, 20 bp, Artificial
  CRISPR gRNA sequence
caataactgagggccctttc

SEQ ID NO: 10617 - DNA, 20 bp, Artificial
  CRISPR gRNA sequence
ttctggccttaaattatttt

SEQ ID NO: 10618 - DNA, 20 bp, Artificial
  CRISPR gRNA sequence
taaattattttcagctgaaa

SEQ ID NO: 10619 - DNA, 20 bp, Artificial
  CRISPR gRNA sequence
ttttcagctgaaaaagcccc

SEQ ID NO: 10620 - DNA, 20 bp, Artificial
  CRISPR gRNA sequence
gctgaaaaagcccctagttc

SEQ ID NO: 10621 - DNA, 20 bp, Artificial
  CRISPR gRNA sequence
aaaagcccctagttcaagat

SEQ ID NO: 10622 - DNA, 20 bp, Artificial
  CRISPR gRNA sequence
tcaagatcggaactgcgctc

SEQ ID NO: 10623 - DNA, 20 bp, Artificial
  CRISPR gRNA sequence
caagatcggaactgcgctct

SEQ ID NO: 10624 - DNA, 20 bp, Artificial
  CRISPR gRNA sequence
aagatcggaactgcgctctg

SEQ ID NO: 10625 - DNA, 20 bp, Artificial
  CRISPR gRNA sequence
cggaactgcgctctggggaa

SEQ ID NO: 10626 - DNA, 20 bp, Artificial
  CRISPR gRNA sequence
aactgcgctctggggaacag

SEQ ID NO: 10627 - DNA, 20 bp, Artificial
  CRISPR gRNA sequence
gctctggggaacagcggcca

SEQ ID NO: 10628 - DNA, 20 bp, Artificial
  CRISPR gRNA sequence
ctctggggaacagcggccat

SEQ ID NO: 10629 - DNA, 20 bp, Artificial
  CRISPR gRNA sequence
tctggggaacagcggccatg

SEQ ID NO: 10630 - DNA, 20 bp, Artificial
  CRISPR gRNA sequence
ggggaacagcggccatgggg

SEQ ID NO: 10631 - DNA, 20 bp, Artificial
  CRISPR gRNA sequence
acagcggccatggggtggaa

SEQ ID NO: 10632 - DNA, 20 bp, Artificial
  CRISPR gRNA sequence
ggccatggggtggaacagcc

SEQ ID NO: 10633 - DNA, 20 bp, Artificial
  CRISPR gRNA sequence
ccatggggtggaacagccta

SEQ ID NO: 10634 - DNA, 20 bp, Artificial
  CRISPR gRNA sequence
ggggtggaacagcctagagc

SEQ ID NO: 10635 - DNA, 20 bp, Artificial
  CRISPR gRNA sequence
gggtggaacagcctagagcc

SEQ ID NO: 10636 - DNA, 20 bp, Artificial
  CRISPR gRNA sequence
acagcctagagccgggtgat

SEQ ID NO: 10637 - DNA, 20 bp, Artificial
  CRISPR gRNA sequence
gagccgggtgatcagccacc

SEQ ID NO: 10638 - DNA, 20 bp, Artificial
  CRISPR gRNA sequence
gccgggtgatcagccacctg

SEQ ID NO: 10639 - DNA, 20 bp, Artificial
  CRISPR gRNA sequence
gtgatcagccacctggagac

SEQ ID NO: 10640 - DNA, 20 bp, Artificial
  CRISPR gRNA sequence
atcagccacctggagaccgg

SEQ ID NO: 10641 - DNA, 20 bp, Artificial
  CRISPR gRNA sequence
cctggagaccggaagccccc

SEQ ID NO: 10642 - DNA, 20 bp, Artificial
  CRISPR gRNA sequence
ctggagaccggaagcccccg

SEQ ID NO: 10643 - DNA, 20 bp, Artificial
  CRISPR gRNA sequence
ggagaccggaagcccccgag

SEQ ID NO: 10644 - DNA, 20 bp, Artificial
  CRISPR gRNA sequence
gagaccggaagcccccgagg

SEQ ID NO: 10645 - DNA, 20 bp, Artificial
  CRISPR gRNA sequence
gaagcccccgaggaggttct

SEQ ID NO: 10646 - DNA, 20 bp, Artificial
  CRISPR gRNA sequence
aagcccccgaggaggttctg

SEQ ID NO: 10647 - DNA, 20 bp, Artificial
  CRISPR gRNA sequence
cccccgaggaggttctgagg

SEQ ID NO: 10648 - DNA, 20 bp, Artificial
  CRISPR gRNA sequence
ccccgaggaggttctgagga

SEQ ID NO: 10649 - DNA, 20 bp, Artificial
  CRISPR gRNA sequence
cgaggaggttctgaggaagg

SEQ ID NO: 10650 - DNA, 20 bp, Artificial
  CRISPR gRNA sequence
gaggaggttctgaggaagga

SEQ ID NO: 10651 - DNA, 20 bp, Artificial
  CRISPR gRNA sequence
gaggttctgaggaaggaagg

SEQ ID NO: 10652 - DNA, 20 bp, Artificial
  CRISPR gRNA sequence
aggttctgaggaaggaagga

SEQ ID NO: 10653 - DNA, 20 bp, Artificial
  CRISPR gRNA sequence
ttctgaggaaggaaggaagg

SEQ ID NO: 10654 - DNA, 20 bp, Artificial
  CRISPR gRNA sequence
tctgaggaaggaaggaagga

SEQ ID NO: 10655 - DNA, 20 bp, Artificial
  CRISPR gRNA sequence
ggaaggaaggaaggaaggaa

SEQ ID NO: 10656 - DNA, 20 bp, Artificial
  CRISPR gRNA sequence
aggaaggaaaagactatttc

SEQ ID NO: 10657 - DNA, 20 bp, Artificial
  CRISPR gRNA sequence
gactatttctggcattttct

SEQ ID NO: 10658 - DNA, 20 bp, Artificial
  CRISPR gRNA sequence
actatttctggcattttctc

SEQ ID NO: 10659 - DNA, 20 bp, Artificial
  CRISPR gRNA sequence
tctcaggcttctactgtgcc

SEQ ID NO: 10660 - DNA, 20 bp, Artificial
  CRISPR gRNA sequence
ctcaggcttctactgtgccc

SEQ ID NO: 10661 - DNA, 20 bp, Artificial
  CRISPR gRNA sequence
tactgtgcccaggcaccctg

SEQ ID NO: 10662 - DNA, 20 bp, Artificial
  CRISPR gRNA sequence
acctcatctgtctgtcaaat

SEQ ID NO: 10663 - DNA, 20 bp, Artificial
  CRISPR gRNA sequence
cctcatctgtctgtcaaatc

SEQ ID NO: 10664 - DNA, 20 bp, Artificial
  CRISPR gRNA sequence
ctcatctgtctgtcaaatca

SEQ ID NO: 10665 - DNA, 20 bp, Artificial
  CRISPR gRNA sequence
gtctgtcaaatcagggttct

SEQ ID NO: 10666 - DNA, 20 bp, Artificial
  CRISPR gRNA sequence
cttagccactcacaacccta

SEQ ID NO: 10667 - DNA, 20 bp, Artificial
  CRISPR gRNA sequence
ttagccactcacaaccctac

SEQ ID NO: 10668 - DNA, 20 bp, Artificial
  CRISPR gRNA sequence
tagccactcacaaccctaca

SEQ ID NO: 10669 - DNA, 20 bp, Artificial
  CRISPR gRNA sequence
acagggacttcgtttgtaca

SEQ ID NO: 10670 - DNA, 20 bp, Artificial
  CRISPR gRNA sequence
agggacttcgtttgtacaca

SEQ ID NO: 10671 - DNA, 20 bp, Artificial
  CRISPR gRNA sequence
ttgtacacagagtccttccc

SEQ ID NO: 10672 - DNA, 20 bp, Artificial
  CRISPR gRNA sequence
cacagagtccttccccagtt

SEQ ID NO: 10673 - DNA, 20 bp, Artificial
  CRISPR gRNA sequence
cccttatctcctacactcgc

SEQ ID NO: 10674 - DNA, 20 bp, Artificial
  CRISPR gRNA sequence
ccttatctcctacactcgct

SEQ ID NO: 10675 - DNA, 20 bp, Artificial
  CRISPR gRNA sequence
gctgggtgctctctccattc

SEQ ID NO: 10676 - DNA, 20 bp, Artificial
  CRISPR gRNA sequence
tgctctctccattccagcca

SEQ ID NO: 10677 - DNA, 20 bp, Artificial
  CRISPR gRNA sequence
gctctctccattccagccac

SEQ ID NO: 10678 - DNA, 20 bp, Artificial
  CRISPR gRNA sequence
ctctctccattccagccaca

SEQ ID NO: 10679 - DNA, 20 bp, Artificial
  CRISPR gRNA sequence
cagccacagggcctccttgc

SEQ ID NO: 10680 - DNA, 20 bp, Artificial
  CRISPR gRNA sequence
cttgctggctttcaacctcc

SEQ ID NO: 10681 - DNA, 20 bp, Artificial
  CRISPR gRNA sequence
ttgctggctttcaacctcct

SEQ ID NO: 10682 - DNA, 20 bp, Artificial
  CRISPR gRNA sequence
cctaggcatgcttctgcctc

SEQ ID NO: 10683 - DNA, 20 bp, Artificial
  CRISPR gRNA sequence
ctaggcatgcttctgcctcc

SEQ ID NO: 10684 - DNA, 20 bp, Artificial
  CRISPR gRNA sequence
ctgcctccaggcctttgcac

SEQ ID NO: 10685 - DNA, 20 bp, Artificial
  CRISPR gRNA sequence
caccggctgtgccctctgcc

SEQ ID NO: 10686 - DNA, 20 bp, Artificial
  CRISPR gRNA sequence
ctgcctggaatacttctccc

SEQ ID NO: 10687 - DNA, 20 bp, Artificial
  CRISPR gRNA sequence
cttctccccagatatctgca

SEQ ID NO: 10688 - DNA, 20 bp, Artificial
  CRISPR gRNA sequence
gctcatgccttcacctcctc

SEQ ID NO: 10689 - DNA, 20 bp, Artificial
  CRISPR gRNA sequence
cacctcctctggtctttact

SEQ ID NO: 10690 - DNA, 20 bp, Artificial
  CRISPR gRNA sequence
tcctctggtctttactcagt

SEQ ID NO: 10691 - DNA, 20 bp, Artificial
  CRISPR gRNA sequence
cctctggtctttactcagtg

SEQ ID NO: 10692 - DNA, 20 bp, Artificial
  CRISPR gRNA sequence
ttttttctttttcttttttt

SEQ ID NO: 10693 - DNA, 20 bp, Artificial
  CRISPR gRNA sequence
tttttctttttctttttttg

SEQ ID NO: 10694 - DNA, 20 bp, Artificial
  CRISPR gRNA sequence
ttctttttctttttttgagg

SEQ ID NO: 10695 - DNA, 20 bp, Artificial
  CRISPR gRNA sequence
ctttttctttttttgaggtg

SEQ ID NO: 10696 - DNA, 20 bp, Artificial
  CRISPR gRNA sequence
tggagtctcgctctgtcacc

SEQ ID NO: 10697 - DNA, 20 bp, Artificial
  CRISPR gRNA sequence
ggagtctcgctctgtcaccc

SEQ ID NO: 10698 - DNA, 20 bp, Artificial
  CRISPR gRNA sequence
tctcgctctgtcacccaggc

SEQ ID NO: 10699 - DNA, 20 bp, Artificial
  CRISPR gRNA sequence
tcgctctgtcacccaggctg

SEQ ID NO: 10700 - DNA, 20 bp, Artificial
  CRISPR gRNA sequence
ctgtcacccaggctggagtg

SEQ ID NO: 10701 - DNA, 20 bp, Artificial
  CRISPR gRNA sequence
tcacccaggctggagtgcag

SEQ ID NO: 10702 - DNA, 20 bp, Artificial
  CRISPR gRNA sequence
cactgcaacctcctcctccc

SEQ ID NO: 10703 - DNA, 20 bp, Artificial
  CRISPR gRNA sequence
aacctcctcctcccaagtcc

SEQ ID NO: 10704 - DNA, 20 bp, Artificial
  CRISPR gRNA sequence
tccaagtgattctcttgcct

SEQ ID NO: 10705 - DNA, 20 bp, Artificial
  CRISPR gRNA sequence
ttctcttgcctcagcctccc

SEQ ID NO: 10706 - DNA, 20 bp, Artificial
  CRISPR gRNA sequence
tcttgcctcagcctcccgag

SEQ ID NO: 10707 - DNA, 20 bp, Artificial
  CRISPR gRNA sequence
gcctcagcctcccgagtagc

SEQ ID NO: 10708 - DNA, 20 bp, Artificial
  CRISPR gRNA sequence
cctcagcctcccgagtagct

SEQ ID NO: 10709 - DNA, 20 bp, Artificial
  CRISPR gRNA sequence
ctcccgagtagctgggacta

SEQ ID NO: 10710 - DNA, 20 bp, Artificial
  CRISPR gRNA sequence
tcccgagtagctgggactac

SEQ ID NO: 10711 - DNA, 20 bp, Artificial
  CRISPR gRNA sequence
caggcacatgtcaccacatc

SEQ ID NO: 10712 - DNA, 20 bp, Artificial
  CRISPR gRNA sequence
tggctaattttttgtatttt

SEQ ID NO: 10713 - DNA, 20 bp, Artificial
  CRISPR gRNA sequence
ctaattttttgtatttttag

SEQ ID NO: 10714 - DNA, 20 bp, Artificial
  CRISPR gRNA sequence
aattttttgtatttttagta

SEQ ID NO: 10715 - DNA, 20 bp, Artificial
  CRISPR gRNA sequence
ttttgtatttttagtagaga

SEQ ID NO: 10716 - DNA, 20 bp, Artificial
  CRISPR gRNA sequence
tttgtatttttagtagagac

SEQ ID NO: 10717 - DNA, 20 bp, Artificial
  CRISPR gRNA sequence
ttgtatttttagtagagacg

SEQ ID NO: 10718 - DNA, 20 bp, Artificial
  CRISPR gRNA sequence
gagacggggtttcaccgtgt

SEQ ID NO: 10719 - DNA, 20 bp, Artificial
  CRISPR gRNA sequence
cggggtttcaccgtgttagc

SEQ ID NO: 10720 - DNA, 20 bp, Artificial
  CRISPR gRNA sequence
ggggtttcaccgtgttagcc

SEQ ID NO: 10721 - DNA, 20 bp, Artificial
  CRISPR gRNA sequence
tttcaccgtgttagccagga

SEQ ID NO: 10722 - DNA, 20 bp, Artificial
  CRISPR gRNA sequence
acctcgtgatccccccacct

SEQ ID NO: 10723 - DNA, 20 bp, Artificial
  CRISPR gRNA sequence
ccccccacctcggcctccca

SEQ ID NO: 10724 - DNA, 20 bp, Artificial
  CRISPR gRNA sequence
acctcggcctcccaaagtgc

SEQ ID NO: 10725 - DNA, 20 bp, Artificial
  CRISPR gRNA sequence
cctcggcctcccaaagtgct

SEQ ID NO: 10726 - DNA, 20 bp, Artificial
  CRISPR gRNA sequence
ctcccaaagtgctgggatta

SEQ ID NO: 10727 - DNA, 20 bp, Artificial
  CRISPR gRNA sequence
tcccaaagtgctgggattac

SEQ ID NO: 10728 - DNA, 20 bp, Artificial
  CRISPR gRNA sequence
agtgctgggattacaggcgt

SEQ ID NO: 10729 - DNA, 20 bp, Artificial
  CRISPR gRNA sequence
caggcgtgagccaccacacc

SEQ ID NO: 10730 - DNA, 20 bp, Artificial
  CRISPR gRNA sequence
tgagccaccacacccggcct

SEQ ID NO: 10731 - DNA, 20 bp, Artificial
  CRISPR gRNA sequence
ccaccacacccggcctcagt

SEQ ID NO: 10732 - DNA, 20 bp, Artificial
  CRISPR gRNA sequence
caccacacccggcctcagtg

SEQ ID NO: 10733 - DNA, 20 bp, Artificial
  CRISPR gRNA sequence
gaggtcttttctgaccctca

SEQ ID NO: 10734 - DNA, 20 bp, Artificial
  CRISPR gRNA sequence
cacagttaaaaataaaactc

SEQ ID NO: 10735 - DNA, 20 bp, Artificial
  CRISPR gRNA sequence
gttaaaaataaaactctggc

SEQ ID NO: 10736 - DNA, 20 bp, Artificial
  CRISPR gRNA sequence
ttaaaaataaaactctggcc

SEQ ID NO: 10737 - DNA, 20 bp, Artificial
  CRISPR gRNA sequence
aataaaactctggccaggcg

SEQ ID NO: 10738 - DNA, 20 bp, Artificial
  CRISPR gRNA sequence
aaaactctggccaggcgcag

SEQ ID NO: 10739 - DNA, 20 bp, Artificial
  CRISPR gRNA sequence
gtggcttatgcctgtaatcc

SEQ ID NO: 10740 - DNA, 20 bp, Artificial
  CRISPR gRNA sequence
tgcctgtaatcccagcactt

SEQ ID NO: 10741 - DNA, 20 bp, Artificial
  CRISPR gRNA sequence
gcctgtaatcccagcacttt

SEQ ID NO: 10742 - DNA, 20 bp, Artificial
  CRISPR gRNA sequence
ctgtaatcccagcactttgg

SEQ ID NO: 10743 - DNA, 20 bp, Artificial
  CRISPR gRNA sequence
tgtaatcccagcactttggg

SEQ ID NO: 10744 - DNA, 20 bp, Artificial
  CRISPR gRNA sequence
tcccagcactttgggaggcc

SEQ ID NO: 10745 - DNA, 20 bp, Artificial
  CRISPR gRNA sequence
cccagcactttgggaggccg

SEQ ID NO: 10746 - DNA, 20 bp, Artificial
  CRISPR gRNA sequence
agcactttgggaggccgagg

SEQ ID NO: 10747 - DNA, 20 bp, Artificial
  CRISPR gRNA sequence
gcactttgggaggccgaggc

SEQ ID NO: 10748 - DNA, 20 bp, Artificial
  CRISPR gRNA sequence
ctttgggaggccgaggcagg

SEQ ID NO: 10749 - DNA, 20 bp, Artificial
  CRISPR gRNA sequence
ggccgaggcaggtggatcac

SEQ ID NO: 10750 - DNA, 20 bp, Artificial
  CRISPR gRNA sequence
gccgaggcaggtggatcaca

SEQ ID NO: 10751 - DNA, 20 bp, Artificial
  CRISPR gRNA sequence
aggcaggtggatcacaaggc

SEQ ID NO: 10752 - DNA, 20 bp, Artificial
  CRISPR gRNA sequence
ggcaggtggatcacaaggcc

SEQ ID NO: 10753 - DNA, 20 bp, Artificial
  CRISPR gRNA sequence
caggtggatcacaaggccag

SEQ ID NO: 10754 - DNA, 20 bp, Artificial
  CRISPR gRNA sequence
gatcacaaggccaggagttt

SEQ ID NO: 10755 - DNA, 20 bp, Artificial
  CRISPR gRNA sequence
caaggccaggagtttgagac

SEQ ID NO: 10756 - DNA, 20 bp, Artificial
  CRISPR gRNA sequence
ccaggagtttgagaccagcc

SEQ ID NO: 10757 - DNA, 20 bp, Artificial
  CRISPR gRNA sequence
tgagaccagcctggccaaca

SEQ ID NO: 10758 - DNA, 20 bp, Artificial
  CRISPR gRNA sequence
actaaatatacaaaacaaat

SEQ ID NO: 10759 - DNA, 20 bp, Artificial
  CRISPR gRNA sequence
aatatacaaaacaaattagc

SEQ ID NO: 10760 - DNA, 20 bp, Artificial
  CRISPR gRNA sequence
atatacaaaacaaattagct

SEQ ID NO: 10761 - DNA, 20 bp, Artificial
  CRISPR gRNA sequence
caaaacaaattagctgggca

SEQ ID NO: 10762 - DNA, 20 bp, Artificial
  CRISPR gRNA sequence
aacaaattagctgggcatgg

SEQ ID NO: 10763 - DNA, 20 bp, Artificial
  CRISPR gRNA sequence
aaattagctgggcatggtgg

SEQ ID NO: 10764 - DNA, 20 bp, Artificial
  CRISPR gRNA sequence
aattagctgggcatggtggc

SEQ ID NO: 10765 - DNA, 20 bp, Artificial
  CRISPR gRNA sequence
ggcatggtggcaggtgcctg

SEQ ID NO: 10766 - DNA, 20 bp, Artificial
  CRISPR gRNA sequence
gtggcaggtgcctgtagtca

SEQ ID NO: 10767 - DNA, 20 bp, Artificial
  CRISPR gRNA sequence
tgcctgtagtcacagctact

SEQ ID NO: 10768 - DNA, 20 bp, Artificial
  CRISPR gRNA sequence
gcctgtagtcacagctactt

SEQ ID NO: 10769 - DNA, 20 bp, Artificial
  CRISPR gRNA sequence
ctgtagtcacagctacttgg

SEQ ID NO: 10770 - DNA, 20 bp, Artificial
  CRISPR gRNA sequence
tgtagtcacagctacttggg

SEQ ID NO: 10771 - DNA, 20 bp, Artificial
  CRISPR gRNA sequence
tcacagctacttgggaggct

SEQ ID NO: 10772 - DNA, 20 bp, Artificial
  CRISPR gRNA sequence
cacagctacttgggaggctg

SEQ ID NO: 10773 - DNA, 20 bp, Artificial
  CRISPR gRNA sequence
agctacttgggaggctgagg

SEQ ID NO: 10774 - DNA, 20 bp, Artificial
  CRISPR gRNA sequence
gctacttgggaggctgaggc

SEQ ID NO: 10775 - DNA, 20 bp, Artificial
  CRISPR gRNA sequence
tacttgggaggctgaggcag

SEQ ID NO: 10776 - DNA, 20 bp, Artificial
  CRISPR gRNA sequence
gcaggagaatcatttgaaac

SEQ ID NO: 10777 - DNA, 20 bp, Artificial
  CRISPR gRNA sequence
caggagaatcatttgaaacc

SEQ ID NO: 10778 - DNA, 20 bp, Artificial
  CRISPR gRNA sequence
ggagaatcatttgaaaccgg

SEQ ID NO: 10779 - DNA, 20 bp, Artificial
  CRISPR gRNA sequence
gagaatcatttgaaaccggg

SEQ ID NO: 10780 - DNA, 20 bp, Artificial
  CRISPR gRNA sequence
aatcatttgaaaccgggagg

SEQ ID NO: 10781 - DNA, 20 bp, Artificial
  CRISPR gRNA sequence
tcatttgaaaccgggaggcg

SEQ ID NO: 10782 - DNA, 20 bp, Artificial
  CRISPR gRNA sequence
catttgaaaccgggaggcgg

SEQ ID NO: 10783 - DNA, 20 bp, Artificial
  CRISPR gRNA sequence
aaaccgggaggcggaggttg

SEQ ID NO: 10784 - DNA, 20 bp, Artificial
  CRISPR gRNA sequence
cgggaggcggaggttgcggt

SEQ ID NO: 10785 - DNA, 20 bp, Artificial
  CRISPR gRNA sequence
ggcggaggttgcggtgagct

SEQ ID NO: 10786 - DNA, 20 bp, Artificial
  CRISPR gRNA sequence
gagctgagatcacgccactg

SEQ ID NO: 10787 - DNA, 20 bp, Artificial
  CRISPR gRNA sequence
gagatcacgccactgcagtc

SEQ ID NO: 10788 - DNA, 20 bp, Artificial
  CRISPR gRNA sequence
cacgccactgcagtccagct

SEQ ID NO: 10789 - DNA, 20 bp, Artificial
  CRISPR gRNA sequence
ctgcagtccagcttggatga

SEQ ID NO: 10790 - DNA, 20 bp, Artificial
  CRISPR gRNA sequence
gcagtccagcttggatgaca

SEQ ID NO: 10791 - DNA, 20 bp, Artificial
  CRISPR gRNA sequence
tccagcttggatgacagagt

SEQ ID NO: 10792 - DNA, 20 bp, Artificial
  CRISPR gRNA sequence
taaataaataaataaataaa

SEQ ID NO: 10793 - DNA, 20 bp, Artificial
  CRISPR gRNA sequence
atagaactccattcccctca

SEQ ID NO: 10794 - DNA, 20 bp, Artificial
  CRISPR gRNA sequence
ttccatatgattcattgtct

SEQ ID NO: 10795 - DNA, 20 bp, Artificial
  CRISPR gRNA sequence
tgattcattgtctcagacat

SEQ ID NO: 10796 - DNA, 20 bp, Artificial
  CRISPR gRNA sequence
tatctgtctatcttcccccc

SEQ ID NO: 10797 - DNA, 20 bp, Artificial
  CRISPR gRNA sequence
tatcttcccccctggaatgt

SEQ ID NO: 10798 - DNA, 20 bp, Artificial
  CRISPR gRNA sequence
ccccctggaatgtcagcacc

SEQ ID NO: 10799 - DNA, 20 bp, Artificial
  CRISPR gRNA sequence
cctggaatgtcagcacccag

SEQ ID NO: 10800 - DNA, 20 bp, Artificial
  CRISPR gRNA sequence
ctggaatgtcagcacccaga

SEQ ID NO: 10801 - DNA, 20 bp, Artificial
  CRISPR gRNA sequence
gaatgtcagcacccagaagg

SEQ ID NO: 10802 - DNA, 20 bp, Artificial
  CRISPR gRNA sequence
aatgtcagcacccagaaggc

SEQ ID NO: 10803 - DNA, 20 bp, Artificial
  CRISPR gRNA sequence
atgtcagcacccagaaggca

SEQ ID NO: 10804 - DNA, 20 bp, Artificial
  CRISPR gRNA sequence
ggcagggattttcgtctgtt

SEQ ID NO: 10805 - DNA, 20 bp, Artificial
  CRISPR gRNA sequence
tggcccacaactttcctccc

SEQ ID NO: 10806 - DNA, 20 bp, Artificial
  CRISPR gRNA sequence
ggcccacaactttcctccct

SEQ ID NO: 10807 - DNA, 20 bp, Artificial
  CRISPR gRNA sequence
acaactttcctccctgggcc

SEQ ID NO: 10808 - DNA, 20 bp, Artificial
  CRISPR gRNA sequence
tcctccctgggcctggcaca

SEQ ID NO: 10809 - DNA, 20 bp, Artificial
  CRISPR gRNA sequence
tccctgggcctggcacatag

SEQ ID NO: 10810 - DNA, 20 bp, Artificial
  CRISPR gRNA sequence
ccctgggcctggcacatagt

SEQ ID NO: 10811 - DNA, 20 bp, Artificial
  CRISPR gRNA sequence
gggcctggcacatagtaggc

SEQ ID NO: 10812 - DNA, 20 bp, Artificial
  CRISPR gRNA sequence
cctggcacatagtaggcaag

SEQ ID NO: 10813 - DNA, 20 bp, Artificial
  CRISPR gRNA sequence
aacaacgaatgccttaatcc

SEQ ID NO: 10814 - DNA, 20 bp, Artificial
  CRISPR gRNA sequence
cttaatccaagaacccccat

SEQ ID NO: 10815 - DNA, 20 bp, Artificial
  CRISPR gRNA sequence
tccaagaacccccataagat

SEQ ID NO: 10816 - DNA, 20 bp, Artificial
  CRISPR gRNA sequence
ccaagaacccccataagatt

SEQ ID NO: 10817 - DNA, 20 bp, Artificial
  CRISPR gRNA sequence
caagaacccccataagattg

SEQ ID NO: 10818 - DNA, 20 bp, Artificial
  CRISPR gRNA sequence
aagattggggtgaaatattt

SEQ ID NO: 10819 - DNA, 20 bp, Artificial
  CRISPR gRNA sequence
agattggggtgaaatatttg

SEQ ID NO: 10820 - DNA, 20 bp, Artificial
  CRISPR gRNA sequence
attggggtgaaatatttgag

SEQ ID NO: 10821 - DNA, 20 bp, Artificial
  CRISPR gRNA sequence
gtgaaatatttgaggagatc

SEQ ID NO: 10822 - DNA, 20 bp, Artificial
  CRISPR gRNA sequence
atttgaggagatcaagactt

SEQ ID NO: 10823 - DNA, 20 bp, Artificial
  CRISPR gRNA sequence
tttgaggagatcaagactta

SEQ ID NO: 10824 - DNA, 20 bp, Artificial
  CRISPR gRNA sequence
ttgaggagatcaagacttaa

SEQ ID NO: 10825 - DNA, 20 bp, Artificial
  CRISPR gRNA sequence
gagatcaagacttaagggtg

SEQ ID NO: 10826 - DNA, 20 bp, Artificial
  CRISPR gRNA sequence
agatcaagacttaagggtga

SEQ ID NO: 10827 - DNA, 20 bp, Artificial
  CRISPR gRNA sequence
gatcaagacttaagggtgaa

SEQ ID NO: 10828 - DNA, 20 bp, Artificial
  CRISPR gRNA sequence
taagggtgaagggatttgcc

SEQ ID NO: 10829 - DNA, 20 bp, Artificial
  CRISPR gRNA sequence
aagggtgaagggatttgcca

SEQ ID NO: 10830 - DNA, 20 bp, Artificial
  CRISPR gRNA sequence
aagggatttgccaaggcctt

SEQ ID NO: 10831 - DNA, 20 bp, Artificial
  CRISPR gRNA sequence
ggatttgccaaggcctttag

SEQ ID NO: 10832 - DNA, 20 bp, Artificial
  CRISPR gRNA sequence
gatttgccaaggcctttagc

SEQ ID NO: 10833 - DNA, 20 bp, Artificial
  CRISPR gRNA sequence
atttgccaaggcctttagca

SEQ ID NO: 10834 - DNA, 20 bp, Artificial
  CRISPR gRNA sequence
ttgccaaggcctttagcagg

SEQ ID NO: 10835 - DNA, 20 bp, Artificial
  CRISPR gRNA sequence
tttagcagggagccaaatgc

SEQ ID NO: 10836 - DNA, 20 bp, Artificial
  CRISPR gRNA sequence
gggagccaaatgccagatcc

SEQ ID NO: 10837 - DNA, 20 bp, Artificial
  CRISPR gRNA sequence
gagccaaatgccagatcctg

SEQ ID NO: 10838 - DNA, 20 bp, Artificial
  CRISPR gRNA sequence
ggagtcaaactctgatcctg

SEQ ID NO: 10839 - DNA, 20 bp, Artificial
  CRISPR gRNA sequence
tgatcctgtggccttttgct

SEQ ID NO: 10840 - DNA, 20 bp, Artificial
  CRISPR gRNA sequence
gatcctgtggccttttgctg

SEQ ID NO: 10841 - DNA, 20 bp, Artificial
  CRISPR gRNA sequence
ctgtggccttttgctgaggc

SEQ ID NO: 10842 - DNA, 20 bp, Artificial
  CRISPR gRNA sequence
tttgctgaggccagtgttct

SEQ ID NO: 10843 - DNA, 20 bp, Artificial
  CRISPR gRNA sequence
aggccagtgttctcagactt

SEQ ID NO: 10844 - DNA, 20 bp, Artificial
  CRISPR gRNA sequence
ggccagtgttctcagacttc

SEQ ID NO: 10845 - DNA, 20 bp, Artificial
  CRISPR gRNA sequence
gttctcagacttcaggattt

SEQ ID NO: 10846 - DNA, 20 bp, Artificial
  CRISPR gRNA sequence
tctcagacttcaggatttca

SEQ ID NO: 10847 - DNA, 20 bp, Artificial
  CRISPR gRNA sequence
ctcagacttcaggatttcag

SEQ ID NO: 10848 - DNA, 20 bp, Artificial
  CRISPR gRNA sequence
acttcaggatttcagaggcc

SEQ ID NO: 10849 - DNA, 20 bp, Artificial
  CRISPR gRNA sequence
ttcagaggccgagaacattt

SEQ ID NO: 10850 - DNA, 20 bp, Artificial
  CRISPR gRNA sequence
gaacatttcggaatgaattc

SEQ ID NO: 10851 - DNA, 20 bp, Artificial
  CRISPR gRNA sequence
tgaattcgagtgaccgtgcg

SEQ ID NO: 10852 - DNA, 20 bp, Artificial
  CRISPR gRNA sequence
actgttttttaatgtttatc

SEQ ID NO: 10853 - DNA, 20 bp, Artificial
  CRISPR gRNA sequence
ctgttttttaatgtttatca

SEQ ID NO: 10854 - DNA, 20 bp, Artificial
  CRISPR gRNA sequence
aacaacaaaatacccactgc

SEQ ID NO: 10855 - DNA, 20 bp, Artificial
  CRISPR gRNA sequence
ctggcaccataattttacca

SEQ ID NO: 10856 - DNA, 20 bp, Artificial
  CRISPR gRNA sequence
tgatcattctaatattgaaa

SEQ ID NO: 10857 - DNA, 20 bp, Artificial
  CRISPR gRNA sequence
tctaatattgaaaaagttca

SEQ ID NO: 10858 - DNA, 20 bp, Artificial
  CRISPR gRNA sequence
ctaatattgaaaaagttcaa

SEQ ID NO: 10859 - DNA, 20 bp, Artificial
  CRISPR gRNA sequence
aagttcaaaggacataattg

SEQ ID NO: 10860 - DNA, 20 bp, Artificial
  CRISPR gRNA sequence
aggacataattgcagaataa

SEQ ID NO: 10861 - DNA, 20 bp, Artificial
  CRISPR gRNA sequence
cataattgcagaataaaaga

SEQ ID NO: 10862 - DNA, 20 bp, Artificial
  CRISPR gRNA sequence
ataaaagacagctctttata

SEQ ID NO: 10863 - DNA, 20 bp, Artificial
  CRISPR gRNA sequence
aaccatatttttaaactaaa

SEQ ID NO: 10864 - DNA, 20 bp, Artificial
  CRISPR gRNA sequence
ttatttttctcatccccttg

SEQ ID NO: 10865 - DNA, 20 bp, Artificial
  CRISPR gRNA sequence
gtctgctctaaatgttgatc

SEQ ID NO: 10866 - DNA, 20 bp, Artificial
  CRISPR gRNA sequence
tctgctctaaatgttgatcc

SEQ ID NO: 10867 - DNA, 20 bp, Artificial
  CRISPR gRNA sequence
caggctgtgtgaccctgtgt

SEQ ID NO: 10868 - DNA, 20 bp, Artificial
  CRISPR gRNA sequence
gtgtgagctatttgatcgcc

SEQ ID NO: 10869 - DNA, 20 bp, Artificial
  CRISPR gRNA sequence
tatttgatcgcctagtgcct

SEQ ID NO: 10870 - DNA, 20 bp, Artificial
  CRISPR gRNA sequence
cagtttccctatatgtaaaa

SEQ ID NO: 10871 - DNA, 20 bp, Artificial
  CRISPR gRNA sequence
gtttccctatatgtaaaatg

SEQ ID NO: 10872 - DNA, 20 bp, Artificial
  CRISPR gRNA sequence
cctatatgtaaaatggagat

SEQ ID NO: 10873 - DNA, 20 bp, Artificial
  CRISPR gRNA sequence
tatatgtaaaatggagataa

SEQ ID NO: 10874 - DNA, 20 bp, Artificial
  CRISPR gRNA sequence
aaaatggagataagagccca

SEQ ID NO: 10875 - DNA, 20 bp, Artificial
  CRISPR gRNA sequence
ggagataagagcccatagct

SEQ ID NO: 10876 - DNA, 20 bp, Artificial
  CRISPR gRNA sequence
agataagagcccatagctca

SEQ ID NO: 10877 - DNA, 20 bp, Artificial
  CRISPR gRNA sequence
agcccatagctcagagtctt

SEQ ID NO: 10878 - DNA, 20 bp, Artificial
  CRISPR gRNA sequence
gcccatagctcagagtcttg

SEQ ID NO: 10879 - DNA, 20 bp, Artificial
  CRISPR gRNA sequence
ccatagctcagagtcttgag

SEQ ID NO: 10880 - DNA, 20 bp, Artificial
  CRISPR gRNA sequence
cagagtcttgaggagtaaat

SEQ ID NO: 10881 - DNA, 20 bp, Artificial
  CRISPR gRNA sequence
cttgaggagtaaatgagatc

SEQ ID NO: 10882 - DNA, 20 bp, Artificial
  CRISPR gRNA sequence
ttgaggagtaaatgagatct

SEQ ID NO: 10883 - DNA, 20 bp, Artificial
  CRISPR gRNA sequence
gagtaaatgagatctaggcc

SEQ ID NO: 10884 - DNA, 20 bp, Artificial
  CRISPR gRNA sequence
agtaaatgagatctaggccg

SEQ ID NO: 10885 - DNA, 20 bp, Artificial
  CRISPR gRNA sequence
gtaaatgagatctaggccga

SEQ ID NO: 10886 - DNA, 20 bp, Artificial
  CRISPR gRNA sequence
aatgagatctaggccgaggg

SEQ ID NO: 10887 - DNA, 20 bp, Artificial
  CRISPR gRNA sequence
atgagatctaggccgaggga

SEQ ID NO: 10888 - DNA, 20 bp, Artificial
  CRISPR gRNA sequence
tgagatctaggccgagggaa

SEQ ID NO: 10889 - DNA, 20 bp, Artificial
  CRISPR gRNA sequence
tctaggccgagggaagggcc

SEQ ID NO: 10890 - DNA, 20 bp, Artificial
  CRISPR gRNA sequence
ggaagggcctagcatgcccc

SEQ ID NO: 10891 - DNA, 20 bp, Artificial
  CRISPR gRNA sequence
tataataaatgctcaacaaa

SEQ ID NO: 10892 - DNA, 20 bp, Artificial
  CRISPR gRNA sequence
ccttttgttattaaaatgca

SEQ ID NO: 10893 - DNA, 20 bp, Artificial
  CRISPR gRNA sequence
cttttgttattaaaatgcaa

SEQ ID NO: 10894 - DNA, 20 bp, Artificial
  CRISPR gRNA sequence
attaaaatgcaaaggcatat

SEQ ID NO: 10895 - DNA, 20 bp, Artificial
  CRISPR gRNA sequence
aggcatattagtcaaccacc

SEQ ID NO: 10896 - DNA, 20 bp, Artificial
  CRISPR gRNA sequence
tcaaccacctggtttaccac

SEQ ID NO: 10897 - DNA, 20 bp, Artificial
  CRISPR gRNA sequence
accacctggtttaccactgg

SEQ ID NO: 10898 - DNA, 20 bp, Artificial
  CRISPR gRNA sequence
acctggtttaccactggcag

SEQ ID NO: 10899 - DNA, 20 bp, Artificial
  CRISPR gRNA sequence
ttaccactggcagtggtcgt

SEQ ID NO: 10900 - DNA, 20 bp, Artificial
  CRISPR gRNA sequence
cactggcagtggtcgtcagc

SEQ ID NO: 10901 - DNA, 20 bp, Artificial
  CRISPR gRNA sequence
gtggtcgtcagctggcattt

SEQ ID NO: 10902 - DNA, 20 bp, Artificial
  CRISPR gRNA sequence
tggtcgtcagctggcatttc

SEQ ID NO: 10903 - DNA, 20 bp, Artificial
  CRISPR gRNA sequence
gcatttcaggaccccttccc

SEQ ID NO: 10904 - DNA, 20 bp, Artificial
  CRISPR gRNA sequence
catttcaggaccccttcccc

SEQ ID NO: 10905 - DNA, 20 bp, Artificial
  CRISPR gRNA sequence
aggaccccttccccaggctg

SEQ ID NO: 10906 - DNA, 20 bp, Artificial
  CRISPR gRNA sequence
accccttccccaggctgcgg

SEQ ID NO: 10907 - DNA, 20 bp, Artificial
  CRISPR gRNA sequence
ccccttccccaggctgcggc

SEQ ID NO: 10908 - DNA, 20 bp, Artificial
  CRISPR gRNA sequence
ccttccccaggctgcggcgg

SEQ ID NO: 10909 - DNA, 20 bp, Artificial
  CRISPR gRNA sequence
tccccaggctgcggcgggag

SEQ ID NO: 10910 - DNA, 20 bp, Artificial
  CRISPR gRNA sequence
ccccaggctgcggcgggaga

SEQ ID NO: 10911 - DNA, 20 bp, Artificial
  CRISPR gRNA sequence
cccaggctgcggcgggagaa

SEQ ID NO: 10912 - DNA, 20 bp, Artificial
  CRISPR gRNA sequence
cggcgggagaagggtatctg

SEQ ID NO: 10913 - DNA, 20 bp, Artificial
  CRISPR gRNA sequence
agaagggtatctgtggatgt

SEQ ID NO: 10914 - DNA, 20 bp, Artificial
  CRISPR gRNA sequence
gaagggtatctgtggatgtt

SEQ ID NO: 10915 - DNA, 20 bp, Artificial
  CRISPR gRNA sequence
gggtatctgtggatgttggg

SEQ ID NO: 10916 - DNA, 20 bp, Artificial
  CRISPR gRNA sequence
gtatctgtggatgttgggaa

SEQ ID NO: 10917 - DNA, 20 bp, Artificial
  CRISPR gRNA sequence
ctgtggatgttgggaagagt

SEQ ID NO: 10918 - DNA, 20 bp, Artificial
  CRISPR gRNA sequence
atgttgggaagagtaagaac

SEQ ID NO: 10919 - DNA, 20 bp, Artificial
  CRISPR gRNA sequence
gtaagaactggctccctact

SEQ ID NO: 10920 - DNA, 20 bp, Artificial
  CRISPR gRNA sequence
aagaactggctccctactta

SEQ ID NO: 10921 - DNA, 20 bp, Artificial
  CRISPR gRNA sequence
ggctccctacttagagacaa

SEQ ID NO: 10922 - DNA, 20 bp, Artificial
  CRISPR gRNA sequence
ccctacttagagacaaaagc

SEQ ID NO: 10923 - DNA, 20 bp, Artificial
  CRISPR gRNA sequence
cctacttagagacaaaagct

SEQ ID NO: 10924 - DNA, 20 bp, Artificial
  CRISPR gRNA sequence
ctacttagagacaaaagctg

SEQ ID NO: 10925 - DNA, 20 bp, Artificial
  CRISPR gRNA sequence
acttagagacaaaagctggg

SEQ ID NO: 10926 - DNA, 20 bp, Artificial
  CRISPR gRNA sequence
gacaaaagctggggagcccc

SEQ ID NO: 10927 - DNA, 20 bp, Artificial
  CRISPR gRNA sequence
aaagctggggagccccaaga

SEQ ID NO: 10928 - DNA, 20 bp, Artificial
  CRISPR gRNA sequence
aagctggggagccccaagat

SEQ ID NO: 10929 - DNA, 20 bp, Artificial
  CRISPR gRNA sequence
gctggggagccccaagatgg

SEQ ID NO: 10930 - DNA, 20 bp, Artificial
  CRISPR gRNA sequence
ttttgttttttttctttttt

SEQ ID NO: 10931 - DNA, 20 bp, Artificial
  CRISPR gRNA sequence
gttttttttcttttttgaga

SEQ ID NO: 10932 - DNA, 20 bp, Artificial
  CRISPR gRNA sequence
ttttttttcttttttgagac

SEQ ID NO: 10933 - DNA, 20 bp, Artificial
  CRISPR gRNA sequence
tttttttcttttttgagaca

SEQ ID NO: 10934 - DNA, 20 bp, Artificial
  CRISPR gRNA sequence
gacagggtctcgctcttacc

SEQ ID NO: 10935 - DNA, 20 bp, Artificial
  CRISPR gRNA sequence
acagggtctcgctcttaccc

SEQ ID NO: 10936 - DNA, 20 bp, Artificial
  CRISPR gRNA sequence
ggtctcgctcttacccaggc

SEQ ID NO: 10937 - DNA, 20 bp, Artificial
  CRISPR gRNA sequence
tctcgctcttacccaggctg

SEQ ID NO: 10938 - DNA, 20 bp, Artificial
  CRISPR gRNA sequence
ctcttacccaggctggagtg

SEQ ID NO: 10939 - DNA, 20 bp, Artificial
  CRISPR gRNA sequence
ttacccaggctggagtgcag

SEQ ID NO: 10940 - DNA, 20 bp, Artificial
  CRISPR gRNA sequence
ggagtgcagtggtgtgatca

SEQ ID NO: 10941 - DNA, 20 bp, Artificial
  CRISPR gRNA sequence
tcactgcatcctccacctcc

SEQ ID NO: 10942 - DNA, 20 bp, Artificial
  CRISPR gRNA sequence
cactgcatcctccacctcct

SEQ ID NO: 10943 - DNA, 20 bp, Artificial
  CRISPR gRNA sequence
atcctccacctcctgggctc

SEQ ID NO: 10944 - DNA, 20 bp, Artificial
  CRISPR gRNA sequence
ctcaagcgatgcttccacct

SEQ ID NO: 10945 - DNA, 20 bp, Artificial
  CRISPR gRNA sequence
tgcttccacctcagcctcct

SEQ ID NO: 10946 - DNA, 20 bp, Artificial
  CRISPR gRNA sequence
ttccacctcagcctcctaag

SEQ ID NO: 10947 - DNA, 20 bp, Artificial
  CRISPR gRNA sequence
cctcagcctcctaagaagct

SEQ ID NO: 10948 - DNA, 20 bp, Artificial
  CRISPR gRNA sequence
ctcctaagaagctgagacca

SEQ ID NO: 10949 - DNA, 20 bp, Artificial
  CRISPR gRNA sequence
tcctaagaagctgagaccac

SEQ ID NO: 10950 - DNA, 20 bp, Artificial
  CRISPR gRNA sequence
acaggacacaccaccacact

SEQ ID NO: 10951 - DNA, 20 bp, Artificial
  CRISPR gRNA sequence
gctaattattgtgttttttg

SEQ ID NO: 10952 - DNA, 20 bp, Artificial
  CRISPR gRNA sequence
taattattgtgttttttgta

SEQ ID NO: 10953 - DNA, 20 bp, Artificial
  CRISPR gRNA sequence
ttgtgttttttgtagagact

SEQ ID NO: 10954 - DNA, 20 bp, Artificial
  CRISPR gRNA sequence
tgagtctcactatgttgccc

SEQ ID NO: 10955 - DNA, 20 bp, Artificial
  CRISPR gRNA sequence
tctcactatgttgcccaagc

SEQ ID NO: 10956 - DNA, 20 bp, Artificial
  CRISPR gRNA sequence
ccaagctggtcttgaactcc

SEQ ID NO: 10957 - DNA, 20 bp, Artificial
  CRISPR gRNA sequence
caagctggtcttgaactcct

SEQ ID NO: 10958 - DNA, 20 bp, Artificial
  CRISPR gRNA sequence
ggtcttgaactcctgggctc

SEQ ID NO: 10959 - DNA, 20 bp, Artificial
  CRISPR gRNA sequence
cttgaactcctgggctcaag

SEQ ID NO: 10960 - DNA, 20 bp, Artificial
  CRISPR gRNA sequence
ctcaagcagtcctcttacct

SEQ ID NO: 10961 - DNA, 20 bp, Artificial
  CRISPR gRNA sequence
accttggcctcccaaaatgc

SEQ ID NO: 10962 - DNA, 20 bp, Artificial
  CRISPR gRNA sequence
ctcccaaaatgctggaatta

SEQ ID NO: 10963 - DNA, 20 bp, Artificial
  CRISPR gRNA sequence
aatgctggaattacagacat

SEQ ID NO: 10964 - DNA, 20 bp, Artificial
  CRISPR gRNA sequence
cagacatgagccactgttcc

SEQ ID NO: 10965 - DNA, 20 bp, Artificial
  CRISPR gRNA sequence
ccactgttcccagcctcaac

SEQ ID NO: 10966 - DNA, 20 bp, Artificial
  CRISPR gRNA sequence
cagcctcaactggcctctta

SEQ ID NO: 10967 - DNA, 20 bp, Artificial
  CRISPR gRNA sequence
agcctcaactggcctcttat

SEQ ID NO: 10968 - DNA, 20 bp, Artificial
  CRISPR gRNA sequence
gcctcaactggcctcttatg

SEQ ID NO: 10969 - DNA, 20 bp, Artificial
  CRISPR gRNA sequence
cctcaactggcctcttatgg

SEQ ID NO: 10970 - DNA, 20 bp, Artificial
  CRISPR gRNA sequence
ctcaactggcctcttatggg

SEQ ID NO: 10971 - DNA, 20 bp, Artificial
  CRISPR gRNA sequence
ggggctatgaaatctacccc

SEQ ID NO: 10972 - DNA, 20 bp, Artificial
  CRISPR gRNA sequence
gctatgaaatctaccccaag

SEQ ID NO: 10973 - DNA, 20 bp, Artificial
  CRISPR gRNA sequence
gaaatctaccccaagcagaa

SEQ ID NO: 10974 - DNA, 20 bp, Artificial
  CRISPR gRNA sequence
ctaccccaagcagaaaagat

SEQ ID NO: 10975 - DNA, 20 bp, Artificial
  CRISPR gRNA sequence
taccccaagcagaaaagatt

SEQ ID NO: 10976 - DNA, 20 bp, Artificial
  CRISPR gRNA sequence
accccaagcagaaaagattg

SEQ ID NO: 10977 - DNA, 20 bp, Artificial
  CRISPR gRNA sequence
gaaaagattggggtcctacg

SEQ ID NO: 10978 - DNA, 20 bp, Artificial
  CRISPR gRNA sequence
aagattggggtcctacgtgg

SEQ ID NO: 10979 - DNA, 20 bp, Artificial
  CRISPR gRNA sequence
agattggggtcctacgtgga

SEQ ID NO: 10980 - DNA, 20 bp, Artificial
  CRISPR gRNA sequence
gattggggtcctacgtggaa

SEQ ID NO: 10981 - DNA, 20 bp, Artificial
  CRISPR gRNA sequence
ggtcctacgtggaagggttg

SEQ ID NO: 10982 - DNA, 20 bp, Artificial
  CRISPR gRNA sequence
gtcctacgtggaagggttgc

SEQ ID NO: 10983 - DNA, 20 bp, Artificial
  CRISPR gRNA sequence
tcctacgtggaagggttgca

SEQ ID NO: 10984 - DNA, 20 bp, Artificial
  CRISPR gRNA sequence
tggaagggttgcagggacct

SEQ ID NO: 10985 - DNA, 20 bp, Artificial
  CRISPR gRNA sequence
gaagggttgcagggacctaa

SEQ ID NO: 10986 - DNA, 20 bp, Artificial
  CRISPR gRNA sequence
aagggttgcagggacctaag

SEQ ID NO: 10987 - DNA, 20 bp, Artificial
  CRISPR gRNA sequence
gttgcagggacctaagaggc

SEQ ID NO: 10988 - DNA, 20 bp, Artificial
  CRISPR gRNA sequence
ttgcagggacctaagaggct

SEQ ID NO: 10989 - DNA, 20 bp, Artificial
  CRISPR gRNA sequence
tgcagggacctaagaggctg

SEQ ID NO: 10990 - DNA, 20 bp, Artificial
  CRISPR gRNA sequence
agggacctaagaggctgggg

SEQ ID NO: 10991 - DNA, 20 bp, Artificial
  CRISPR gRNA sequence
gacctaagaggctggggtgg

SEQ ID NO: 10992 - DNA, 20 bp, Artificial
  CRISPR gRNA sequence
acctaagaggctggggtgga

SEQ ID NO: 10993 - DNA, 20 bp, Artificial
  CRISPR gRNA sequence
cctaagaggctggggtggaa

SEQ ID NO: 10994 - DNA, 20 bp, Artificial
  CRISPR gRNA sequence
aagaggctggggtggaaggg

SEQ ID NO: 10995 - DNA, 20 bp, Artificial
  CRISPR gRNA sequence
gaggctggggtggaagggaa

SEQ ID NO: 10996 - DNA, 20 bp, Artificial
  CRISPR gRNA sequence
aggctggggtggaagggaag

SEQ ID NO: 10997 - DNA, 20 bp, Artificial
  CRISPR gRNA sequence
gctggggtggaagggaagag

SEQ ID NO: 10998 - DNA, 20 bp, Artificial
  CRISPR gRNA sequence
ctggggtggaagggaagagg

SEQ ID NO: 10999 - DNA, 20 bp, Artificial
  CRISPR gRNA sequence
tggggtggaagggaagagga

SEQ ID NO: 11000 - DNA, 20 bp, Artificial
  CRISPR gRNA sequence
ggggtggaagggaagaggag

SEQ ID NO: 11001 - DNA, 20 bp, Artificial
  CRISPR gRNA sequence
gaagggaagaggaggggcct

SEQ ID NO: 11002 - DNA, 20 bp, Artificial
  CRISPR gRNA sequence
ggaagaggaggggcctcaga

SEQ ID NO: 11003 - DNA, 20 bp, Artificial
  CRISPR gRNA sequence
gaagaggaggggcctcagac

SEQ ID NO: 11004 - DNA, 20 bp, Artificial
  CRISPR gRNA sequence
gccttgtctctgccccaccc

SEQ ID NO: 11005 - DNA, 20 bp, Artificial
  CRISPR gRNA sequence
ccttgtctctgccccaccct

SEQ ID NO: 11006 - DNA, 20 bp, Artificial
  CRISPR gRNA sequence
cttgtctctgccccaccctg

SEQ ID NO: 11007 - DNA, 20 bp, Artificial
  CRISPR gRNA sequence
gccccaccctggggctgaat

SEQ ID NO: 11008 - DNA, 20 bp, Artificial
  CRISPR gRNA sequence
ccccaccctggggctgaatg

SEQ ID NO: 11009 - DNA, 20 bp, Artificial
  CRISPR gRNA sequence
cccaccctggggctgaatga

SEQ ID NO: 11010 - DNA, 20 bp, Artificial
  CRISPR gRNA sequence
ccaccctggggctgaatgag

SEQ ID NO: 11011 - DNA, 20 bp, Artificial
  CRISPR gRNA sequence
tgaggggctgtgactgtgac

SEQ ID NO: 11012 - DNA, 20 bp, Artificial
  CRISPR gRNA sequence
aggggctgtgactgtgactg

SEQ ID NO: 11013 - DNA, 20 bp, Artificial
  CRISPR gRNA sequence
ggggctgtgactgtgactgg

SEQ ID NO: 11014 - DNA, 20 bp, Artificial
  CRISPR gRNA sequence
tacccttgctctttgcctcc

SEQ ID NO: 11015 - DNA, 20 bp, Artificial
  CRISPR gRNA sequence
acccttgctctttgcctcct

SEQ ID NO: 11016 - DNA, 20 bp, Artificial
  CRISPR gRNA sequence
ttgctctttgcctcctaggc

SEQ ID NO: 11017 - DNA, 20 bp, Artificial
  CRISPR gRNA sequence
tgctctttgcctcctaggct

SEQ ID NO: 11018 - DNA, 20 bp, Artificial
  CRISPR gRNA sequence
tcctaggctgggccctgtct

SEQ ID NO: 11019 - DNA, 20 bp, Artificial
  CRISPR gRNA sequence
cctaggctgggccctgtctc

SEQ ID NO: 11020 - DNA, 20 bp, Artificial
  CRISPR gRNA sequence
tgggccctgtctcaggcccc

SEQ ID NO: 11021 - DNA, 20 bp, Artificial
  CRISPR gRNA sequence
gggccctgtctcaggccccc

SEQ ID NO: 11022 - DNA, 20 bp, Artificial
  CRISPR gRNA sequence
cccccaggctttccccaaac

SEQ ID NO: 11023 - DNA, 20 bp, Artificial
  CRISPR gRNA sequence
aggctttccccaaactggtg

SEQ ID NO: 11024 - DNA, 20 bp, Artificial
  CRISPR gRNA sequence
caaactggtgcggatcctca

SEQ ID NO: 11025 - DNA, 20 bp, Artificial
  CRISPR gRNA sequence
tcacggccttttcctccctg

SEQ ID NO: 11026 - DNA, 20 bp, Artificial
  CRISPR gRNA sequence
cttttcctccctgcagcatc

SEQ ID NO: 11027 - DNA, 20 bp, Artificial
  CRISPR gRNA sequence
tttcctccctgcagcatctg

SEQ ID NO: 11028 - DNA, 20 bp, Artificial
  CRISPR gRNA sequence
ctccctgcagcatctggagt

SEQ ID NO: 11029 - DNA, 20 bp, Artificial
  CRISPR gRNA sequence
tgcagcatctggagtgagta

SEQ ID NO: 11030 - DNA, 20 bp, Artificial
  CRISPR gRNA sequence
tctggagtgagtatagactc

SEQ ID NO: 11031 - DNA, 20 bp, Artificial
  CRISPR gRNA sequence
ctggagtgagtatagactct

SEQ ID NO: 11032 - DNA, 20 bp, Artificial
  CRISPR gRNA sequence
gaccccttcctctcaacatc

SEQ ID NO: 11033 - DNA, 20 bp, Artificial
  CRISPR gRNA sequence
accccttcctctcaacatct

SEQ ID NO: 11034 - DNA, 20 bp, Artificial
  CRISPR gRNA sequence
ttcctctcaacatctgggtg

SEQ ID NO: 11035 - DNA, 20 bp, Artificial
  CRISPR gRNA sequence
tgggtgcagtgctgtgatca

SEQ ID NO: 11036 - DNA, 20 bp, Artificial
  CRISPR gRNA sequence
gctgtgatcatagctcactg

SEQ ID NO: 11037 - DNA, 20 bp, Artificial
  CRISPR gRNA sequence
tcactgcagcctcgaattcc

SEQ ID NO: 11038 - DNA, 20 bp, Artificial
  CRISPR gRNA sequence
agcctcgaattcctggcctc

SEQ ID NO: 11039 - DNA, 20 bp, Artificial
  CRISPR gRNA sequence
ctcgaattcctggcctcaag

SEQ ID NO: 11040 - DNA, 20 bp, Artificial
  CRISPR gRNA sequence
ctcaagtagtcctcctgcct

SEQ ID NO: 11041 - DNA, 20 bp, Artificial
  CRISPR gRNA sequence
tcctcctgcctcagcctcct

SEQ ID NO: 11042 - DNA, 20 bp, Artificial
  CRISPR gRNA sequence
tcctgcctcagcctcctgag

SEQ ID NO: 11043 - DNA, 20 bp, Artificial
  CRISPR gRNA sequence
gcctcagcctcctgagtagc

SEQ ID NO: 11044 - DNA, 20 bp, Artificial
  CRISPR gRNA sequence
cctcagcctcctgagtagct

SEQ ID NO: 11045 - DNA, 20 bp, Artificial
  CRISPR gRNA sequence
ctcctgagtagctgggacca

SEQ ID NO: 11046 - DNA, 20 bp, Artificial
  CRISPR gRNA sequence
tcctgagtagctgggaccac

SEQ ID NO: 11047 - DNA, 20 bp, Artificial
  CRISPR gRNA sequence
gggaccacaggtgcatgcta

SEQ ID NO: 11048 - DNA, 20 bp, Artificial
  CRISPR gRNA sequence
caggtgcatgctacagtgcc

SEQ ID NO: 11049 - DNA, 20 bp, Artificial
  CRISPR gRNA sequence
ctacagtgcccagcaacctc

SEQ ID NO: 11050 - DNA, 20 bp, Artificial
  CRISPR gRNA sequence
tacagtgcccagcaacctct

SEQ ID NO: 11051 - DNA, 20 bp, Artificial
  CRISPR gRNA sequence
caaccccaaatcctgccccc

SEQ ID NO: 11052 - DNA, 20 bp, Artificial
  CRISPR gRNA sequence
aaccccaaatcctgccccca

SEQ ID NO: 11053 - DNA, 20 bp, Artificial
  CRISPR gRNA sequence
tcctgcccccaaggcacctg

SEQ ID NO: 11054 - DNA, 20 bp, Artificial
  CRISPR gRNA sequence
gcccccaaggcacctgcaga

SEQ ID NO: 11055 - DNA, 20 bp, Artificial
  CRISPR gRNA sequence
caaggcacctgcagaaagaa

SEQ ID NO: 11056 - DNA, 20 bp, Artificial
  CRISPR gRNA sequence
cgcctactgcatcctcaatg

SEQ ID NO: 11057 - DNA, 20 bp, Artificial
  CRISPR gRNA sequence
tactgcatcctcaatgtggc

SEQ ID NO: 11058 - DNA, 20 bp, Artificial
  CRISPR gRNA sequence
cctcaatgtggctggcacat

SEQ ID NO: 11059 - DNA, 20 bp, Artificial
  CRISPR gRNA sequence
gtggctggcacatgagtgat

SEQ ID NO: 11060 - DNA, 20 bp, Artificial
  CRISPR gRNA sequence
gtgatgagatgacgccacat

SEQ ID NO: 11061 - DNA, 20 bp, Artificial
  CRISPR gRNA sequence
tgagatgacgccacatcaga

SEQ ID NO: 11062 - DNA, 20 bp, Artificial
  CRISPR gRNA sequence
gagatgacgccacatcagat

SEQ ID NO: 11063 - DNA, 20 bp, Artificial
  CRISPR gRNA sequence
ccacatcagatgggaatccc

SEQ ID NO: 11064 - DNA, 20 bp, Artificial
  CRISPR gRNA sequence
ggaatccccagtgacaaaaa

SEQ ID NO: 11065 - DNA, 20 bp, Artificial
  CRISPR gRNA sequence
cccagtgacaaaaaaagttg

SEQ ID NO: 11066 - DNA, 20 bp, Artificial
  CRISPR gRNA sequence
acaacctcatttgctgctct

SEQ ID NO: 11067 - DNA, 20 bp, Artificial
  CRISPR gRNA sequence
atttgctgctctcagcaatt

SEQ ID NO: 11068 - DNA, 20 bp, Artificial
  CRISPR gRNA sequence
gctgctctcagcaattcagc

SEQ ID NO: 11069 - DNA, 20 bp, Artificial
  CRISPR gRNA sequence
ctgctctcagcaattcagct

SEQ ID NO: 11070 - DNA, 20 bp, Artificial
  CRISPR gRNA sequence
tgctctcagcaattcagctg

SEQ ID NO: 11071 - DNA, 20 bp, Artificial
  CRISPR gRNA sequence
ctctcagcaattcagctggg

SEQ ID NO: 11072 - DNA, 20 bp, Artificial
  CRISPR gRNA sequence
tctcagcaattcagctgggg

SEQ ID NO: 11073 - DNA, 20 bp, Artificial
  CRISPR gRNA sequence
ctcagcaattcagctgggga

SEQ ID NO: 11074 - DNA, 20 bp, Artificial
  CRISPR gRNA sequence
caattcagctggggagggat

SEQ ID NO: 11075 - DNA, 20 bp, Artificial
  CRISPR gRNA sequence
aattcagctggggagggatt

SEQ ID NO: 11076 - DNA, 20 bp, Artificial
  CRISPR gRNA sequence
attcagctggggagggattg

SEQ ID NO: 11077 - DNA, 20 bp, Artificial
  CRISPR gRNA sequence
tcagctggggagggattggg

SEQ ID NO: 11078 - DNA, 20 bp, Artificial
  CRISPR gRNA sequence
tggggagggattggggagca

SEQ ID NO: 11079 - DNA, 20 bp, Artificial
  CRISPR gRNA sequence
gggagcatagtcctacttta

SEQ ID NO: 11080 - DNA, 20 bp, Artificial
  CRISPR gRNA sequence
agcatagtcctactttacag

SEQ ID NO: 11081 - DNA, 20 bp, Artificial
  CRISPR gRNA sequence
catagtcctactttacagtg

SEQ ID NO: 11082 - DNA, 20 bp, Artificial
  CRISPR gRNA sequence
atagtcctactttacagtgg

SEQ ID NO: 11083 - DNA, 20 bp, Artificial
  CRISPR gRNA sequence
cctactttacagtggaggtt

SEQ ID NO: 11084 - DNA, 20 bp, Artificial
  CRISPR gRNA sequence
ctactttacagtggaggtta

SEQ ID NO: 11085 - DNA, 20 bp, Artificial
  CRISPR gRNA sequence
ctttacagtggaggttaagg

SEQ ID NO: 11086 - DNA, 20 bp, Artificial
  CRISPR gRNA sequence
tggaggttaaggaagttgcc

SEQ ID NO: 11087 - DNA, 20 bp, Artificial
  CRISPR gRNA sequence
ttaaggaagttgccaagcct

SEQ ID NO: 11088 - DNA, 20 bp, Artificial
  CRISPR gRNA sequence
taaggaagttgccaagcctc

SEQ ID NO: 11089 - DNA, 20 bp, Artificial
  CRISPR gRNA sequence
aaggaagttgccaagcctca

SEQ ID NO: 11090 - DNA, 20 bp, Artificial
  CRISPR gRNA sequence
aggaagttgccaagcctcag

SEQ ID NO: 11091 - DNA, 20 bp, Artificial
  CRISPR gRNA sequence
gttgccaagcctcaggggct

SEQ ID NO: 11092 - DNA, 20 bp, Artificial
  CRISPR gRNA sequence
gcctcaggggcttagttcct

SEQ ID NO: 11093 - DNA, 20 bp, Artificial
  CRISPR gRNA sequence
tcaggggcttagttcctaag

SEQ ID NO: 11094 - DNA, 20 bp, Artificial
  CRISPR gRNA sequence
ttagttcctaagaagctaaa

SEQ ID NO: 11095 - DNA, 20 bp, Artificial
  CRISPR gRNA sequence
tagttcctaagaagctaaac

SEQ ID NO: 11096 - DNA, 20 bp, Artificial
  CRISPR gRNA sequence
agttcctaagaagctaaaca

SEQ ID NO: 11097 - DNA, 20 bp, Artificial
  CRISPR gRNA sequence
aagaagctaaacagggattc

SEQ ID NO: 11098 - DNA, 20 bp, Artificial
  CRISPR gRNA sequence
cagggattcaagtccatcat

SEQ ID NO: 11099 - DNA, 20 bp, Artificial
  CRISPR gRNA sequence
gattcaagtccatcatgagt

SEQ ID NO: 11100 - DNA, 20 bp, Artificial
  CRISPR gRNA sequence
atgagttagactttgccctc

SEQ ID NO: 11101 - DNA, 20 bp, Artificial
  CRISPR gRNA sequence
gactttgccctctggctgcc

SEQ ID NO: 11102 - DNA, 20 bp, Artificial
  CRISPR gRNA sequence
ttgccctctggctgcctggt

SEQ ID NO: 11103 - DNA, 20 bp, Artificial
  CRISPR gRNA sequence
gccctctggctgcctggttg

SEQ ID NO: 11104 - DNA, 20 bp, Artificial
  CRISPR gRNA sequence
ggctgcctggttggagcccc

SEQ ID NO: 11105 - DNA, 20 bp, Artificial
  CRISPR gRNA sequence
gctgcctggttggagccccc

SEQ ID NO: 11106 - DNA, 20 bp, Artificial
  CRISPR gRNA sequence
gttggagcccccaggtgatg

SEQ ID NO: 11107 - DNA, 20 bp, Artificial
  CRISPR gRNA sequence
tgatgaagtcctcgtctgaa

SEQ ID NO: 11108 - DNA, 20 bp, Artificial
  CRISPR gRNA sequence
aagtcctcgtctgaaaagct

SEQ ID NO: 11109 - DNA, 20 bp, Artificial
  CRISPR gRNA sequence
agtcctcgtctgaaaagctc

SEQ ID NO: 11110 - DNA, 20 bp, Artificial
  CRISPR gRNA sequence
tgaaaagctcaggaatgtgc

SEQ ID NO: 11111 - DNA, 20 bp, Artificial
  CRISPR gRNA sequence
aggaatgtgccggctgccta

SEQ ID NO: 11112 - DNA, 20 bp, Artificial
  CRISPR gRNA sequence
gccggctgcctatggtgtat

SEQ ID NO: 11113 - DNA, 20 bp, Artificial
  CRISPR gRNA sequence
cggctgcctatggtgtatta

SEQ ID NO: 11114 - DNA, 20 bp, Artificial
  CRISPR gRNA sequence
tgcctatggtgtattagagc

SEQ ID NO: 11115 - DNA, 20 bp, Artificial
  CRISPR gRNA sequence
gcctatggtgtattagagct

SEQ ID NO: 11116 - DNA, 20 bp, Artificial
  CRISPR gRNA sequence
cctatggtgtattagagctg

SEQ ID NO: 11117 - DNA, 20 bp, Artificial
  CRISPR gRNA sequence
ctatggtgtattagagctgg

SEQ ID NO: 11118 - DNA, 20 bp, Artificial
  CRISPR gRNA sequence
tatggtgtattagagctggg

SEQ ID NO: 11119 - DNA, 20 bp, Artificial
  CRISPR gRNA sequence
ggtgtattagagctgggggg

SEQ ID NO: 11120 - DNA, 20 bp, Artificial
  CRISPR gRNA sequence
gtgtattagagctggggggt

SEQ ID NO: 11121 - DNA, 20 bp, Artificial
  CRISPR gRNA sequence
tattagagctggggggtggg

SEQ ID NO: 11122 - DNA, 20 bp, Artificial
  CRISPR gRNA sequence
attagagctggggggtggga

SEQ ID NO: 11123 - DNA, 20 bp, Artificial
  CRISPR gRNA sequence
ttagagctggggggtgggaa

SEQ ID NO: 11124 - DNA, 20 bp, Artificial
  CRISPR gRNA sequence
gagctggggggtgggaaggg

SEQ ID NO: 11125 - DNA, 20 bp, Artificial
  CRISPR gRNA sequence
agctggggggtgggaagggc

SEQ ID NO: 11126 - DNA, 20 bp, Artificial
  CRISPR gRNA sequence
ggggtgggaagggcaggtgc

SEQ ID NO: 11127 - DNA, 20 bp, Artificial
  CRISPR gRNA sequence
gggtgggaagggcaggtgcc

SEQ ID NO: 11128 - DNA, 20 bp, Artificial
  CRISPR gRNA sequence
ggtgggaagggcaggtgcca

SEQ ID NO: 11129 - DNA, 20 bp, Artificial
  CRISPR gRNA sequence
gaagggcaggtgccagggct

SEQ ID NO: 11130 - DNA, 20 bp, Artificial
  CRISPR gRNA sequence
aagggcaggtgccagggctg

SEQ ID NO: 11131 - DNA, 20 bp, Artificial
  CRISPR gRNA sequence
gggcaggtgccagggctgag

SEQ ID NO: 11132 - DNA, 20 bp, Artificial
  CRISPR gRNA sequence
ggcaggtgccagggctgagg

SEQ ID NO: 11133 - DNA, 20 bp, Artificial
  CRISPR gRNA sequence
agggctgaggaggccctcac

SEQ ID NO: 11134 - DNA, 20 bp, Artificial
  CRISPR gRNA sequence
gggctgaggaggccctcact

SEQ ID NO: 11135 - DNA, 20 bp, Artificial
  CRISPR gRNA sequence
tgaggaggccctcactggga

SEQ ID NO: 11136 - DNA, 20 bp, Artificial
  CRISPR gRNA sequence
gaggaggccctcactgggat

SEQ ID NO: 11137 - DNA, 20 bp, Artificial
  CRISPR gRNA sequence
gaggccctcactgggatggg

SEQ ID NO: 11138 - DNA, 20 bp, Artificial
  CRISPR gRNA sequence
aggccctcactgggatggga

SEQ ID NO: 11139 - DNA, 20 bp, Artificial
  CRISPR gRNA sequence
ggccctcactgggatgggaa

SEQ ID NO: 11140 - DNA, 20 bp, Artificial
  CRISPR gRNA sequence
ctcactgggatgggaagggt

SEQ ID NO: 11141 - DNA, 20 bp, Artificial
  CRISPR gRNA sequence
ctgggatgggaagggtcaga

SEQ ID NO: 11142 - DNA, 20 bp, Artificial
  CRISPR gRNA sequence
tgggaagggtcagatggccc

SEQ ID NO: 11143 - DNA, 20 bp, Artificial
  CRISPR gRNA sequence
gggaagggtcagatggcccc

SEQ ID NO: 11144 - DNA, 20 bp, Artificial
  CRISPR gRNA sequence
gtcagatggccccaggacgc

SEQ ID NO: 11145 - DNA, 20 bp, Artificial
  CRISPR gRNA sequence
ggccccaggacgctagctga

SEQ ID NO: 11146 - DNA, 20 bp, Artificial
  CRISPR gRNA sequence
cccccatctgattccacctg

SEQ ID NO: 11147 - DNA, 20 bp, Artificial
  CRISPR gRNA sequence
atctgattccacctgcagcc

SEQ ID NO: 11148 - DNA, 20 bp, Artificial
  CRISPR gRNA sequence
acctgcagcctggatgcgct

SEQ ID NO: 11149 - DNA, 20 bp, Artificial
  CRISPR gRNA sequence
gcagcctggatgcgctgagt

SEQ ID NO: 11150 - DNA, 20 bp, Artificial
  CRISPR gRNA sequence
tggatgcgctgagtgagaac

SEQ ID NO: 11151 - DNA, 20 bp, Artificial
  CRISPR gRNA sequence
gcgctgagtgagaacaagat

SEQ ID NO: 11152 - DNA, 20 bp, Artificial
  CRISPR gRNA sequence
cgctgagtgagaacaagatc

SEQ ID NO: 11153 - DNA, 20 bp, Artificial
  CRISPR gRNA sequence
gctgagtgagaacaagatcg

SEQ ID NO: 11154 - DNA, 20 bp, Artificial
  CRISPR gRNA sequence
gtgagaacaagatcggggac

SEQ ID NO: 11155 - DNA, 20 bp, Artificial
  CRISPR gRNA sequence
tgagaacaagatcggggacg

SEQ ID NO: 11156 - DNA, 20 bp, Artificial
  CRISPR gRNA sequence
gagaacaagatcggggacga

SEQ ID NO: 11157 - DNA, 20 bp, Artificial
  CRISPR gRNA sequence
tcggggacgagggtgtctcg

SEQ ID NO: 11158 - DNA, 20 bp, Artificial
  CRISPR gRNA sequence
cgagggtgtctcgcagctct

SEQ ID NO: 11159 - DNA, 20 bp, Artificial
  CRISPR gRNA sequence
agctctcagccaccttcccc

SEQ ID NO: 11160 - DNA, 20 bp, Artificial
  CRISPR gRNA sequence
cagccaccttcccccagctg

SEQ ID NO: 11161 - DNA, 20 bp, Artificial
  CRISPR gRNA sequence
cttcccccagctgaagtcct

SEQ ID NO: 11162 - DNA, 20 bp, Artificial
  CRISPR gRNA sequence
tgaagtccttggaaaccctc

SEQ ID NO: 11163 - DNA, 20 bp, Artificial
  CRISPR gRNA sequence
gtccttggaaaccctcaagt

SEQ ID NO: 11164 - DNA, 20 bp, Artificial
  CRISPR gRNA sequence
ttggaaaccctcaagtgagt

SEQ ID NO: 11165 - DNA, 20 bp, Artificial
  CRISPR gRNA sequence
aaaccctcaagtgagtgagc

SEQ ID NO: 11166 - DNA, 20 bp, Artificial
  CRISPR gRNA sequence
aaccctcaagtgagtgagct

SEQ ID NO: 11167 - DNA, 20 bp, Artificial
  CRISPR gRNA sequence
gcctgcccttcctgctgaat

SEQ ID NO: 11168 - DNA, 20 bp, Artificial
  CRISPR gRNA sequence
cctgcccttcctgctgaatc

SEQ ID NO: 11169 - DNA, 20 bp, Artificial
  CRISPR gRNA sequence
cctgctgaatcgggccccca

SEQ ID NO: 11170 - DNA, 20 bp, Artificial
  CRISPR gRNA sequence
tgaatcgggcccccaaagtc

SEQ ID NO: 11171 - DNA, 20 bp, Artificial
  CRISPR gRNA sequence
ttaatttaaatttgtttttt

SEQ ID NO: 11172 - DNA, 20 bp, Artificial
  CRISPR gRNA sequence
ttaaatttgtttttttagac

SEQ ID NO: 11173 - DNA, 20 bp, Artificial
  CRISPR gRNA sequence
taaatttgtttttttagaca

SEQ ID NO: 11174 - DNA, 20 bp, Artificial
  CRISPR gRNA sequence
aaatttgtttttttagacaa

SEQ ID NO: 11175 - DNA, 20 bp, Artificial
  CRISPR gRNA sequence
caagggctcgctgtgtcacc

SEQ ID NO: 11176 - DNA, 20 bp, Artificial
  CRISPR gRNA sequence
aagggctcgctgtgtcaccc

SEQ ID NO: 11177 - DNA, 20 bp, Artificial
  CRISPR gRNA sequence
gctcgctgtgtcacccaggc

SEQ ID NO: 11178 - DNA, 20 bp, Artificial
  CRISPR gRNA sequence
gtgtcacccaggctagaata

SEQ ID NO: 11179 - DNA, 20 bp, Artificial
  CRISPR gRNA sequence
gtgctatgatcatacctctg

SEQ ID NO: 11180 - DNA, 20 bp, Artificial
  CRISPR gRNA sequence
cctctgcagccttgaactcc

SEQ ID NO: 11181 - DNA, 20 bp, Artificial
  CRISPR gRNA sequence
agccttgaactcctggcctc

SEQ ID NO: 11182 - DNA, 20 bp, Artificial
  CRISPR gRNA sequence
gccttgaactcctggcctca

SEQ ID NO: 11183 - DNA, 20 bp, Artificial
  CRISPR gRNA sequence
ctcctcacctccgcttccca

SEQ ID NO: 11184 - DNA, 20 bp, Artificial
  CRISPR gRNA sequence
acctccgcttcccaaagtgc

SEQ ID NO: 11185 - DNA, 20 bp, Artificial
  CRISPR gRNA sequence
cctccgcttcccaaagtgct

SEQ ID NO: 11186 - DNA, 20 bp, Artificial
  CRISPR gRNA sequence
ttcccaaagtgctgggatta

SEQ ID NO: 11187 - DNA, 20 bp, Artificial
  CRISPR gRNA sequence
tcccaaagtgctgggattat

SEQ ID NO: 11188 - DNA, 20 bp, Artificial
  CRISPR gRNA sequence
taggtgtgacttaccatgcc

SEQ ID NO: 11189 - DNA, 20 bp, Artificial
  CRISPR gRNA sequence
tgacttaccatgcccagccc

SEQ ID NO: 11190 - DNA, 20 bp, Artificial
  CRISPR gRNA sequence
cttaccatgcccagccccag

SEQ ID NO: 11191 - DNA, 20 bp, Artificial
  CRISPR gRNA sequence
cactcattcacctattcaat

SEQ ID NO: 11192 - DNA, 20 bp, Artificial
  CRISPR gRNA sequence
gattcatccattcacttatg

SEQ ID NO: 11193 - DNA, 20 bp, Artificial
  CRISPR gRNA sequence
aatttaatcaacaaatattt

SEQ ID NO: 11194 - DNA, 20 bp, Artificial
  CRISPR gRNA sequence
atttaatcaacaaatattta

SEQ ID NO: 11195 - DNA, 20 bp, Artificial
  CRISPR gRNA sequence
ttaatcaacaaatatttaag

SEQ ID NO: 11196 - DNA, 20 bp, Artificial
  CRISPR gRNA sequence
taatcaacaaatatttaagg

SEQ ID NO: 11197 - DNA, 20 bp, Artificial
  CRISPR gRNA sequence
taaggaggacctactatgtg

SEQ ID NO: 11198 - DNA, 20 bp, Artificial
  CRISPR gRNA sequence
aaggaggacctactatgtgc

SEQ ID NO: 11199 - DNA, 20 bp, Artificial
  CRISPR gRNA sequence
actatgtgcaggcacctttc

SEQ ID NO: 11200 - DNA, 20 bp, Artificial
  CRISPR gRNA sequence
ctatgtgcaggcacctttct

SEQ ID NO: 11201 - DNA, 20 bp, Artificial
  CRISPR gRNA sequence
gcaggcacctttctaggccc

SEQ ID NO: 11202 - DNA, 20 bp, Artificial
  CRISPR gRNA sequence
aggcacctttctaggccctg

SEQ ID NO: 11203 - DNA, 20 bp, Artificial
  CRISPR gRNA sequence
ctttctaggccctggagacc

SEQ ID NO: 11204 - DNA, 20 bp, Artificial
  CRISPR gRNA sequence
acaaataaatcccctgacct

SEQ ID NO: 11205 - DNA, 20 bp, Artificial
  CRISPR gRNA sequence
caaataaatcccctgacctc

SEQ ID NO: 11206 - DNA, 20 bp, Artificial
  CRISPR gRNA sequence
acctcaggaatcttaaattc

SEQ ID NO: 11207 - DNA, 20 bp, Artificial
  CRISPR gRNA sequence
caggaatcttaaattctagt

SEQ ID NO: 11208 - DNA, 20 bp, Artificial
  CRISPR gRNA sequence
aggaatcttaaattctagtg

SEQ ID NO: 11209 - DNA, 20 bp, Artificial
  CRISPR gRNA sequence
gaatcttaaattctagtgag

SEQ ID NO: 11210 - DNA, 20 bp, Artificial
  CRISPR gRNA sequence
agtgaggagacacaatgaac

SEQ ID NO: 11211 - DNA, 20 bp, Artificial
  CRISPR gRNA sequence
gacacaatgaacaagtaaac

SEQ ID NO: 11212 - DNA, 20 bp, Artificial
  CRISPR gRNA sequence
caatgaacaagtaaacaagt

SEQ ID NO: 11213 - DNA, 20 bp, Artificial
  CRISPR gRNA sequence
taaacaagtcggtaattata

SEQ ID NO: 11214 - DNA, 20 bp, Artificial
  CRISPR gRNA sequence
gtcggtaattataaagtata

SEQ ID NO: 11215 - DNA, 20 bp, Artificial
  CRISPR gRNA sequence
acagtaatgaaaataatgtt

SEQ ID NO: 11216 - DNA, 20 bp, Artificial
  CRISPR gRNA sequence
atgaaaataatgtttggtga

SEQ ID NO: 11217 - DNA, 20 bp, Artificial
  CRISPR gRNA sequence
ttggtgacagaaaattatac

SEQ ID NO: 11218 - DNA, 20 bp, Artificial
  CRISPR gRNA sequence
tggtgacagaaaattatact

SEQ ID NO: 11219 - DNA, 20 bp, Artificial
  CRISPR gRNA sequence
ggtgacagaaaattatactg

SEQ ID NO: 11220 - DNA, 20 bp, Artificial
  CRISPR gRNA sequence
gtgacagaaaattatactgg

SEQ ID NO: 11221 - DNA, 20 bp, Artificial
  CRISPR gRNA sequence
tgacagaaaattatactggg

SEQ ID NO: 11222 - DNA, 20 bp, Artificial
  CRISPR gRNA sequence
aattatactggggggtgaaa

SEQ ID NO: 11223 - DNA, 20 bp, Artificial
  CRISPR gRNA sequence
attatactggggggtgaaat

SEQ ID NO: 11224 - DNA, 20 bp, Artificial
  CRISPR gRNA sequence
tatactggggggtgaaatag

SEQ ID NO: 11225 - DNA, 20 bp, Artificial
  CRISPR gRNA sequence
tactggggggtgaaatagga

SEQ ID NO: 11226 - DNA, 20 bp, Artificial
  CRISPR gRNA sequence
ggggggtgaaataggagaga

SEQ ID NO: 11227 - DNA, 20 bp, Artificial
  CRISPR gRNA sequence
gtgaaataggagagatagat

SEQ ID NO: 11228 - DNA, 20 bp, Artificial
  CRISPR gRNA sequence
tgaaataggagagatagatt

SEQ ID NO: 11229 - DNA, 20 bp, Artificial
  CRISPR gRNA sequence
tagattaggatttatcaata

SEQ ID NO: 11230 - DNA, 20 bp, Artificial
  CRISPR gRNA sequence
ataaagcattattatcaaaa

SEQ ID NO: 11231 - DNA, 20 bp, Artificial
  CRISPR gRNA sequence
aaactttttaaaaactgttc

SEQ ID NO: 11232 - DNA, 20 bp, Artificial
  CRISPR gRNA sequence
aactttttaaaaactgttct

SEQ ID NO: 11233 - DNA, 20 bp, Artificial
  CRISPR gRNA sequence
ttaaaaactgttctgggctc

SEQ ID NO: 11234 - DNA, 20 bp, Artificial
  CRISPR gRNA sequence
taaaaactgttctgggctct

SEQ ID NO: 11235 - DNA, 20 bp, Artificial
  CRISPR gRNA sequence
aaactgttctgggctctggg

SEQ ID NO: 11236 - DNA, 20 bp, Artificial
  CRISPR gRNA sequence
tgttctgggctctgggaagt

SEQ ID NO: 11237 - DNA, 20 bp, Artificial
  CRISPR gRNA sequence
ttctgggctctgggaagttg

SEQ ID NO: 11238 - DNA, 20 bp, Artificial
  CRISPR gRNA sequence
gggctctgggaagttggaga

SEQ ID NO: 11239 - DNA, 20 bp, Artificial
  CRISPR gRNA sequence
ctgggaagttggagatggat

SEQ ID NO: 11240 - DNA, 20 bp, Artificial
  CRISPR gRNA sequence
agttggagatggataagata

SEQ ID NO: 11241 - DNA, 20 bp, Artificial
  CRISPR gRNA sequence
gttggagatggataagatac

SEQ ID NO: 11242 - DNA, 20 bp, Artificial
  CRISPR gRNA sequence
tggagatggataagatacag

SEQ ID NO: 11243 - DNA, 20 bp, Artificial
  CRISPR gRNA sequence
ggagatggataagatacagg

SEQ ID NO: 11244 - DNA, 20 bp, Artificial
  CRISPR gRNA sequence
gtgattttttttcttttttt

SEQ ID NO: 11245 - DNA, 20 bp, Artificial
  CRISPR gRNA sequence
tttttttctttttttcagac

SEQ ID NO: 11246 - DNA, 20 bp, Artificial
  CRISPR gRNA sequence
ttttttctttttttcagaca

SEQ ID NO: 11247 - DNA, 20 bp, Artificial
  CRISPR gRNA sequence
caaggtctcgctctgtcacc

SEQ ID NO: 11248 - DNA, 20 bp, Artificial
  CRISPR gRNA sequence
aaggtctcgctctgtcaccc

SEQ ID NO: 11249 - DNA, 20 bp, Artificial
  CRISPR gRNA sequence
aggtctcgctctgtcaccca

SEQ ID NO: 11250 - DNA, 20 bp, Artificial
  CRISPR gRNA sequence
tctcgctctgtcacccaggg

SEQ ID NO: 11251 - DNA, 20 bp, Artificial
  CRISPR gRNA sequence
tcgctctgtcacccagggtg

SEQ ID NO: 11252 - DNA, 20 bp, Artificial
  CRISPR gRNA sequence
ctgtcacccagggtggagtg

SEQ ID NO: 11253 - DNA, 20 bp, Artificial
  CRISPR gRNA sequence
tcacccagggtggagtgcag

SEQ ID NO: 11254 - DNA, 20 bp, Artificial
  CRISPR gRNA sequence
ggagtgcagtggtgtaatca

SEQ ID NO: 11255 - DNA, 20 bp, Artificial
  CRISPR gRNA sequence
ggtgtaatcatggctcactg

SEQ ID NO: 11256 - DNA, 20 bp, Artificial
  CRISPR gRNA sequence
tcactgcagcctcaatctcc

SEQ ID NO: 11257 - DNA, 20 bp, Artificial
  CRISPR gRNA sequence
cactgcagcctcaatctcct

SEQ ID NO: 11258 - DNA, 20 bp, Artificial
  CRISPR gRNA sequence
agcctcaatctcctaggctc

SEQ ID NO: 11259 - DNA, 20 bp, Artificial
  CRISPR gRNA sequence
tcctcccatctcaaccttct

SEQ ID NO: 11260 - DNA, 20 bp, Artificial
  CRISPR gRNA sequence
tcccatctcaaccttctgag

SEQ ID NO: 11261 - DNA, 20 bp, Artificial
  CRISPR gRNA sequence
atctcaaccttctgagtagc

SEQ ID NO: 11262 - DNA, 20 bp, Artificial
  CRISPR gRNA sequence
tctcaaccttctgagtagct

SEQ ID NO: 11263 - DNA, 20 bp, Artificial
  CRISPR gRNA sequence
aaccttctgagtagctggga

SEQ ID NO: 11264 - DNA, 20 bp, Artificial
  CRISPR gRNA sequence
accttctgagtagctgggac

SEQ ID NO: 11265 - DNA, 20 bp, Artificial
  CRISPR gRNA sequence
ctaatttttgtatttttttg

SEQ ID NO: 11266 - DNA, 20 bp, Artificial
  CRISPR gRNA sequence
aatttttgtatttttttgta

SEQ ID NO: 11267 - DNA, 20 bp, Artificial
  CRISPR gRNA sequence
tgtatttttttgtagagacg

SEQ ID NO: 11268 - DNA, 20 bp, Artificial
  CRISPR gRNA sequence
cgtggtttcaccacgttgcc

SEQ ID NO: 11269 - DNA, 20 bp, Artificial
  CRISPR gRNA sequence
gtggtttcaccacgttgccc

SEQ ID NO: 11270 - DNA, 20 bp, Artificial
  CRISPR gRNA sequence
tttcaccacgttgcccaggc

SEQ ID NO: 11271 - DNA, 20 bp, Artificial
  CRISPR gRNA sequence
caggctggtcttgaacttct

SEQ ID NO: 11272 - DNA, 20 bp, Artificial
  CRISPR gRNA sequence
ggtcttgaacttctgagctc

SEQ ID NO: 11273 - DNA, 20 bp, Artificial
  CRISPR gRNA sequence
cctcctgcctctgcctccca

SEQ ID NO: 11274 - DNA, 20 bp, Artificial
  CRISPR gRNA sequence
gcctctgcctcccaaagtac

SEQ ID NO: 11275 - DNA, 20 bp, Artificial
  CRISPR gRNA sequence
cctctgcctcccaaagtact

SEQ ID NO: 11276 - DNA, 20 bp, Artificial
  CRISPR gRNA sequence
ctcccaaagtactgggatta

SEQ ID NO: 11277 - DNA, 20 bp, Artificial
  CRISPR gRNA sequence
tcccaaagtactgggattac

SEQ ID NO: 11278 - DNA, 20 bp, Artificial
  CRISPR gRNA sequence
agtactgggattacaggcat

SEQ ID NO: 11279 - DNA, 20 bp, Artificial
  CRISPR gRNA sequence
caggcatgagtcactgtgcc

SEQ ID NO: 11280 - DNA, 20 bp, Artificial
  CRISPR gRNA sequence
agtcactgtgcctggttcaa

SEQ ID NO: 11281 - DNA, 20 bp, Artificial
  CRISPR gRNA sequence
gtcactgtgcctggttcaat

SEQ ID NO: 11282 - DNA, 20 bp, Artificial
  CRISPR gRNA sequence
ttttttttttttttttgaca

SEQ ID NO: 11283 - DNA, 20 bp, Artificial
  CRISPR gRNA sequence
ttttttttttttttgacacg

SEQ ID NO: 11284 - DNA, 20 bp, Artificial
  CRISPR gRNA sequence
tgacacggagtctcgctctg

SEQ ID NO: 11285 - DNA, 20 bp, Artificial
  CRISPR gRNA sequence
cggagtctcgctctgtagcc

SEQ ID NO: 11286 - DNA, 20 bp, Artificial
  CRISPR gRNA sequence
ggagtctcgctctgtagccc

SEQ ID NO: 11287 - DNA, 20 bp, Artificial
  CRISPR gRNA sequence
tctcgctctgtagcccaggc

SEQ ID NO: 11288 - DNA, 20 bp, Artificial
  CRISPR gRNA sequence
tcgctctgtagcccaggctg

SEQ ID NO: 11289 - DNA, 20 bp, Artificial
  CRISPR gRNA sequence
ctgtagcccaggctggagtg

SEQ ID NO: 11290 - DNA, 20 bp, Artificial
  CRISPR gRNA sequence
tagcccaggctggagtgcag

SEQ ID NO: 11291 - DNA, 20 bp, Artificial
  CRISPR gRNA sequence
ttattgcaaacttcacctcc

SEQ ID NO: 11292 - DNA, 20 bp, Artificial
  CRISPR gRNA sequence
tattgcaaacttcacctcct

SEQ ID NO: 11293 - DNA, 20 bp, Artificial
  CRISPR gRNA sequence
aaacttcacctcctgggttc

SEQ ID NO: 11294 - DNA, 20 bp, Artificial
  CRISPR gRNA sequence
ttcaagcaattctcacacct

SEQ ID NO: 11295 - DNA, 20 bp, Artificial
  CRISPR gRNA sequence
ttctcacacctcagcctccc

SEQ ID NO: 11296 - DNA, 20 bp, Artificial
  CRISPR gRNA sequence
tcacacctcagcctcccaag

SEQ ID NO: 11297 - DNA, 20 bp, Artificial
  CRISPR gRNA sequence
acctcagcctcccaagtagc

SEQ ID NO: 11298 - DNA, 20 bp, Artificial
  CRISPR gRNA sequence
ctcccaagtagctggaatta

SEQ ID NO: 11299 - DNA, 20 bp, Artificial
  CRISPR gRNA sequence
tcccaagtagctggaattac

SEQ ID NO: 11300 - DNA, 20 bp, Artificial
  CRISPR gRNA sequence
ccaactaatttttgtatttt

SEQ ID NO: 11301 - DNA, 20 bp, Artificial
  CRISPR gRNA sequence
actaatttttgtatttttag

SEQ ID NO: 11302 - DNA, 20 bp, Artificial
  CRISPR gRNA sequence
taatttttgtatttttagta

SEQ ID NO: 11303 - DNA, 20 bp, Artificial
  CRISPR gRNA sequence
ttttgtatttttagtagaga

SEQ ID NO: 11304 - DNA, 20 bp, Artificial
  CRISPR gRNA sequence
tttgtatttttagtagagac

SEQ ID NO: 11305 - DNA, 20 bp, Artificial
  CRISPR gRNA sequence
ttgtatttttagtagagacg

SEQ ID NO: 11306 - DNA, 20 bp, Artificial
  CRISPR gRNA sequence
tagtagagacggggtttcac

SEQ ID NO: 11307 - DNA, 20 bp, Artificial
  CRISPR gRNA sequence
agtagagacggggtttcacc

SEQ ID NO: 11308 - DNA, 20 bp, Artificial
  CRISPR gRNA sequence
gagacggggtttcaccaggt

SEQ ID NO: 11309 - DNA, 20 bp, Artificial
  CRISPR gRNA sequence
cggggtttcaccaggttggc

SEQ ID NO: 11310 - DNA, 20 bp, Artificial
  CRISPR gRNA sequence
ggggtttcaccaggttggcc

SEQ ID NO: 11311 - DNA, 20 bp, Artificial
  CRISPR gRNA sequence
tttcaccaggttggccaggc

SEQ ID NO: 11312 - DNA, 20 bp, Artificial
  CRISPR gRNA sequence
ggtcttgaactcctgacctc

SEQ ID NO: 11313 - DNA, 20 bp, Artificial
  CRISPR gRNA sequence
ctcaagtgatccgcccacct

SEQ ID NO: 11314 - DNA, 20 bp, Artificial
  CRISPR gRNA sequence
ccgcccacctcagcctccca

SEQ ID NO: 11315 - DNA, 20 bp, Artificial
  CRISPR gRNA sequence
acctcagcctcccaaagtgc

SEQ ID NO: 11316 - DNA, 20 bp, Artificial
  CRISPR gRNA sequence
cctcagcctcccaaagtgct

SEQ ID NO: 11317 - DNA, 20 bp, Artificial
  CRISPR gRNA sequence
tcccaaagtgctgggattac

SEQ ID NO: 11318 - DNA, 20 bp, Artificial
  CRISPR gRNA sequence
agtgctgggattaccggcat

SEQ ID NO: 11319 - DNA, 20 bp, Artificial
  CRISPR gRNA sequence
ccggcatgagccaccacgcc

SEQ ID NO: 11320 - DNA, 20 bp, Artificial
  CRISPR gRNA sequence
acatgattttttactgaacc

SEQ ID NO: 11321 - DNA, 20 bp, Artificial
  CRISPR gRNA sequence
atgattttttactgaaccta

SEQ ID NO: 11322 - DNA, 20 bp, Artificial
  CRISPR gRNA sequence
tgattttttactgaacctag

SEQ ID NO: 11323 - DNA, 20 bp, Artificial
  CRISPR gRNA sequence
ccacactccccctcacaacc

SEQ ID NO: 11324 - DNA, 20 bp, Artificial
  CRISPR gRNA sequence
cacactccccctcacaacca

SEQ ID NO: 11325 - DNA, 20 bp, Artificial
  CRISPR gRNA sequence
ccccctcacaaccaaggtct

SEQ ID NO: 11326 - DNA, 20 bp, Artificial
  CRISPR gRNA sequence
cccctcacaaccaaggtctt

SEQ ID NO: 11327 - DNA, 20 bp, Artificial
  CRISPR gRNA sequence
tcacaaccaaggtcttagga

SEQ ID NO: 11328 - DNA, 20 bp, Artificial
  CRISPR gRNA sequence
aggatggccaaataatttac

SEQ ID NO: 11329 - DNA, 20 bp, Artificial
  CRISPR gRNA sequence
ataatttaccggaatttact

SEQ ID NO: 11330 - DNA, 20 bp, Artificial
  CRISPR gRNA sequence
cttagcaatttccttaattg

SEQ ID NO: 11331 - DNA, 20 bp, Artificial
  CRISPR gRNA sequence
ttagcaatttccttaattgt

SEQ ID NO: 11332 - DNA, 20 bp, Artificial
  CRISPR gRNA sequence
tttccttaattgtaggactg

SEQ ID NO: 11333 - DNA, 20 bp, Artificial
  CRISPR gRNA sequence
ttccttaattgtaggactgt

SEQ ID NO: 11334 - DNA, 20 bp, Artificial
  CRISPR gRNA sequence
gtaggactgtgggacttctc

SEQ ID NO: 11335 - DNA, 20 bp, Artificial
  CRISPR gRNA sequence
gggacttctccagtaatttc

SEQ ID NO: 11336 - DNA, 20 bp, Artificial
  CRISPR gRNA sequence
tccagtaatttctagtgtcc

SEQ ID NO: 11337 - DNA, 20 bp, Artificial
  CRISPR gRNA sequence
ccagtaatttctagtgtcct

SEQ ID NO: 11338 - DNA, 20 bp, Artificial
  CRISPR gRNA sequence
agtgtcctaggtaacactgt

SEQ ID NO: 11339 - DNA, 20 bp, Artificial
  CRISPR gRNA sequence
tcctaggtaacactgtaagc

SEQ ID NO: 11340 - DNA, 20 bp, Artificial
  CRISPR gRNA sequence
taagctagatttcttctcct

SEQ ID NO: 11341 - DNA, 20 bp, Artificial
  CRISPR gRNA sequence
tcttacccgccaccccactt

SEQ ID NO: 11342 - DNA, 20 bp, Artificial
  CRISPR gRNA sequence
accccacttaagtatttatt

SEQ ID NO: 11343 - DNA, 20 bp, Artificial
  CRISPR gRNA sequence
ttgagcacctactatgtgcc

SEQ ID NO: 11344 - DNA, 20 bp, Artificial
  CRISPR gRNA sequence
agcacctactatgtgcctgg

SEQ ID NO: 11345 - DNA, 20 bp, Artificial
  CRISPR gRNA sequence
ctatgtgcctggcagtgctc

SEQ ID NO: 11346 - DNA, 20 bp, Artificial
  CRISPR gRNA sequence
tatgtgcctggcagtgctct

SEQ ID NO: 11347 - DNA, 20 bp, Artificial
  CRISPR gRNA sequence
gcctggcagtgctctaggca

SEQ ID NO: 11348 - DNA, 20 bp, Artificial
  CRISPR gRNA sequence
cctggcagtgctctaggcac

SEQ ID NO: 11349 - DNA, 20 bp, Artificial
  CRISPR gRNA sequence
ctggcagtgctctaggcaca

SEQ ID NO: 11350 - DNA, 20 bp, Artificial
  CRISPR gRNA sequence
gtgctctaggcacagggata

SEQ ID NO: 11351 - DNA, 20 bp, Artificial
  CRISPR gRNA sequence
aggcacagggatacagtaat

SEQ ID NO: 11352 - DNA, 20 bp, Artificial
  CRISPR gRNA sequence
ggatacagtaatgagcaaaa

SEQ ID NO: 11353 - DNA, 20 bp, Artificial
  CRISPR gRNA sequence
agtaatgagcaaaacagaca

SEQ ID NO: 11354 - DNA, 20 bp, Artificial
  CRISPR gRNA sequence
acacagccctgctccatgtg

SEQ ID NO: 11355 - DNA, 20 bp, Artificial
  CRISPR gRNA sequence
tccatgtgaagcccacaacc

SEQ ID NO: 11356 - DNA, 20 bp, Artificial
  CRISPR gRNA sequence
atgtgaagcccacaacccgg

SEQ ID NO: 11357 - DNA, 20 bp, Artificial
  CRISPR gRNA sequence
gaagcccacaacccggcaga

SEQ ID NO: 11358 - DNA, 20 bp, Artificial
  CRISPR gRNA sequence
aagcccacaacccggcagaa

SEQ ID NO: 11359 - DNA, 20 bp, Artificial
  CRISPR gRNA sequence
acccggcagaaaggattaca

SEQ ID NO: 11360 - DNA, 20 bp, Artificial
  CRISPR gRNA sequence
tgccaacacttatttcatta

SEQ ID NO: 11361 - DNA, 20 bp, Artificial
  CRISPR gRNA sequence
tatttcattatagtgctgaa

SEQ ID NO: 11362 - DNA, 20 bp, Artificial
  CRISPR gRNA sequence
ttcattatagtgctgaaaag

SEQ ID NO: 11363 - DNA, 20 bp, Artificial
  CRISPR gRNA sequence
tatagtgctgaaaagtggcg

SEQ ID NO: 11364 - DNA, 20 bp, Artificial
  CRISPR gRNA sequence
tagtgctgaaaagtggcgca

SEQ ID NO: 11365 - DNA, 20 bp, Artificial
  CRISPR gRNA sequence
agtgctgaaaagtggcgcag

SEQ ID NO: 11366 - DNA, 20 bp, Artificial
  CRISPR gRNA sequence
gtgctgaaaagtggcgcaga

SEQ ID NO: 11367 - DNA, 20 bp, Artificial
  CRISPR gRNA sequence
gaaaagtggcgcagagggaa

SEQ ID NO: 11368 - DNA, 20 bp, Artificial
  CRISPR gRNA sequence
aaagtggcgcagagggaaaa

SEQ ID NO: 11369 - DNA, 20 bp, Artificial
  CRISPR gRNA sequence
aagtggcgcagagggaaaag

SEQ ID NO: 11370 - DNA, 20 bp, Artificial
  CRISPR gRNA sequence
agtggcgcagagggaaaaga

SEQ ID NO: 11371 - DNA, 20 bp, Artificial
  CRISPR gRNA sequence
gtggcgcagagggaaaagag

SEQ ID NO: 11372 - DNA, 20 bp, Artificial
  CRISPR gRNA sequence
ggaaaagaggggatgttgta

SEQ ID NO: 11373 - DNA, 20 bp, Artificial
  CRISPR gRNA sequence
gaggggatgttgtaaagtca

SEQ ID NO: 11374 - DNA, 20 bp, Artificial
  CRISPR gRNA sequence
aggggatgttgtaaagtcat

SEQ ID NO: 11375 - DNA, 20 bp, Artificial
  CRISPR gRNA sequence
gatgttgtaaagtcatggga

SEQ ID NO: 11376 - DNA, 20 bp, Artificial
  CRISPR gRNA sequence
atgttgtaaagtcatgggac

SEQ ID NO: 11377 - DNA, 20 bp, Artificial
  CRISPR gRNA sequence
ttgtaaagtcatgggacagg

SEQ ID NO: 11378 - DNA, 20 bp, Artificial
  CRISPR gRNA sequence
tgtaaagtcatgggacaggt

SEQ ID NO: 11379 - DNA, 20 bp, Artificial
  CRISPR gRNA sequence
gtaaagtcatgggacaggtg

SEQ ID NO: 11380 - DNA, 20 bp, Artificial
  CRISPR gRNA sequence
taaagtcatgggacaggtgg

SEQ ID NO: 11381 - DNA, 20 bp, Artificial
  CRISPR gRNA sequence
agtcatgggacaggtggggg

SEQ ID NO: 11382 - DNA, 20 bp, Artificial
  CRISPR gRNA sequence
gtcatgggacaggtgggggc

SEQ ID NO: 11383 - DNA, 20 bp, Artificial
  CRISPR gRNA sequence
catgggacaggtgggggcag

SEQ ID NO: 11384 - DNA, 20 bp, Artificial
  CRISPR gRNA sequence
atgggacaggtgggggcagg

SEQ ID NO: 11385 - DNA, 20 bp, Artificial
  CRISPR gRNA sequence
tgggacaggtgggggcagga

SEQ ID NO: 11386 - DNA, 20 bp, Artificial
  CRISPR gRNA sequence
ctcatccctgccctcccact

SEQ ID NO: 11387 - DNA, 20 bp, Artificial
  CRISPR gRNA sequence
cctgccctcccacttggcca

SEQ ID NO: 11388 - DNA, 20 bp, Artificial
  CRISPR gRNA sequence
ctgccctcccacttggccac

SEQ ID NO: 11389 - DNA, 20 bp, Artificial
  CRISPR gRNA sequence
cacttggccacaggacctaa

SEQ ID NO: 11390 - DNA, 20 bp, Artificial
  CRISPR gRNA sequence
acagtatcctcctatttacc

SEQ ID NO: 11391 - DNA, 20 bp, Artificial
  CRISPR gRNA sequence
agtatcctcctatttaccga

SEQ ID NO: 11392 - DNA, 20 bp, Artificial
  CRISPR gRNA sequence
gtatcctcctatttaccgag

SEQ ID NO: 11393 - DNA, 20 bp, Artificial
  CRISPR gRNA sequence
tcctcctatttaccgagagg

SEQ ID NO: 11394 - DNA, 20 bp, Artificial
  CRISPR gRNA sequence
tatttaccgagaggtagctt

SEQ ID NO: 11395 - DNA, 20 bp, Artificial
  CRISPR gRNA sequence
aggtagcttaagtctgtcga

SEQ ID NO: 11396 - DNA, 20 bp, Artificial
  CRISPR gRNA sequence
tctgtcgacagcgccattca

SEQ ID NO: 11397 - DNA, 20 bp, Artificial
  CRISPR gRNA sequence
gccattcacagcctatgacc

SEQ ID NO: 11398 - DNA, 20 bp, Artificial
  CRISPR gRNA sequence
tatgacccagaactctcctt

SEQ ID NO: 11399 - DNA, 20 bp, Artificial
  CRISPR gRNA sequence
atgacccagaactctccttg

SEQ ID NO: 11400 - DNA, 20 bp, Artificial
  CRISPR gRNA sequence
cagaactctccttgaggtca

SEQ ID NO: 11401 - DNA, 20 bp, Artificial
  CRISPR gRNA sequence
actctccttgaggtcaaagt

SEQ ID NO: 11402 - DNA, 20 bp, Artificial
  CRISPR gRNA sequence
ctctccttgaggtcaaagtg

SEQ ID NO: 11403 - DNA, 20 bp, Artificial
  CRISPR gRNA sequence
gaggtcaaagtgaggcatgc

SEQ ID NO: 11404 - DNA, 20 bp, Artificial
  CRISPR gRNA sequence
caaagtgaggcatgcaagtt

SEQ ID NO: 11405 - DNA, 20 bp, Artificial
  CRISPR gRNA sequence
aggcatgcaagtttggtcct

SEQ ID NO: 11406 - DNA, 20 bp, Artificial
  CRISPR gRNA sequence
tccccctcactgtgtccccg

SEQ ID NO: 11407 - DNA, 20 bp, Artificial
  CRISPR gRNA sequence
tgtgtccccgcagtctgtcc

SEQ ID NO: 11408 - DNA, 20 bp, Artificial
  CRISPR gRNA sequence
ccagaacaacatcactgacc

SEQ ID NO: 11409 - DNA, 20 bp, Artificial
  CRISPR gRNA sequence
cagaacaacatcactgacct

SEQ ID NO: 11410 - DNA, 20 bp, Artificial
  CRISPR gRNA sequence
tgggtgcctacaaactcgcc

SEQ ID NO: 11411 - DNA, 20 bp, Artificial
  CRISPR gRNA sequence
gggtgcctacaaactcgccg

SEQ ID NO: 11412 - DNA, 20 bp, Artificial
  CRISPR gRNA sequence
tcgctcgctgcatccctgct

SEQ ID NO: 11413 - DNA, 20 bp, Artificial
  CRISPR gRNA sequence
cgctcgctgcatccctgctc

SEQ ID NO: 11414 - DNA, 20 bp, Artificial
  CRISPR gRNA sequence
gctgcatccctgctcaggct

SEQ ID NO: 11415 - DNA, 20 bp, Artificial
  CRISPR gRNA sequence
ctgcatccctgctcaggcta

SEQ ID NO: 11416 - DNA, 20 bp, Artificial
  CRISPR gRNA sequence
atccctgctcaggctaaggt

SEQ ID NO: 11417 - DNA, 20 bp, Artificial
  CRISPR gRNA sequence
cctgctcaggctaaggtgag

SEQ ID NO: 11418 - DNA, 20 bp, Artificial
  CRISPR gRNA sequence
ctgctcaggctaaggtgagt

SEQ ID NO: 11419 - DNA, 20 bp, Artificial
  CRISPR gRNA sequence
tgctcaggctaaggtgagtg

SEQ ID NO: 11420 - DNA, 20 bp, Artificial
  CRISPR gRNA sequence
ggctaaggtgagtggggccc

SEQ ID NO: 11421 - DNA, 20 bp, Artificial
  CRISPR gRNA sequence
gtgagtggggccccggatac

SEQ ID NO: 11422 - DNA, 20 bp, Artificial
  CRISPR gRNA sequence
gtggggccccggataccggt

SEQ ID NO: 11423 - DNA, 20 bp, Artificial
  CRISPR gRNA sequence
tggggccccggataccggtc

SEQ ID NO: 11424 - DNA, 20 bp, Artificial
  CRISPR gRNA sequence
ccggataccggtcaggtgct

SEQ ID NO: 11425 - DNA, 20 bp, Artificial
  CRISPR gRNA sequence
ataccggtcaggtgctgagc

SEQ ID NO: 11426 - DNA, 20 bp, Artificial
  CRISPR gRNA sequence
taccggtcaggtgctgagct

SEQ ID NO: 11427 - DNA, 20 bp, Artificial
  CRISPR gRNA sequence
accggtcaggtgctgagctg

SEQ ID NO: 11428 - DNA, 20 bp, Artificial
  CRISPR gRNA sequence
ccggtcaggtgctgagctgg

SEQ ID NO: 11429 - DNA, 20 bp, Artificial
  CRISPR gRNA sequence
cggtcaggtgctgagctggg

SEQ ID NO: 11430 - DNA, 20 bp, Artificial
  CRISPR gRNA sequence
ggtgctgagctggggggctg

SEQ ID NO: 11431 - DNA, 20 bp, Artificial
  CRISPR gRNA sequence
tgctgagctggggggctgca

SEQ ID NO: 11432 - DNA, 20 bp, Artificial
  CRISPR gRNA sequence
agctggggggctgcagagcg

SEQ ID NO: 11433 - DNA, 20 bp, Artificial
  CRISPR gRNA sequence
gctggggggctgcagagcgc

SEQ ID NO: 11434 - DNA, 20 bp, Artificial
  CRISPR gRNA sequence
ctggggggctgcagagcgca

SEQ ID NO: 11435 - DNA, 20 bp, Artificial
  CRISPR gRNA sequence
gcagggaacccacatcgtgc

SEQ ID NO: 11436 - DNA, 20 bp, Artificial
  CRISPR gRNA sequence
aacccacatcgtgctggctg

SEQ ID NO: 11437 - DNA, 20 bp, Artificial
  CRISPR gRNA sequence
acccacatcgtgctggctgc

SEQ ID NO: 11438 - DNA, 20 bp, Artificial
  CRISPR gRNA sequence
cccacatcgtgctggctgca

SEQ ID NO: 11439 - DNA, 20 bp, Artificial
  CRISPR gRNA sequence
ccacatcgtgctggctgcag

SEQ ID NO: 11440 - DNA, 20 bp, Artificial
  CRISPR gRNA sequence
tgctggctgcaggggacact

SEQ ID NO: 11441 - DNA, 20 bp, Artificial
  CRISPR gRNA sequence
tgcaggggacactgagaccc

SEQ ID NO: 11442 - DNA, 20 bp, Artificial
  CRISPR gRNA sequence
aggggacactgagaccctag

SEQ ID NO: 11443 - DNA, 20 bp, Artificial
  CRISPR gRNA sequence
gaccctagaagcaatcacca

SEQ ID NO: 11444 - DNA, 20 bp, Artificial
  CRISPR gRNA sequence
atcaccacagccctgaacaa

SEQ ID NO: 11445 - DNA, 20 bp, Artificial
  CRISPR gRNA sequence
tcaccacagccctgaacaaa

SEQ ID NO: 11446 - DNA, 20 bp, Artificial
  CRISPR gRNA sequence
acagccctgaacaaaaggat

SEQ ID NO: 11447 - DNA, 20 bp, Artificial
  CRISPR gRNA sequence
gccctgaacaaaaggattag

SEQ ID NO: 11448 - DNA, 20 bp, Artificial
  CRISPR gRNA sequence
ccctgaacaaaaggattagc

SEQ ID NO: 11449 - DNA, 20 bp, Artificial
  CRISPR gRNA sequence
acaaaaggattagcgggacg

SEQ ID NO: 11450 - DNA, 20 bp, Artificial
  CRISPR gRNA sequence
ggattagcgggacgtggtga

SEQ ID NO: 11451 - DNA, 20 bp, Artificial
  CRISPR gRNA sequence
gacgtggtgaaagaaactct

SEQ ID NO: 11452 - DNA, 20 bp, Artificial
  CRISPR gRNA sequence
tggtgaaagaaactctgagc

SEQ ID NO: 11453 - DNA, 20 bp, Artificial
  CRISPR gRNA sequence
gaaagaaactctgagcaagt

SEQ ID NO: 11454 - DNA, 20 bp, Artificial
  CRISPR gRNA sequence
gcaagtcagttattcattcc

SEQ ID NO: 11455 - DNA, 20 bp, Artificial
  CRISPR gRNA sequence
ctagccgctgttttcttacc

SEQ ID NO: 11456 - DNA, 20 bp, Artificial
  CRISPR gRNA sequence
ctgttttcttacctggaaaa

SEQ ID NO: 11457 - DNA, 20 bp, Artificial
  CRISPR gRNA sequence
tgttttcttacctggaaaat

SEQ ID NO: 11458 - DNA, 20 bp, Artificial
  CRISPR gRNA sequence
gaaaatgggaaccatcctaa

SEQ ID NO: 11459 - DNA, 20 bp, Artificial
  CRISPR gRNA sequence
accatcctaatggtctatgt

SEQ ID NO: 11460 - DNA, 20 bp, Artificial
  CRISPR gRNA sequence
gtaagcacttgtcacaatgc

SEQ ID NO: 11461 - DNA, 20 bp, Artificial
  CRISPR gRNA sequence
taagcacttgtcacaatgcc

SEQ ID NO: 11462 - DNA, 20 bp, Artificial
  CRISPR gRNA sequence
aaatattgctccttttcccc

SEQ ID NO: 11463 - DNA, 20 bp, Artificial
  CRISPR gRNA sequence
aatattgctccttttccccc

SEQ ID NO: 11464 - DNA, 20 bp, Artificial
  CRISPR gRNA sequence
atattgctccttttccccca

SEQ ID NO: 11465 - DNA, 20 bp, Artificial
  CRISPR gRNA sequence
tgctccttttcccccaggga

SEQ ID NO: 11466 - DNA, 20 bp, Artificial
  CRISPR gRNA sequence
tccttttcccccagggatgg

SEQ ID NO: 11467 - DNA, 20 bp, Artificial
  CRISPR gRNA sequence
ccttttcccccagggatggc

SEQ ID NO: 11468 - DNA, 20 bp, Artificial
  CRISPR gRNA sequence
tcccccagggatggcgggac

SEQ ID NO: 11469 - DNA, 20 bp, Artificial
  CRISPR gRNA sequence
cccccagggatggcgggacc

SEQ ID NO: 11470 - DNA, 20 bp, Artificial
  CRISPR gRNA sequence
tggcgggaccaggctttttc

SEQ ID NO: 11471 - DNA, 20 bp, Artificial
  CRISPR gRNA sequence
accaggctttttccggaacc

SEQ ID NO: 11472 - DNA, 20 bp, Artificial
  CRISPR gRNA sequence
ccaggctttttccggaacct

SEQ ID NO: 11473 - DNA, 20 bp, Artificial
  CRISPR gRNA sequence
caggctttttccggaaccta

SEQ ID NO: 11474 - DNA, 20 bp, Artificial
  CRISPR gRNA sequence
aggctttttccggaacctag

SEQ ID NO: 11475 - DNA, 20 bp, Artificial
  CRISPR gRNA sequence
ctttttccggaacctagggg

SEQ ID NO: 11476 - DNA, 20 bp, Artificial
  CRISPR gRNA sequence
tttccggaacctaggggtgg

SEQ ID NO: 11477 - DNA, 20 bp, Artificial
  CRISPR gRNA sequence
aacctaggggtggtggcttc

SEQ ID NO: 11478 - DNA, 20 bp, Artificial
  CRISPR gRNA sequence
ctaggggtggtggcttctgg

SEQ ID NO: 11479 - DNA, 20 bp, Artificial
  CRISPR gRNA sequence
taggggtggtggcttctgga

SEQ ID NO: 11480 - DNA, 20 bp, Artificial
  CRISPR gRNA sequence
ggaaggctaaccacgtacgt

SEQ ID NO: 11481 - DNA, 20 bp, Artificial
  CRISPR gRNA sequence
ccacgtacgtcagcttttgc

SEQ ID NO: 11482 - DNA, 20 bp, Artificial
  CRISPR gRNA sequence
cggccttgtcacttacatgc

SEQ ID NO: 11483 - DNA, 20 bp, Artificial
  CRISPR gRNA sequence
cttgtcacttacatgccggt

SEQ ID NO: 11484 - DNA, 20 bp, Artificial
  CRISPR gRNA sequence
agtgtttcactgccaccttc

SEQ ID NO: 11485 - DNA, 20 bp, Artificial
  CRISPR gRNA sequence
gtttcactgccaccttctgg

SEQ ID NO: 11486 - DNA, 20 bp, Artificial
  CRISPR gRNA sequence
tttcactgccaccttctggt

SEQ ID NO: 11487 - DNA, 20 bp, Artificial
  CRISPR gRNA sequence
tgccaccttctggtaggcct

SEQ ID NO: 11488 - DNA, 20 bp, Artificial
  CRISPR gRNA sequence
ccttctggtaggccttggca

SEQ ID NO: 11489 - DNA, 20 bp, Artificial
  CRISPR gRNA sequence
gcatagcacctcttgctttt

SEQ ID NO: 11490 - DNA, 20 bp, Artificial
  CRISPR gRNA sequence
gcttttgagtgacttccatc

SEQ ID NO: 11491 - DNA, 20 bp, Artificial
  CRISPR gRNA sequence
cttttgagtgacttccatcc

SEQ ID NO: 11492 - DNA, 20 bp, Artificial
  CRISPR gRNA sequence
agtgacttccatccaggccc

SEQ ID NO: 11493 - DNA, 20 bp, Artificial
  CRISPR gRNA sequence
cttccatccaggccctggtg

SEQ ID NO: 11494 - DNA, 20 bp, Artificial
  CRISPR gRNA sequence
tccaggccctggtgtggtcc

SEQ ID NO: 11495 - DNA, 20 bp, Artificial
  CRISPR gRNA sequence
caggccctggtgtggtccca

SEQ ID NO: 11496 - DNA, 20 bp, Artificial
  CRISPR gRNA sequence
aggccctggtgtggtcccag

SEQ ID NO: 11497 - DNA, 20 bp, Artificial
  CRISPR gRNA sequence
ggtgtggtcccagaggtaat

SEQ ID NO: 11498 - DNA, 20 bp, Artificial
  CRISPR gRNA sequence
gtggtcccagaggtaatgag

SEQ ID NO: 11499 - DNA, 20 bp, Artificial
  CRISPR gRNA sequence
ccagaggtaatgagcggact

SEQ ID NO: 11500 - DNA, 20 bp, Artificial
  CRISPR gRNA sequence
ggtaatgagcggactgagct

SEQ ID NO: 11501 - DNA, 20 bp, Artificial
  CRISPR gRNA sequence
tgagcggactgagcttggac

SEQ ID NO: 11502 - DNA, 20 bp, Artificial
  CRISPR gRNA sequence
agcggactgagcttggacca

SEQ ID NO: 11503 - DNA, 20 bp, Artificial
  CRISPR gRNA sequence
ctgagcttggaccagagccc

SEQ ID NO: 11504 - DNA, 20 bp, Artificial
  CRISPR gRNA sequence
agagccccagtcatccaact

SEQ ID NO: 11505 - DNA, 20 bp, Artificial
  CRISPR gRNA sequence
gtcatccaactcagcattac

SEQ ID NO: 11506 - DNA, 20 bp, Artificial
  CRISPR gRNA sequence
taccagctcttcttactcgc

SEQ ID NO: 11507 - DNA, 20 bp, Artificial
  CRISPR gRNA sequence
ctcttcttactcgccagact

SEQ ID NO: 11508 - DNA, 20 bp, Artificial
  CRISPR gRNA sequence
cttcttactcgccagactga

SEQ ID NO: 11509 - DNA, 20 bp, Artificial
  CRISPR gRNA sequence
gaaactgctctcctcttcgc

SEQ ID NO: 11510 - DNA, 20 bp, Artificial
  CRISPR gRNA sequence
aactgctctcctcttcgcca

SEQ ID NO: 11511 - DNA, 20 bp, Artificial
  CRISPR gRNA sequence
gccagagctcttcacttact

SEQ ID NO: 11512 - DNA, 20 bp, Artificial
  CRISPR gRNA sequence
ccagagctcttcacttactg

SEQ ID NO: 11513 - DNA, 20 bp, Artificial
  CRISPR gRNA sequence
cttcacttactgaggacaac

SEQ ID NO: 11514 - DNA, 20 bp, Artificial
  CRISPR gRNA sequence
tcacttactgaggacaacca

SEQ ID NO: 11515 - DNA, 20 bp, Artificial
  CRISPR gRNA sequence
ttactgaggacaaccagagt

SEQ ID NO: 11516 - DNA, 20 bp, Artificial
  CRISPR gRNA sequence
gacaaccagagtcagattcc

SEQ ID NO: 11517 - DNA, 20 bp, Artificial
  CRISPR gRNA sequence
acaaccagagtcagattccc

SEQ ID NO: 11518 - DNA, 20 bp, Artificial
  CRISPR gRNA sequence
ccagagtcagattcccagga

SEQ ID NO: 11519 - DNA, 20 bp, Artificial
  CRISPR gRNA sequence
agtcagattcccaggaaaga

SEQ ID NO: 11520 - DNA, 20 bp, Artificial
  CRISPR gRNA sequence
ttcccaggaaagatggcatt

SEQ ID NO: 11521 - DNA, 20 bp, Artificial
  CRISPR gRNA sequence
tttttttaatttctgttttt

SEQ ID NO: 11522 - DNA, 20 bp, Artificial
  CRISPR gRNA sequence
tttaatttctgtttttgaga

SEQ ID NO: 11523 - DNA, 20 bp, Artificial
  CRISPR gRNA sequence
taatttctgtttttgagatg

SEQ ID NO: 11524 - DNA, 20 bp, Artificial
  CRISPR gRNA sequence
tggagtctcgctctgtcacc

SEQ ID NO: 11525 - DNA, 20 bp, Artificial
  CRISPR gRNA sequence
ggagtctcgctctgtcaccc

SEQ ID NO: 11526 - DNA, 20 bp, Artificial
  CRISPR gRNA sequence
tctcgctctgtcacccaggc

SEQ ID NO: 11527 - DNA, 20 bp, Artificial
  CRISPR gRNA sequence
tcgctctgtcacccaggctg

SEQ ID NO: 11528 - DNA, 20 bp, Artificial
  CRISPR gRNA sequence
ctgtcacccaggctggagtg

SEQ ID NO: 11529 - DNA, 20 bp, Artificial
  CRISPR gRNA sequence
tcacccaggctggagtgaag

SEQ ID NO: 11530 - DNA, 20 bp, Artificial
  CRISPR gRNA sequence
ggagtgaagtggtgtgatct

SEQ ID NO: 11531 - DNA, 20 bp, Artificial
  CRISPR gRNA sequence
ctgcaacttctgcccccccc

SEQ ID NO: 11532 - DNA, 20 bp, Artificial
  CRISPR gRNA sequence
tgcaacttctgccccccccc

SEQ ID NO: 11533 - DNA, 20 bp, Artificial
  CRISPR gRNA sequence
ttctgcccccccccaggttc

SEQ ID NO: 11534 - DNA, 20 bp, Artificial
  CRISPR gRNA sequence
ttcaagctattcgcctgcct

SEQ ID NO: 11535 - DNA, 20 bp, Artificial
  CRISPR gRNA sequence
ttcgcctgcctcagtgctcc

SEQ ID NO: 11536 - DNA, 20 bp, Artificial
  CRISPR gRNA sequence
gcctgcctcagtgctccgag

SEQ ID NO: 11537 - DNA, 20 bp, Artificial
  CRISPR gRNA sequence
gcctcagtgctccgagtagc

SEQ ID NO: 11538 - DNA, 20 bp, Artificial
  CRISPR gRNA sequence
cctcagtgctccgagtagct

SEQ ID NO: 11539 - DNA, 20 bp, Artificial
  CRISPR gRNA sequence
gctccgagtagctgggatta

SEQ ID NO: 11540 - DNA, 20 bp, Artificial
  CRISPR gRNA sequence
ctccgagtagctgggattat

SEQ ID NO: 11541 - DNA, 20 bp, Artificial
  CRISPR gRNA sequence
taggcgcccaccaccacgtc

SEQ ID NO: 11542 - DNA, 20 bp, Artificial
  CRISPR gRNA sequence
cgcccaccaccacgtccagc

SEQ ID NO: 11543 - DNA, 20 bp, Artificial
  CRISPR gRNA sequence
ccagctagtttttatatttt

SEQ ID NO: 11544 - DNA, 20 bp, Artificial
  CRISPR gRNA sequence
gctagtttttatatttttag

SEQ ID NO: 11545 - DNA, 20 bp, Artificial
  CRISPR gRNA sequence
tagtttttatatttttagta

SEQ ID NO: 11546 - DNA, 20 bp, Artificial
  CRISPR gRNA sequence
ttttatatttttagtagaga

SEQ ID NO: 11547 - DNA, 20 bp, Artificial
  CRISPR gRNA sequence
tttatatttttagtagagac

SEQ ID NO: 11548 - DNA, 20 bp, Artificial
  CRISPR gRNA sequence
ttatatttttagtagagaca

SEQ ID NO: 11549 - DNA, 20 bp, Artificial
  CRISPR gRNA sequence
gagacagggtttcgccatgt

SEQ ID NO: 11550 - DNA, 20 bp, Artificial
  CRISPR gRNA sequence
cagggtttcgccatgttggc

SEQ ID NO: 11551 - DNA, 20 bp, Artificial
  CRISPR gRNA sequence
agggtttcgccatgttggcc

SEQ ID NO: 11552 - DNA, 20 bp, Artificial
  CRISPR gRNA sequence
tttcgccatgttggccaggc

SEQ ID NO: 11553 - DNA, 20 bp, Artificial
  CRISPR gRNA sequence
tggtctcaaactcctgatct

SEQ ID NO: 11554 - DNA, 20 bp, Artificial
  CRISPR gRNA sequence
ggtctcaaactcctgatctc

SEQ ID NO: 11555 - DNA, 20 bp, Artificial
  CRISPR gRNA sequence
ctcaggtgatccacctgcct

SEQ ID NO: 11556 - DNA, 20 bp, Artificial
  CRISPR gRNA sequence
ccacctgcctcggcctccca

SEQ ID NO: 11557 - DNA, 20 bp, Artificial
  CRISPR gRNA sequence
ctgcctcggcctcccaaagt

SEQ ID NO: 11558 - DNA, 20 bp, Artificial
  CRISPR gRNA sequence
cggcctcccaaagtgagtac

SEQ ID NO: 11559 - DNA, 20 bp, Artificial
  CRISPR gRNA sequence
ggcctcccaaagtgagtact

SEQ ID NO: 11560 - DNA, 20 bp, Artificial
  CRISPR gRNA sequence
caaagtgagtactaggatta

SEQ ID NO: 11561 - DNA, 20 bp, Artificial
  CRISPR gRNA sequence
aaagtgagtactaggattac

SEQ ID NO: 11562 - DNA, 20 bp, Artificial
  CRISPR gRNA sequence
agtactaggattacaggcgt

SEQ ID NO: 11563 - DNA, 20 bp, Artificial
  CRISPR gRNA sequence
caggcgtgagccaccatgcc

SEQ ID NO: 11564 - DNA, 20 bp, Artificial
  CRISPR gRNA sequence
tatttatttatttatttatt

SEQ ID NO: 11565 - DNA, 20 bp, Artificial
  CRISPR gRNA sequence
tttatttatttatttatttg

SEQ ID NO: 11566 - DNA, 20 bp, Artificial
  CRISPR gRNA sequence
tttatttatttatttggaga

SEQ ID NO: 11567 - DNA, 20 bp, Artificial
  CRISPR gRNA sequence
ttatttatttatttggagat

SEQ ID NO: 11568 - DNA, 20 bp, Artificial
  CRISPR gRNA sequence
tatttatttatttggagatg

SEQ ID NO: 11569 - DNA, 20 bp, Artificial
  CRISPR gRNA sequence
tttggagatggggtctcacc

SEQ ID NO: 11570 - DNA, 20 bp, Artificial
  CRISPR gRNA sequence
ttggagatggggtctcaccc

SEQ ID NO: 11571 - DNA, 20 bp, Artificial
  CRISPR gRNA sequence
atggggtctcacccaggttg

SEQ ID NO: 11572 - DNA, 20 bp, Artificial
  CRISPR gRNA sequence
gtctcacccaggttgtagtg

SEQ ID NO: 11573 - DNA, 20 bp, Artificial
  CRISPR gRNA sequence
tctcacccaggttgtagtgc

SEQ ID NO: 11574 - DNA, 20 bp, Artificial
  CRISPR gRNA sequence
ctcacccaggttgtagtgca

SEQ ID NO: 11575 - DNA, 20 bp, Artificial
  CRISPR gRNA sequence
tcacccaggttgtagtgcag

SEQ ID NO: 11576 - DNA, 20 bp, Artificial
  CRISPR gRNA sequence
gtagtgcaggggtgcaatga

SEQ ID NO: 11577 - DNA, 20 bp, Artificial
  CRISPR gRNA sequence
ggtgcaatgatggctcacta

SEQ ID NO: 11578 - DNA, 20 bp, Artificial
  CRISPR gRNA sequence
tcactacagcctcgactacc

SEQ ID NO: 11579 - DNA, 20 bp, Artificial
  CRISPR gRNA sequence
agcctcgactacctggactg

SEQ ID NO: 11580 - DNA, 20 bp, Artificial
  CRISPR gRNA sequence
ctgaagcgaacctcccacct

SEQ ID NO: 11581 - DNA, 20 bp, Artificial
  CRISPR gRNA sequence
acctcccacctcagccttcc

SEQ ID NO: 11582 - DNA, 20 bp, Artificial
  CRISPR gRNA sequence
tcccacctcagccttccaag

SEQ ID NO: 11583 - DNA, 20 bp, Artificial
  CRISPR gRNA sequence
acctcagccttccaagtagc

SEQ ID NO: 11584 - DNA, 20 bp, Artificial
  CRISPR gRNA sequence
cctcagccttccaagtagct

SEQ ID NO: 11585 - DNA, 20 bp, Artificial
  CRISPR gRNA sequence
gctgggtcctataccctcct

SEQ ID NO: 11586 - DNA, 20 bp, Artificial
  CRISPR gRNA sequence
gagccttgttaatttcttcc

SEQ ID NO: 11587 - DNA, 20 bp, Artificial
  CRISPR gRNA sequence
tttacaatattttatttatg

SEQ ID NO: 11588 - DNA, 20 bp, Artificial
  CRISPR gRNA sequence
ttacaatattttatttatgt

SEQ ID NO: 11589 - DNA, 20 bp, Artificial
  CRISPR gRNA sequence
tgcttacttcttgctatgca

SEQ ID NO: 11590 - DNA, 20 bp, Artificial
  CRISPR gRNA sequence
tcttgctatgcaaagaaact

SEQ ID NO: 11591 - DNA, 20 bp, Artificial
  CRISPR gRNA sequence
tgctatgcaaagaaactcag

SEQ ID NO: 11592 - DNA, 20 bp, Artificial
  CRISPR gRNA sequence
aagaaactcagaagcaaaaa

SEQ ID NO: 11593 - DNA, 20 bp, Artificial
  CRISPR gRNA sequence
aagcaaaaatagaatctgtc

SEQ ID NO: 11594 - DNA, 20 bp, Artificial
  CRISPR gRNA sequence
ttcataattgtgctaaaaac

SEQ ID NO: 11595 - DNA, 20 bp, Artificial
  CRISPR gRNA sequence
cataattgtgctaaaaacta

SEQ ID NO: 11596 - DNA, 20 bp, Artificial
  CRISPR gRNA sequence
gtgctaaaaactagagatac

SEQ ID NO: 11597 - DNA, 20 bp, Artificial
  CRISPR gRNA sequence
ctagagatacaagtatgaac

SEQ ID NO: 11598 - DNA, 20 bp, Artificial
  CRISPR gRNA sequence
agatacaagtatgaactaga

SEQ ID NO: 11599 - DNA, 20 bp, Artificial
  CRISPR gRNA sequence
cagatgtcgttcttgctttt

SEQ ID NO: 11600 - DNA, 20 bp, Artificial
  CRISPR gRNA sequence
tgcttttgagtttctttgcg

SEQ ID NO: 11601 - DNA, 20 bp, Artificial
  CRISPR gRNA sequence
ttttgagtttctttgcgtag

SEQ ID NO: 11602 - DNA, 20 bp, Artificial
  CRISPR gRNA sequence
tttgagtttctttgcgtagt

SEQ ID NO: 11603 - DNA, 20 bp, Artificial
  CRISPR gRNA sequence
tttctttgcgtagtaggaat

SEQ ID NO: 11604 - DNA, 20 bp, Artificial
  CRISPR gRNA sequence
ttctttgcgtagtaggaatt

SEQ ID NO: 11605 - DNA, 20 bp, Artificial
  CRISPR gRNA sequence
ataaataaaatattgtaaaa

SEQ ID NO: 11606 - DNA, 20 bp, Artificial
  CRISPR gRNA sequence
tgtaaaacagtgattcatgc

SEQ ID NO: 11607 - DNA, 20 bp, Artificial
  CRISPR gRNA sequence
gtaaaacagtgattcatgct

SEQ ID NO: 11608 - DNA, 20 bp, Artificial
  CRISPR gRNA sequence
aaacagtgattcatgctggg

SEQ ID NO: 11609 - DNA, 20 bp, Artificial
  CRISPR gRNA sequence
aacagtgattcatgctggga

SEQ ID NO: 11610 - DNA, 20 bp, Artificial
  CRISPR gRNA sequence
atgctgggaaggaaactaac

SEQ ID NO: 11611 - DNA, 20 bp, Artificial
  CRISPR gRNA sequence
ggaaggaaactaacaagccc

SEQ ID NO: 11612 - DNA, 20 bp, Artificial
  CRISPR gRNA sequence
gaaggaaactaacaagcccc

SEQ ID NO: 11613 - DNA, 20 bp, Artificial
  CRISPR gRNA sequence
aggaaactaacaagccccag

SEQ ID NO: 11614 - DNA, 20 bp, Artificial
  CRISPR gRNA sequence
ggaaactaacaagccccagg

SEQ ID NO: 11615 - DNA, 20 bp, Artificial
  CRISPR gRNA sequence
gaaactaacaagccccagga

SEQ ID NO: 11616 - DNA, 20 bp, Artificial
  CRISPR gRNA sequence
taacaagccccaggagggta

SEQ ID NO: 11617 - DNA, 20 bp, Artificial
  CRISPR gRNA sequence
aacaagccccaggagggtac

SEQ ID NO: 11618 - DNA, 20 bp, Artificial
  CRISPR gRNA sequence
ccaggagggtacaggacttc

SEQ ID NO: 11619 - DNA, 20 bp, Artificial
  CRISPR gRNA sequence
caggagggtacaggacttct

SEQ ID NO: 11620 - DNA, 20 bp, Artificial
  CRISPR gRNA sequence
aggagggtacaggacttctg

SEQ ID NO: 11621 - DNA, 20 bp, Artificial
  CRISPR gRNA sequence
gagggtacaggacttctggg

SEQ ID NO: 11622 - DNA, 20 bp, Artificial
  CRISPR gRNA sequence
ctggggagatgattcttccg

SEQ ID NO: 11623 - DNA, 20 bp, Artificial
  CRISPR gRNA sequence
tggggagatgattcttccgt

SEQ ID NO: 11624 - DNA, 20 bp, Artificial
  CRISPR gRNA sequence
ggagatgattcttccgtggg

SEQ ID NO: 11625 - DNA, 20 bp, Artificial
  CRISPR gRNA sequence
gattcttccgtgggaagctc

SEQ ID NO: 11626 - DNA, 20 bp, Artificial
  CRISPR gRNA sequence
attcttccgtgggaagctct

SEQ ID NO: 11627 - DNA, 20 bp, Artificial
  CRISPR gRNA sequence
ttcttccgtgggaagctcta

SEQ ID NO: 11628 - DNA, 20 bp, Artificial
  CRISPR gRNA sequence
tcttccgtgggaagctctag

SEQ ID NO: 11629 - DNA, 20 bp, Artificial
  CRISPR gRNA sequence
cgtgggaagctctaggggaa

SEQ ID NO: 11630 - DNA, 20 bp, Artificial
  CRISPR gRNA sequence
gtgggaagctctaggggaaa

SEQ ID NO: 11631 - DNA, 20 bp, Artificial
  CRISPR gRNA sequence
gctctaggggaaaaggactc

SEQ ID NO: 11632 - DNA, 20 bp, Artificial
  CRISPR gRNA sequence
ctctaggggaaaaggactct

SEQ ID NO: 11633 - DNA, 20 bp, Artificial
  CRISPR gRNA sequence
taggggaaaaggactctagg

SEQ ID NO: 11634 - DNA, 20 bp, Artificial
  CRISPR gRNA sequence
ggaaaaggactctaggaaga

SEQ ID NO: 11635 - DNA, 20 bp, Artificial
  CRISPR gRNA sequence
aggactctaggaagaaagaa

SEQ ID NO: 11636 - DNA, 20 bp, Artificial
  CRISPR gRNA sequence
actctaggaagaaagaacag

SEQ ID NO: 11637 - DNA, 20 bp, Artificial
  CRISPR gRNA sequence
ctctaggaagaaagaacagc

SEQ ID NO: 11638 - DNA, 20 bp, Artificial
  CRISPR gRNA sequence
aagaaagaacagcaggtgca

SEQ ID NO: 11639 - DNA, 20 bp, Artificial
  CRISPR gRNA sequence
agaaagaacagcaggtgcaa

SEQ ID NO: 11640 - DNA, 20 bp, Artificial
  CRISPR gRNA sequence
acagcaggtgcaaaggccct

SEQ ID NO: 11641 - DNA, 20 bp, Artificial
  CRISPR gRNA sequence
gcaggtgcaaaggccctaag

SEQ ID NO: 11642 - DNA, 20 bp, Artificial
  CRISPR gRNA sequence
caggtgcaaaggccctaagt

SEQ ID NO: 11643 - DNA, 20 bp, Artificial
  CRISPR gRNA sequence
gcaaaggccctaagtgggaa

SEQ ID NO: 11644 - DNA, 20 bp, Artificial
  CRISPR gRNA sequence
caaaggccctaagtgggaaa

SEQ ID NO: 11645 - DNA, 20 bp, Artificial
  CRISPR gRNA sequence
aaaggccctaagtgggaaaa

SEQ ID NO: 11646 - DNA, 20 bp, Artificial
  CRISPR gRNA sequence
aaggccctaagtgggaaaag

SEQ ID NO: 11647 - DNA, 20 bp, Artificial
  CRISPR gRNA sequence
gggaaaaggggctgtgtttt

SEQ ID NO: 11648 - DNA, 20 bp, Artificial
  CRISPR gRNA sequence
ggaaaaggggctgtgtttta

SEQ ID NO: 11649 - DNA, 20 bp, Artificial
  CRISPR gRNA sequence
gaaaaggggctgtgttttaa

SEQ ID NO: 11650 - DNA, 20 bp, Artificial
  CRISPR gRNA sequence
aggggctgtgttttaagggt

SEQ ID NO: 11651 - DNA, 20 bp, Artificial
  CRISPR gRNA sequence
ggctgtgttttaagggtcag

SEQ ID NO: 11652 - DNA, 20 bp, Artificial
  CRISPR gRNA sequence
gctgtgttttaagggtcaga

SEQ ID NO: 11653 - DNA, 20 bp, Artificial
  CRISPR gRNA sequence
ctgtgttttaagggtcagaa

SEQ ID NO: 11654 - DNA, 20 bp, Artificial
  CRISPR gRNA sequence
aagggtcagaagggccactg

SEQ ID NO: 11655 - DNA, 20 bp, Artificial
  CRISPR gRNA sequence
agggccactgtggctgtgtg

SEQ ID NO: 11656 - DNA, 20 bp, Artificial
  CRISPR gRNA sequence
tgtggctgtgtgtagtgaat

SEQ ID NO: 11657 - DNA, 20 bp, Artificial
  CRISPR gRNA sequence
gtggctgtgtgtagtgaatg

SEQ ID NO: 11658 - DNA, 20 bp, Artificial
  CRISPR gRNA sequence
tggctgtgtgtagtgaatga

SEQ ID NO: 11659 - DNA, 20 bp, Artificial
  CRISPR gRNA sequence
tgtgtgtagtgaatgaggga

SEQ ID NO: 11660 - DNA, 20 bp, Artificial
  CRISPR gRNA sequence
tgtgtagtgaatgagggaca

SEQ ID NO: 11661 - DNA, 20 bp, Artificial
  CRISPR gRNA sequence
gtgtagtgaatgagggacag

SEQ ID NO: 11662 - DNA, 20 bp, Artificial
  CRISPR gRNA sequence
agtgaatgagggacagaggc

SEQ ID NO: 11663 - DNA, 20 bp, Artificial
  CRISPR gRNA sequence
gtgaatgagggacagaggct

SEQ ID NO: 11664 - DNA, 20 bp, Artificial
  CRISPR gRNA sequence
gagggacagaggctgggcaa

SEQ ID NO: 11665 - DNA, 20 bp, Artificial
  CRISPR gRNA sequence
ggacagaggctgggcaatgg

SEQ ID NO: 11666 - DNA, 20 bp, Artificial
  CRISPR gRNA sequence
cagaggctgggcaatggtgg

SEQ ID NO: 11667 - DNA, 20 bp, Artificial
  CRISPR gRNA sequence
aggctgggcaatggtggaag

SEQ ID NO: 11668 - DNA, 20 bp, Artificial
  CRISPR gRNA sequence
ggctgggcaatggtggaagt

SEQ ID NO: 11669 - DNA, 20 bp, Artificial
  CRISPR gRNA sequence
gctgggcaatggtggaagta

SEQ ID NO: 11670 - DNA, 20 bp, Artificial
  CRISPR gRNA sequence
ctgggcaatggtggaagtag

SEQ ID NO: 11671 - DNA, 20 bp, Artificial
  CRISPR gRNA sequence
gggcaatggtggaagtaggg

SEQ ID NO: 11672 - DNA, 20 bp, Artificial
  CRISPR gRNA sequence
ggcaatggtggaagtagggg

SEQ ID NO: 11673 - DNA, 20 bp, Artificial
  CRISPR gRNA sequence
atggtggaagtaggggaggt

SEQ ID NO: 11674 - DNA, 20 bp, Artificial
  CRISPR gRNA sequence
tggtggaagtaggggaggtc

SEQ ID NO: 11675 - DNA, 20 bp, Artificial
  CRISPR gRNA sequence
ggtggaagtaggggaggtca

SEQ ID NO: 11676 - DNA, 20 bp, Artificial
  CRISPR gRNA sequence
gtggaagtaggggaggtcag

SEQ ID NO: 11677 - DNA, 20 bp, Artificial
  CRISPR gRNA sequence
taggggaggtcaggggaatc

SEQ ID NO: 11678 - DNA, 20 bp, Artificial
  CRISPR gRNA sequence
tcaggggaatccagatcaca

SEQ ID NO: 11679 - DNA, 20 bp, Artificial
  CRISPR gRNA sequence
caggggaatccagatcacac

SEQ ID NO: 11680 - DNA, 20 bp, Artificial
  CRISPR gRNA sequence
aggggaatccagatcacaca

SEQ ID NO: 11681 - DNA, 20 bp, Artificial
  CRISPR gRNA sequence
gggaatccagatcacacagg

SEQ ID NO: 11682 - DNA, 20 bp, Artificial
  CRISPR gRNA sequence
ggaatccagatcacacaggg

SEQ ID NO: 11683 - DNA, 20 bp, Artificial
  CRISPR gRNA sequence
atcacacagggaggcccttg

SEQ ID NO: 11684 - DNA, 20 bp, Artificial
  CRISPR gRNA sequence
tcacacagggaggcccttgt

SEQ ID NO: 11685 - DNA, 20 bp, Artificial
  CRISPR gRNA sequence
gggaggcccttgtgggtcac

SEQ ID NO: 11686 - DNA, 20 bp, Artificial
  CRISPR gRNA sequence
gaggcccttgtgggtcacaa

SEQ ID NO: 11687 - DNA, 20 bp, Artificial
  CRISPR gRNA sequence
aggcccttgtgggtcacaag

SEQ ID NO: 11688 - DNA, 20 bp, Artificial
  CRISPR gRNA sequence
tgggtcacaagaggtatttg

SEQ ID NO: 11689 - DNA, 20 bp, Artificial
  CRISPR gRNA sequence
aagaggtatttgcagttttt

SEQ ID NO: 11690 - DNA, 20 bp, Artificial
  CRISPR gRNA sequence
ttgcagtttttcagtgtgaa

SEQ ID NO: 11691 - DNA, 20 bp, Artificial
  CRISPR gRNA sequence
gtttttcagtgtgaatggaa

SEQ ID NO: 11692 - DNA, 20 bp, Artificial
  CRISPR gRNA sequence
tttcagtgtgaatggaaaag

SEQ ID NO: 11693 - DNA, 20 bp, Artificial
  CRISPR gRNA sequence
ttcagtgtgaatggaaaagt

SEQ ID NO: 11694 - DNA, 20 bp, Artificial
  CRISPR gRNA sequence
agtgtgaatggaaaagtagg

SEQ ID NO: 11695 - DNA, 20 bp, Artificial
  CRISPR gRNA sequence
gtgtgaatggaaaagtaggt

SEQ ID NO: 11696 - DNA, 20 bp, Artificial
  CRISPR gRNA sequence
aatggaaaagtaggtgggcc

SEQ ID NO: 11697 - DNA, 20 bp, Artificial
  CRISPR gRNA sequence
atggaaaagtaggtgggcct

SEQ ID NO: 11698 - DNA, 20 bp, Artificial
  CRISPR gRNA sequence
gaaaagtaggtgggcctggg

SEQ ID NO: 11699 - DNA, 20 bp, Artificial
  CRISPR gRNA sequence
aaaagtaggtgggcctggga

SEQ ID NO: 11700 - DNA, 20 bp, Artificial
  CRISPR gRNA sequence
ttttcttttcttttcttttt

SEQ ID NO: 11701 - DNA, 20 bp, Artificial
  CRISPR gRNA sequence
tttcttttctttttgagacc

SEQ ID NO: 11702 - DNA, 20 bp, Artificial
  CRISPR gRNA sequence
ccaagtctcactttattgcc

SEQ ID NO: 11703 - DNA, 20 bp, Artificial
  CRISPR gRNA sequence
caagtctcactttattgccc

SEQ ID NO: 11704 - DNA, 20 bp, Artificial
  CRISPR gRNA sequence
ctcactttattgcccaggct

SEQ ID NO: 11705 - DNA, 20 bp, Artificial
  CRISPR gRNA sequence
tcactttattgcccaggcta

SEQ ID NO: 11706 - DNA, 20 bp, Artificial
  CRISPR gRNA sequence
ttattgcccaggctaaggtg

SEQ ID NO: 11707 - DNA, 20 bp, Artificial
  CRISPR gRNA sequence
ttgcccaggctaaggtgcag

SEQ ID NO: 11708 - DNA, 20 bp, Artificial
  CRISPR gRNA sequence
aaggtgcagtggcatgatct

SEQ ID NO: 11709 - DNA, 20 bp, Artificial
  CRISPR gRNA sequence
gcatgatctcagctcactgc

SEQ ID NO: 11710 - DNA, 20 bp, Artificial
  CRISPR gRNA sequence
tcactgcaagcactgcctcc

SEQ ID NO: 11711 - DNA, 20 bp, Artificial
  CRISPR gRNA sequence
cactgcaagcactgcctcct

SEQ ID NO: 11712 - DNA, 20 bp, Artificial
  CRISPR gRNA sequence
aagcactgcctcctgggttc

SEQ ID NO: 11713 - DNA, 20 bp, Artificial
  CRISPR gRNA sequence
ttcaagtgattctcatgcct

SEQ ID NO: 11714 - DNA, 20 bp, Artificial
  CRISPR gRNA sequence
ttctcatgcctcagcctccc

SEQ ID NO: 11715 - DNA, 20 bp, Artificial
  CRISPR gRNA sequence
tcatgcctcagcctcccaag

SEQ ID NO: 11716 - DNA, 20 bp, Artificial
  CRISPR gRNA sequence
gcctcagcctcccaagtagc

SEQ ID NO: 11717 - DNA, 20 bp, Artificial
  CRISPR gRNA sequence
cctcagcctcccaagtagct

SEQ ID NO: 11718 - DNA, 20 bp, Artificial
  CRISPR gRNA sequence
ctcccaagtagctgggatta

SEQ ID NO: 11719 - DNA, 20 bp, Artificial
  CRISPR gRNA sequence
acagatgcccgccaccacac

SEQ ID NO: 11720 - DNA, 20 bp, Artificial
  CRISPR gRNA sequence
cagatgcccgccaccacacc

SEQ ID NO: 11721 - DNA, 20 bp, Artificial
  CRISPR gRNA sequence
ccaggctatttttgtgtttt

SEQ ID NO: 11722 - DNA, 20 bp, Artificial
  CRISPR gRNA sequence
ggctatttttgtgttttcag

SEQ ID NO: 11723 - DNA, 20 bp, Artificial
  CRISPR gRNA sequence
ctatttttgtgttttcagta

SEQ ID NO: 11724 - DNA, 20 bp, Artificial
  CRISPR gRNA sequence
ttttgtgttttcagtagaga

SEQ ID NO: 11725 - DNA, 20 bp, Artificial
  CRISPR gRNA sequence
tttgtgttttcagtagagac

SEQ ID NO: 11726 - DNA, 20 bp, Artificial
  CRISPR gRNA sequence
ttgtgttttcagtagagaca

SEQ ID NO: 11727 - DNA, 20 bp, Artificial
  CRISPR gRNA sequence
agagacagggcttcgccatg

SEQ ID NO: 11728 - DNA, 20 bp, Artificial
  CRISPR gRNA sequence
cagggcttcgccatgtggcc

SEQ ID NO: 11729 - DNA, 20 bp, Artificial
  CRISPR gRNA sequence
cttcgccatgtggcccagac

SEQ ID NO: 11730 - DNA, 20 bp, Artificial
  CRISPR gRNA sequence
ccagactggtcttgaaatcc

SEQ ID NO: 11731 - DNA, 20 bp, Artificial
  CRISPR gRNA sequence
cagactggtcttgaaatcct

SEQ ID NO: 11732 - DNA, 20 bp, Artificial
  CRISPR gRNA sequence
ggtcttgaaatcctgggccc

SEQ ID NO: 11733 - DNA, 20 bp, Artificial
  CRISPR gRNA sequence
cccaagcgatccacccacct

SEQ ID NO: 11734 - DNA, 20 bp, Artificial
  CRISPR gRNA sequence
ccacccacctcagccttcca

SEQ ID NO: 11735 - DNA, 20 bp, Artificial
  CRISPR gRNA sequence
acctcagccttccaaagtgc

SEQ ID NO: 11736 - DNA, 20 bp, Artificial
  CRISPR gRNA sequence
cctcagccttccaaagtgct

SEQ ID NO: 11737 - DNA, 20 bp, Artificial
  CRISPR gRNA sequence
cttccaaagtgctgggatta

SEQ ID NO: 11738 - DNA, 20 bp, Artificial
  CRISPR gRNA sequence
ttccaaagtgctgggattac

SEQ ID NO: 11739 - DNA, 20 bp, Artificial
  CRISPR gRNA sequence
agtgctgggattacgggtgt

SEQ ID NO: 11740 - DNA, 20 bp, Artificial
  CRISPR gRNA sequence
cgggtgtgagccaccatgcc

SEQ ID NO: 11741 - DNA, 20 bp, Artificial
  CRISPR gRNA sequence
cccagcctgatttacccttt

SEQ ID NO: 11742 - DNA, 20 bp, Artificial
  CRISPR gRNA sequence
ttaagaaacatcatatttca

SEQ ID NO: 11743 - DNA, 20 bp, Artificial
  CRISPR gRNA sequence
catcatatttcatggaatct

SEQ ID NO: 11744 - DNA, 20 bp, Artificial
  CRISPR gRNA sequence
tctaagatgccatccattgt

SEQ ID NO: 11745 - DNA, 20 bp, Artificial
  CRISPR gRNA sequence
ccattgtaagaccccaatat

SEQ ID NO: 11746 - DNA, 20 bp, Artificial
  CRISPR gRNA sequence
cattgtaagaccccaatatg

SEQ ID NO: 11747 - DNA, 20 bp, Artificial
  CRISPR gRNA sequence
tgcaaactgtgacacgctat

SEQ ID NO: 11748 - DNA, 20 bp, Artificial
  CRISPR gRNA sequence
tgtgacacgctattggttat

SEQ ID NO: 11749 - DNA, 20 bp, Artificial
  CRISPR gRNA sequence
tgatctcaatgatattcaaa

SEQ ID NO: 11750 - DNA, 20 bp, Artificial
  CRISPR gRNA sequence
aaatggtgacatatatgtct

SEQ ID NO: 11751 - DNA, 20 bp, Artificial
  CRISPR gRNA sequence
gtcttggcatcgatgaaata

SEQ ID NO: 11752 - DNA, 20 bp, Artificial
  CRISPR gRNA sequence
tggcatcgatgaaatatggt

SEQ ID NO: 11753 - DNA, 20 bp, Artificial
  CRISPR gRNA sequence
tggtcagattactctccctg

SEQ ID NO: 11754 - DNA, 20 bp, Artificial
  CRISPR gRNA sequence
ggtcagattactctccctgt

SEQ ID NO: 11755 - DNA, 20 bp, Artificial
  CRISPR gRNA sequence
gtcagattactctccctgtg

SEQ ID NO: 11756 - DNA, 20 bp, Artificial
  CRISPR gRNA sequence
agattactctccctgtgggg

SEQ ID NO: 11757 - DNA, 20 bp, Artificial
  CRISPR gRNA sequence
attactctccctgtggggtg

SEQ ID NO: 11758 - DNA, 20 bp, Artificial
  CRISPR gRNA sequence
ttactctccctgtggggtgg

SEQ ID NO: 11759 - DNA, 20 bp, Artificial
  CRISPR gRNA sequence
ctctccctgtggggtggagg

SEQ ID NO: 11760 - DNA, 20 bp, Artificial
  CRISPR gRNA sequence
tctccctgtggggtggagga

SEQ ID NO: 11761 - DNA, 20 bp, Artificial
  CRISPR gRNA sequence
ctccctgtggggtggaggaa

SEQ ID NO: 11762 - DNA, 20 bp, Artificial
  CRISPR gRNA sequence
tggggtggaggaagggtctc

SEQ ID NO: 11763 - DNA, 20 bp, Artificial
  CRISPR gRNA sequence
ggggtggaggaagggtctcc

SEQ ID NO: 11764 - DNA, 20 bp, Artificial
  CRISPR gRNA sequence
gggtggaggaagggtctcca

SEQ ID NO: 11765 - DNA, 20 bp, Artificial
  CRISPR gRNA sequence
gaggaagggtctccagggtt

SEQ ID NO: 11766 - DNA, 20 bp, Artificial
  CRISPR gRNA sequence
ggaagggtctccagggttca

SEQ ID NO: 11767 - DNA, 20 bp, Artificial
  CRISPR gRNA sequence
gagattgcaaaacccccatc

SEQ ID NO: 11768 - DNA, 20 bp, Artificial
  CRISPR gRNA sequence
cccccatctagtttctgcac

SEQ ID NO: 11769 - DNA, 20 bp, Artificial
  CRISPR gRNA sequence
tctagtttctgcactggtac

SEQ ID NO: 11770 - DNA, 20 bp, Artificial
  CRISPR gRNA sequence
taccggccgacccgtgatgt

SEQ ID NO: 11771 - DNA, 20 bp, Artificial
  CRISPR gRNA sequence
acccgtgatgtgagttgatt

SEQ ID NO: 11772 - DNA, 20 bp, Artificial
  CRISPR gRNA sequence
tgatttagcctgaatccact

SEQ ID NO: 11773 - DNA, 20 bp, Artificial
  CRISPR gRNA sequence
tttagcctgaatccacttgg

SEQ ID NO: 11774 - DNA, 20 bp, Artificial
  CRISPR gRNA sequence
agcctgaatccacttggcag

SEQ ID NO: 11775 - DNA, 20 bp, Artificial
  CRISPR gRNA sequence
tatttttttctttttttttc

SEQ ID NO: 11776 - DNA, 20 bp, Artificial
  CRISPR gRNA sequence
tttttctttttttttcgaga

SEQ ID NO: 11777 - DNA, 20 bp, Artificial
  CRISPR gRNA sequence
tttctttttttttcgagaca

SEQ ID NO: 11778 - DNA, 20 bp, Artificial
  CRISPR gRNA sequence
agagtttcgctcttgttgcc

SEQ ID NO: 11779 - DNA, 20 bp, Artificial
  CRISPR gRNA sequence
gagtttcgctcttgttgcca

SEQ ID NO: 11780 - DNA, 20 bp, Artificial
  CRISPR gRNA sequence
ttcgctcttgttgccaaggc

SEQ ID NO: 11781 - DNA, 20 bp, Artificial
  CRISPR gRNA sequence
cgctcttgttgccaaggctg

SEQ ID NO: 11782 - DNA, 20 bp, Artificial
  CRISPR gRNA sequence
ttgttgccaaggctggagtg

SEQ ID NO: 11783 - DNA, 20 bp, Artificial
  CRISPR gRNA sequence
ccaaggctggagtgcagtct

SEQ ID NO: 11784 - DNA, 20 bp, Artificial
  CRISPR gRNA sequence
tcactgcaactccgcctccc

SEQ ID NO: 11785 - DNA, 20 bp, Artificial
  CRISPR gRNA sequence
caactccgcctcccgagttc

SEQ ID NO: 11786 - DNA, 20 bp, Artificial
  CRISPR gRNA sequence
ttcaagcaattctcctgcct

SEQ ID NO: 11787 - DNA, 20 bp, Artificial
  CRISPR gRNA sequence
ttctcctgcctcagcctctc

SEQ ID NO: 11788 - DNA, 20 bp, Artificial
  CRISPR gRNA sequence
tcctgcctcagcctctcaag

SEQ ID NO: 11789 - DNA, 20 bp, Artificial
  CRISPR gRNA sequence
gcctcagcctctcaagtagc

SEQ ID NO: 11790 - DNA, 20 bp, Artificial
  CRISPR gRNA sequence
cctcagcctctcaagtagct

SEQ ID NO: 11791 - DNA, 20 bp, Artificial
  CRISPR gRNA sequence
tcagcctctcaagtagctgg

SEQ ID NO: 11792 - DNA, 20 bp, Artificial
  CRISPR gRNA sequence
ctctcaagtagctgggagta

SEQ ID NO: 11793 - DNA, 20 bp, Artificial
  CRISPR gRNA sequence
tctcaagtagctgggagtat

SEQ ID NO: 11794 - DNA, 20 bp, Artificial
  CRISPR gRNA sequence
taggcatgtgccatcacacc

SEQ ID NO: 11795 - DNA, 20 bp, Artificial
  CRISPR gRNA sequence
cccggctaattttgtatttt

SEQ ID NO: 11796 - DNA, 20 bp, Artificial
  CRISPR gRNA sequence
ggctaattttgtatttttag

SEQ ID NO: 11797 - DNA, 20 bp, Artificial
  CRISPR gRNA sequence
ctaattttgtatttttagta

SEQ ID NO: 11798 - DNA, 20 bp, Artificial
  CRISPR gRNA sequence
ttttgtatttttagtagaga

SEQ ID NO: 11799 - DNA, 20 bp, Artificial
  CRISPR gRNA sequence
tttgtatttttagtagagac

SEQ ID NO: 11800 - DNA, 20 bp, Artificial
  CRISPR gRNA sequence
ttgtatttttagtagagacg

SEQ ID NO: 11801 - DNA, 20 bp, Artificial
  CRISPR gRNA sequence
gagacggggtttctccatgt

SEQ ID NO: 11802 - DNA, 20 bp, Artificial
  CRISPR gRNA sequence
cggggtttctccatgttggt

SEQ ID NO: 11803 - DNA, 20 bp, Artificial
  CRISPR gRNA sequence
ggggtttctccatgttggtc

SEQ ID NO: 11804 - DNA, 20 bp, Artificial
  CRISPR gRNA sequence
tttctccatgttggtcaggc

SEQ ID NO: 11805 - DNA, 20 bp, Artificial
  CRISPR gRNA sequence
tggtctcaaactcccgacct

SEQ ID NO: 11806 - DNA, 20 bp, Artificial
  CRISPR gRNA sequence
ggtctcaaactcccgacctt

SEQ ID NO: 11807 - DNA, 20 bp, Artificial
  CRISPR gRNA sequence
cttaggtgatccacccgcct

SEQ ID NO: 11808 - DNA, 20 bp, Artificial
  CRISPR gRNA sequence
tccacccgcctcggcctcca

SEQ ID NO: 11809 - DNA, 20 bp, Artificial
  CRISPR gRNA sequence
cgcctcggcctccaaagtgt

SEQ ID NO: 11810 - DNA, 20 bp, Artificial
  CRISPR gRNA sequence
gcctcggcctccaaagtgtt

SEQ ID NO: 11811 - DNA, 20 bp, Artificial
  CRISPR gRNA sequence
cctccaaagtgttaggatta

SEQ ID NO: 11812 - DNA, 20 bp, Artificial
  CRISPR gRNA sequence
ctccaaagtgttaggattac

SEQ ID NO: 11813 - DNA, 20 bp, Artificial
  CRISPR gRNA sequence
agtgttaggattacaggcgt

SEQ ID NO: 11814 - DNA, 20 bp, Artificial
  CRISPR gRNA sequence
gcacctgctgcttttatatg

SEQ ID NO: 11815 - DNA, 20 bp, Artificial
  CRISPR gRNA sequence
gcttttatatgcagccctgc

SEQ ID NO: 11816 - DNA, 20 bp, Artificial
  CRISPR gRNA sequence
cttttatatgcagccctgca

SEQ ID NO: 11817 - DNA, 20 bp, Artificial
  CRISPR gRNA sequence
ttttatatgcagccctgcaa

SEQ ID NO: 11818 - DNA, 20 bp, Artificial
  CRISPR gRNA sequence
ttatatgcagccctgcaagg

SEQ ID NO: 11819 - DNA, 20 bp, Artificial
  CRISPR gRNA sequence
cagccctgcaagggagttct

SEQ ID NO: 11820 - DNA, 20 bp, Artificial
  CRISPR gRNA sequence
agccctgcaagggagttctg

SEQ ID NO: 11821 - DNA, 20 bp, Artificial
  CRISPR gRNA sequence
ggagttctgaggctgaatca

SEQ ID NO: 11822 - DNA, 20 bp, Artificial
  CRISPR gRNA sequence
tctgaggctgaatcatggca

SEQ ID NO: 11823 - DNA, 20 bp, Artificial
  CRISPR gRNA sequence
gctgaatcatggcaaagtca

SEQ ID NO: 11824 - DNA, 20 bp, Artificial
  CRISPR gRNA sequence
tggccctgaaatcatacccg

SEQ ID NO: 11825 - DNA, 20 bp, Artificial
  CRISPR gRNA sequence
ccctgaaatcatacccgcag

SEQ ID NO: 11826 - DNA, 20 bp, Artificial
  CRISPR gRNA sequence
agcagcacctgacctgttaa

SEQ ID NO: 11827 - DNA, 20 bp, Artificial
  CRISPR gRNA sequence
gcagcacctgacctgttaaa

SEQ ID NO: 11828 - DNA, 20 bp, Artificial
  CRISPR gRNA sequence
tgacctgttaaaaggctgct

SEQ ID NO: 11829 - DNA, 20 bp, Artificial
  CRISPR gRNA sequence
ttaaaaggctgcttggtgtc

SEQ ID NO: 11830 - DNA, 20 bp, Artificial
  CRISPR gRNA sequence
gctgcttggtgtcgagtaaa

SEQ ID NO: 11831 - DNA, 20 bp, Artificial
  CRISPR gRNA sequence
tggtgtcgagtaaacagctg

SEQ ID NO: 11832 - DNA, 20 bp, Artificial
  CRISPR gRNA sequence
gtcgagtaaacagctgaagt

SEQ ID NO: 11833 - DNA, 20 bp, Artificial
  CRISPR gRNA sequence
taaacagctgaagttggcat

SEQ ID NO: 11834 - DNA, 20 bp, Artificial
  CRISPR gRNA sequence
attttcactgctactaatgc

SEQ ID NO: 11835 - DNA, 20 bp, Artificial
  CRISPR gRNA sequence
tgctggttgtgaatatgctg

SEQ ID NO: 11836 - DNA, 20 bp, Artificial
  CRISPR gRNA sequence
tgtgaatatgctgcagaaac

SEQ ID NO: 11837 - DNA, 20 bp, Artificial
  CRISPR gRNA sequence
tgaatatgctgcagaaactg

SEQ ID NO: 11838 - DNA, 20 bp, Artificial
  CRISPR gRNA sequence
tatgctgcagaaactggagc

SEQ ID NO: 11839 - DNA, 20 bp, Artificial
  CRISPR gRNA sequence
tgcagaaactggagctggtc

SEQ ID NO: 11840 - DNA, 20 bp, Artificial
  CRISPR gRNA sequence
actggagctggtccagtgac

SEQ ID NO: 11841 - DNA, 20 bp, Artificial
  CRISPR gRNA sequence
gctttttctcttcctgcccc

SEQ ID NO: 11842 - DNA, 20 bp, Artificial
  CRISPR gRNA sequence
tctcttcctgcccccagtgc

SEQ ID NO: 11843 - DNA, 20 bp, Artificial
  CRISPR gRNA sequence
tcaccaatgttcctgtgatg

SEQ ID NO: 11844 - DNA, 20 bp, Artificial
  CRISPR gRNA sequence
caatgttcctgtgatgtagt

SEQ ID NO: 11845 - DNA, 20 bp, Artificial
  CRISPR gRNA sequence
ctgtgatgtagtcagaacca

SEQ ID NO: 11846 - DNA, 20 bp, Artificial
  CRISPR gRNA sequence
tcagaaccatagctaacatt

SEQ ID NO: 11847 - DNA, 20 bp, Artificial
  CRISPR gRNA sequence
agctaacatttagttcattc

SEQ ID NO: 11848 - DNA, 20 bp, Artificial
  CRISPR gRNA sequence
gctaacatttagttcattct

SEQ ID NO: 11849 - DNA, 20 bp, Artificial
  CRISPR gRNA sequence
tttagttcattctaggcacc

SEQ ID NO: 11850 - DNA, 20 bp, Artificial
  CRISPR gRNA sequence
ttagttcattctaggcacca

SEQ ID NO: 11851 - DNA, 20 bp, Artificial
  CRISPR gRNA sequence
gcatgttctaaatgttatat

SEQ ID NO: 11852 - DNA, 20 bp, Artificial
  CRISPR gRNA sequence
actctatcatgcccatttta

SEQ ID NO: 11853 - DNA, 20 bp, Artificial
  CRISPR gRNA sequence
tatcatgcccattttacaga

SEQ ID NO: 11854 - DNA, 20 bp, Artificial
  CRISPR gRNA sequence
atcatgcccattttacagat

SEQ ID NO: 11855 - DNA, 20 bp, Artificial
  CRISPR gRNA sequence
attttacagatgggcaaact

SEQ ID NO: 11856 - DNA, 20 bp, Artificial
  CRISPR gRNA sequence
cagatgggcaaactgagtct

SEQ ID NO: 11857 - DNA, 20 bp, Artificial
  CRISPR gRNA sequence
atgggcaaactgagtctcag

SEQ ID NO: 11858 - DNA, 20 bp, Artificial
  CRISPR gRNA sequence
gggcaaactgagtctcagaa

SEQ ID NO: 11859 - DNA, 20 bp, Artificial
  CRISPR gRNA sequence
aactgagtctcagaagagtt

SEQ ID NO: 11860 - DNA, 20 bp, Artificial
  CRISPR gRNA sequence
tgagtctcagaagagttgag

SEQ ID NO: 11861 - DNA, 20 bp, Artificial
  CRISPR gRNA sequence
aagagttgagtagcttgccc

SEQ ID NO: 11862 - DNA, 20 bp, Artificial
  CRISPR gRNA sequence
agagttgagtagcttgccca

SEQ ID NO: 11863 - DNA, 20 bp, Artificial
  CRISPR gRNA sequence
gtagcttgcccaaggtcaca

SEQ ID NO: 11864 - DNA, 20 bp, Artificial
  CRISPR gRNA sequence
tagcttgcccaaggtcacat

SEQ ID NO: 11865 - DNA, 20 bp, Artificial
  CRISPR gRNA sequence
cttgcccaaggtcacatagg

SEQ ID NO: 11866 - DNA, 20 bp, Artificial
  CRISPR gRNA sequence
cccaaggtcacataggcagt

SEQ ID NO: 11867 - DNA, 20 bp, Artificial
  CRISPR gRNA sequence
caaggtcacataggcagtaa

SEQ ID NO: 11868 - DNA, 20 bp, Artificial
  CRISPR gRNA sequence
aaggtcacataggcagtaag

SEQ ID NO: 11869 - DNA, 20 bp, Artificial
  CRISPR gRNA sequence
cacataggcagtaagaggca

SEQ ID NO: 11870 - DNA, 20 bp, Artificial
  CRISPR gRNA sequence
taggcagtaagaggcatagc

SEQ ID NO: 11871 - DNA, 20 bp, Artificial
  CRISPR gRNA sequence
aggcagtaagaggcatagct

SEQ ID NO: 11872 - DNA, 20 bp, Artificial
  CRISPR gRNA sequence
gcatagctgggatttgaact

SEQ ID NO: 11873 - DNA, 20 bp, Artificial
  CRISPR gRNA sequence
catagctgggatttgaactt

SEQ ID NO: 11874 - DNA, 20 bp, Artificial
  CRISPR gRNA sequence
agctgggatttgaacttggg

SEQ ID NO: 11875 - DNA, 20 bp, Artificial
  CRISPR gRNA sequence
aacttgggaagttgttctga

SEQ ID NO: 11876 - DNA, 20 bp, Artificial
  CRISPR gRNA sequence
ttgttctgacagtttccaca

SEQ ID NO: 11877 - DNA, 20 bp, Artificial
  CRISPR gRNA sequence
tctgacagtttccacacagt

SEQ ID NO: 11878 - DNA, 20 bp, Artificial
  CRISPR gRNA sequence
ctgacagtttccacacagta

SEQ ID NO: 11879 - DNA, 20 bp, Artificial
  CRISPR gRNA sequence
cagtttccacacagtaaggc

SEQ ID NO: 11880 - DNA, 20 bp, Artificial
  CRISPR gRNA sequence
ggcaagaaatgacttccttt

SEQ ID NO: 11881 - DNA, 20 bp, Artificial
  CRISPR gRNA sequence
ttttagtcctgctgttttcc

SEQ ID NO: 11882 - DNA, 20 bp, Artificial
  CRISPR gRNA sequence
tttagtcctgctgttttcct

SEQ ID NO: 11883 - DNA, 20 bp, Artificial
  CRISPR gRNA sequence
ctgggctcactgtttgacca

SEQ ID NO: 11884 - DNA, 20 bp, Artificial
  CRISPR gRNA sequence
gggctcactgtttgaccaca

SEQ ID NO: 11885 - DNA, 20 bp, Artificial
  CRISPR gRNA sequence
ctcactgtttgaccacagag

SEQ ID NO: 11886 - DNA, 20 bp, Artificial
  CRISPR gRNA sequence
actgtttgaccacagagaag

SEQ ID NO: 11887 - DNA, 20 bp, Artificial
  CRISPR gRNA sequence
gagaagtggtctcaactctc

SEQ ID NO: 11888 - DNA, 20 bp, Artificial
  CRISPR gRNA sequence
agaagtggtctcaactctct

SEQ ID NO: 11889 - DNA, 20 bp, Artificial
  CRISPR gRNA sequence
ggtctcaactctctgggtct

SEQ ID NO: 11890 - DNA, 20 bp, Artificial
  CRISPR gRNA sequence
tggtttgcctgtctttaaaa

SEQ ID NO: 11891 - DNA, 20 bp, Artificial
  CRISPR gRNA sequence
ggtttgcctgtctttaaaat

SEQ ID NO: 11892 - DNA, 20 bp, Artificial
  CRISPR gRNA sequence
gtttgcctgtctttaaaatg

SEQ ID NO: 11893 - DNA, 20 bp, Artificial
  CRISPR gRNA sequence
tgcctgtctttaaaatgggg

SEQ ID NO: 11894 - DNA, 20 bp, Artificial
  CRISPR gRNA sequence
ttaaaatggggcagtaatcc

SEQ ID NO: 11895 - DNA, 20 bp, Artificial
  CRISPR gRNA sequence
aaatggggcagtaatcccag

SEQ ID NO: 11896 - DNA, 20 bp, Artificial
  CRISPR gRNA sequence
aatggggcagtaatcccagt

SEQ ID NO: 11897 - DNA, 20 bp, Artificial
  CRISPR gRNA sequence
ggggcagtaatcccagtagg

SEQ ID NO: 11898 - DNA, 20 bp, Artificial
  CRISPR gRNA sequence
ccagtaggtggtgactccca

SEQ ID NO: 11899 - DNA, 20 bp, Artificial
  CRISPR gRNA sequence
cagtaggtggtgactcccac

SEQ ID NO: 11900 - DNA, 20 bp, Artificial
  CRISPR gRNA sequence
agtaggtggtgactcccacg

SEQ ID NO: 11901 - DNA, 20 bp, Artificial
  CRISPR gRNA sequence
actcccacggggctgacctc

SEQ ID NO: 11902 - DNA, 20 bp, Artificial
  CRISPR gRNA sequence
ctcccacggggctgacctcc

SEQ ID NO: 11903 - DNA, 20 bp, Artificial
  CRISPR gRNA sequence
cggggctgacctccaggctg

SEQ ID NO: 11904 - DNA, 20 bp, Artificial
  CRISPR gRNA sequence
ggggctgacctccaggctgc

SEQ ID NO: 11905 - DNA, 20 bp, Artificial
  CRISPR gRNA sequence
gggctgacctccaggctgca

SEQ ID NO: 11906 - DNA, 20 bp, Artificial
  CRISPR gRNA sequence
ggctgacctccaggctgcag

SEQ ID NO: 11907 - DNA, 20 bp, Artificial
  CRISPR gRNA sequence
tccaggctgcaggggacact

SEQ ID NO: 11908 - DNA, 20 bp, Artificial
  CRISPR gRNA sequence
tgcaggggacactgagatcc

SEQ ID NO: 11909 - DNA, 20 bp, Artificial
  CRISPR gRNA sequence
aggggacactgagatcctag

SEQ ID NO: 11910 - DNA, 20 bp, Artificial
  CRISPR gRNA sequence
gatcctagaagcaatcacca

SEQ ID NO: 11911 - DNA, 20 bp, Artificial
  CRISPR gRNA sequence
caatcaccacagccctgaac

SEQ ID NO: 11912 - DNA, 20 bp, Artificial
  CRISPR gRNA sequence
atcaccacagccctgaacaa

SEQ ID NO: 11913 - DNA, 20 bp, Artificial
  CRISPR gRNA sequence
acagccctgaacaagagaac

SEQ ID NO: 11914 - DNA, 20 bp, Artificial
  CRISPR gRNA sequence
gccctgaacaagagaactag

SEQ ID NO: 11915 - DNA, 20 bp, Artificial
  CRISPR gRNA sequence
ccctgaacaagagaactagt

SEQ ID NO: 11916 - DNA, 20 bp, Artificial
  CRISPR gRNA sequence
acaagagaactagtgggacc

SEQ ID NO: 11917 - DNA, 20 bp, Artificial
  CRISPR gRNA sequence
caagagaactagtgggacct

SEQ ID NO: 11918 - DNA, 20 bp, Artificial
  CRISPR gRNA sequence
aagagaactagtgggacctg

SEQ ID NO: 11919 - DNA, 20 bp, Artificial
  CRISPR gRNA sequence
gaactagtgggacctgggga

SEQ ID NO: 11920 - DNA, 20 bp, Artificial
  CRISPR gRNA sequence
gacctggggacagaaacttt

SEQ ID NO: 11921 - DNA, 20 bp, Artificial
  CRISPR gRNA sequence
tggggacagaaactttgagc

SEQ ID NO: 11922 - DNA, 20 bp, Artificial
  CRISPR gRNA sequence
gcaagtcacttattcattcc

SEQ ID NO: 11923 - DNA, 20 bp, Artificial
  CRISPR gRNA sequence
ctagcctctattttcatatc

SEQ ID NO: 11924 - DNA, 20 bp, Artificial
  CRISPR gRNA sequence
ctattttcatatctagaaaa

SEQ ID NO: 11925 - DNA, 20 bp, Artificial
  CRISPR gRNA sequence
tattttcatatctagaaaat

SEQ ID NO: 11926 - DNA, 20 bp, Artificial
  CRISPR gRNA sequence
gaaaatgggaaccatcccaa

SEQ ID NO: 11927 - DNA, 20 bp, Artificial
  CRISPR gRNA sequence
accatcccaatggcctatgt

SEQ ID NO: 11928 - DNA, 20 bp, Artificial
  CRISPR gRNA sequence
caatggcctatgtaagtact

SEQ ID NO: 11929 - DNA, 20 bp, Artificial
  CRISPR gRNA sequence
gtaagtacttggcacaatgc

SEQ ID NO: 11930 - DNA, 20 bp, Artificial
  CRISPR gRNA sequence
taagtacttggcacaatgcc

SEQ ID NO: 11931 - DNA, 20 bp, Artificial
  CRISPR gRNA sequence
taaatattgattccttcccc

SEQ ID NO: 11932 - DNA, 20 bp, Artificial
  CRISPR gRNA sequence
aaatattgattccttccccc

SEQ ID NO: 11933 - DNA, 20 bp, Artificial
  CRISPR gRNA sequence
aatattgattccttccccca

SEQ ID NO: 11934 - DNA, 20 bp, Artificial
  CRISPR gRNA sequence
ttgattccttcccccaggga

SEQ ID NO: 11935 - DNA, 20 bp, Artificial
  CRISPR gRNA sequence
attccttcccccagggatag

SEQ ID NO: 11936 - DNA, 20 bp, Artificial
  CRISPR gRNA sequence
ttccttcccccagggatagt

SEQ ID NO: 11937 - DNA, 20 bp, Artificial
  CRISPR gRNA sequence
tcccccagggatagtgggac

SEQ ID NO: 11938 - DNA, 20 bp, Artificial
  CRISPR gRNA sequence
cccccagggatagtgggacc

SEQ ID NO: 11939 - DNA, 20 bp, Artificial
  CRISPR gRNA sequence
tagtgggaccaggctttttc

SEQ ID NO: 11940 - DNA, 20 bp, Artificial
  CRISPR gRNA sequence
accaggctttttctggaatc

SEQ ID NO: 11941 - DNA, 20 bp, Artificial
  CRISPR gRNA sequence
ccaggctttttctggaatct

SEQ ID NO: 11942 - DNA, 20 bp, Artificial
  CRISPR gRNA sequence
caggctttttctggaatcta

SEQ ID NO: 11943 - DNA, 20 bp, Artificial
  CRISPR gRNA sequence
ctttttctggaatctaggga

SEQ ID NO: 11944 - DNA, 20 bp, Artificial
  CRISPR gRNA sequence
tttctggaatctagggatgg

SEQ ID NO: 11945 - DNA, 20 bp, Artificial
  CRISPR gRNA sequence
aatctagggatggtggcttc

SEQ ID NO: 11946 - DNA, 20 bp, Artificial
  CRISPR gRNA sequence
ctagggatggtggcttctgg

SEQ ID NO: 11947 - DNA, 20 bp, Artificial
  CRISPR gRNA sequence
tagggatggtggcttctgga

SEQ ID NO: 11948 - DNA, 20 bp, Artificial
  CRISPR gRNA sequence
tctggaaggctgaccatgca

SEQ ID NO: 11949 - DNA, 20 bp, Artificial
  CRISPR gRNA sequence
ctggaaggctgaccatgcac

SEQ ID NO: 11950 - DNA, 20 bp, Artificial
  CRISPR gRNA sequence
aggcctccaatccctccccc

SEQ ID NO: 11951 - DNA, 20 bp, Artificial
  CRISPR gRNA sequence
cccctggcctctgtttccga

SEQ ID NO: 11952 - DNA, 20 bp, Artificial
  CRISPR gRNA sequence
caataactgcatctgcgacg

SEQ ID NO: 11953 - DNA, 20 bp, Artificial
  CRISPR gRNA sequence
aataactgcatctgcgacgt

SEQ ID NO: 11954 - DNA, 20 bp, Artificial
  CRISPR gRNA sequence
taactgcatctgcgacgtgg

SEQ ID NO: 11955 - DNA, 20 bp, Artificial
  CRISPR gRNA sequence
gcatctgcgacgtgggagcc

SEQ ID NO: 11956 - DNA, 20 bp, Artificial
  CRISPR gRNA sequence
atctgcgacgtgggagccga

SEQ ID NO: 11957 - DNA, 20 bp, Artificial
  CRISPR gRNA sequence
cgacgtgggagccgagagct

SEQ ID NO: 11958 - DNA, 20 bp, Artificial
  CRISPR gRNA sequence
gagcttggctcgtgtgcttc

SEQ ID NO: 11959 - DNA, 20 bp, Artificial
  CRISPR gRNA sequence
ggctcgtgtgcttccggaca

SEQ ID NO: 11960 - DNA, 20 bp, Artificial
  CRISPR gRNA sequence
ttccggacatggtgtccctc

SEQ ID NO: 11961 - DNA, 20 bp, Artificial
  CRISPR gRNA sequence
tccggacatggtgtccctcc

SEQ ID NO: 11962 - DNA, 20 bp, Artificial
  CRISPR gRNA sequence
catggtgtccctccgggtga

SEQ ID NO: 11963 - DNA, 20 bp, Artificial
  CRISPR gRNA sequence
tggtgtccctccgggtgatg

SEQ ID NO: 11964 - DNA, 20 bp, Artificial
  CRISPR gRNA sequence
gtccctccgggtgatggagt

SEQ ID NO: 11965 - DNA, 20 bp, Artificial
  CRISPR gRNA sequence
tccgggtgatggagtgagtg

SEQ ID NO: 11966 - DNA, 20 bp, Artificial
  CRISPR gRNA sequence
ccgggtgatggagtgagtgt

SEQ ID NO: 11967 - DNA, 20 bp, Artificial
  CRISPR gRNA sequence
gggtgatggagtgagtgtgg

SEQ ID NO: 11968 - DNA, 20 bp, Artificial
  CRISPR gRNA sequence
atggagtgagtgtgggagtc

SEQ ID NO: 11969 - DNA, 20 bp, Artificial
  CRISPR gRNA sequence
tggagtgagtgtgggagtct

SEQ ID NO: 11970 - DNA, 20 bp, Artificial
  CRISPR gRNA sequence
agtgagtgtgggagtctggg

SEQ ID NO: 11971 - DNA, 20 bp, Artificial
  CRISPR gRNA sequence
gagtgtgggagtctgggcgg

SEQ ID NO: 11972 - DNA, 20 bp, Artificial
  CRISPR gRNA sequence
agtgtgggagtctgggcggt

SEQ ID NO: 11973 - DNA, 20 bp, Artificial
  CRISPR gRNA sequence
gtgggagtctgggcggtggg

SEQ ID NO: 11974 - DNA, 20 bp, Artificial
  CRISPR gRNA sequence
agtctgggcggtgggtggct

SEQ ID NO: 11975 - DNA, 20 bp, Artificial
  CRISPR gRNA sequence
gggcggtgggtggctcagcc

SEQ ID NO: 11976 - DNA, 20 bp, Artificial
  CRISPR gRNA sequence
ggcggtgggtggctcagccc

SEQ ID NO: 11977 - DNA, 20 bp, Artificial
  CRISPR gRNA sequence
gcggtgggtggctcagcccg

SEQ ID NO: 11978 - DNA, 20 bp, Artificial
  CRISPR gRNA sequence
gtgggtggctcagcccgggg

SEQ ID NO: 11979 - DNA, 20 bp, Artificial
  CRISPR gRNA sequence
tgggtggctcagcccggggt

SEQ ID NO: 11980 - DNA, 20 bp, Artificial
  CRISPR gRNA sequence
ggtggctcagcccggggtgg

SEQ ID NO: 11981 - DNA, 20 bp, Artificial
  CRISPR gRNA sequence
gcccggggtgggagacactg

SEQ ID NO: 11982 - DNA, 20 bp, Artificial
  CRISPR gRNA sequence
gagacactgaagtctctccc

SEQ ID NO: 11983 - DNA, 20 bp, Artificial
  CRISPR gRNA sequence
gaagtctctccctggtgtcc

SEQ ID NO: 11984 - DNA, 20 bp, Artificial
  CRISPR gRNA sequence
gtctctccctggtgtcctgg

SEQ ID NO: 11985 - DNA, 20 bp, Artificial
  CRISPR gRNA sequence
ctctccctggtgtcctggaa

SEQ ID NO: 11986 - DNA, 20 bp, Artificial
  CRISPR gRNA sequence
ccctggtgtcctggaagagc

SEQ ID NO: 11987 - DNA, 20 bp, Artificial
  CRISPR gRNA sequence
tgtcctggaagagctggatg

SEQ ID NO: 11988 - DNA, 20 bp, Artificial
  CRISPR gRNA sequence
gtcctggaagagctggatgt

SEQ ID NO: 11989 - DNA, 20 bp, Artificial
  CRISPR gRNA sequence
tcctggaagagctggatgtg

SEQ ID NO: 11990 - DNA, 20 bp, Artificial
  CRISPR gRNA sequence
cctggaagagctggatgtgg

SEQ ID NO: 11991 - DNA, 20 bp, Artificial
  CRISPR gRNA sequence
ggaagagctggatgtggggg

SEQ ID NO: 11992 - DNA, 20 bp, Artificial
  CRISPR gRNA sequence
gctggatgtgggggtggcct

SEQ ID NO: 11993 - DNA, 20 bp, Artificial
  CRISPR gRNA sequence
atgtgggggtggccttggtc

SEQ ID NO: 11994 - DNA, 20 bp, Artificial
  CRISPR gRNA sequence
gtgggggtggccttggtctg

SEQ ID NO: 11995 - DNA, 20 bp, Artificial
  CRISPR gRNA sequence
gggtggccttggtctggagc

SEQ ID NO: 11996 - DNA, 20 bp, Artificial
  CRISPR gRNA sequence
ggtggccttggtctggagct

SEQ ID NO: 11997 - DNA, 20 bp, Artificial
  CRISPR gRNA sequence
gtggccttggtctggagctg

SEQ ID NO: 11998 - DNA, 20 bp, Artificial
  CRISPR gRNA sequence
ggccttggtctggagctggg

SEQ ID NO: 11999 - DNA, 20 bp, Artificial
  CRISPR gRNA sequence
gtctggagctggggagtccc

SEQ ID NO: 12000 - DNA, 20 bp, Artificial
  CRISPR gRNA sequence
tctggagctggggagtccca

SEQ ID NO: 12001 - DNA, 20 bp, Artificial
  CRISPR gRNA sequence
ctggagctggggagtcccaa

SEQ ID NO: 12002 - DNA, 20 bp, Artificial
  CRISPR gRNA sequence
agctggggagtcccaagggc

SEQ ID NO: 12003 - DNA, 20 bp, Artificial
  CRISPR gRNA sequence
gctggggagtcccaagggcc

SEQ ID NO: 12004 - DNA, 20 bp, Artificial
  CRISPR gRNA sequence
agtcccaagggccaggcccc

SEQ ID NO: 12005 - DNA, 20 bp, Artificial
  CRISPR gRNA sequence
gtcccaagggccaggcccca

SEQ ID NO: 12006 - DNA, 20 bp, Artificial
  CRISPR gRNA sequence
caagggccaggccccaaggt

SEQ ID NO: 12007 - DNA, 20 bp, Artificial
  CRISPR gRNA sequence
ccaaggtgagtttctcttgc

SEQ ID NO: 12008 - DNA, 20 bp, Artificial
  CRISPR gRNA sequence
gagtttctcttgccagcgtc

SEQ ID NO: 12009 - DNA, 20 bp, Artificial
  CRISPR gRNA sequence
ttgccagcgtccagtacaac

SEQ ID NO: 12010 - DNA, 20 bp, Artificial
  CRISPR gRNA sequence
cgtccagtacaacaagttca

SEQ ID NO: 12011 - DNA, 20 bp, Artificial
  CRISPR gRNA sequence
tacaacaagttcacggctgc

SEQ ID NO: 12012 - DNA, 20 bp, Artificial
  CRISPR gRNA sequence
acaacaagttcacggctgcc

SEQ ID NO: 12013 - DNA, 20 bp, Artificial
  CRISPR gRNA sequence
caacaagttcacggctgccg

SEQ ID NO: 12014 - DNA, 20 bp, Artificial
  CRISPR gRNA sequence
agttcacggctgccggggcc

SEQ ID NO: 12015 - DNA, 20 bp, Artificial
  CRISPR gRNA sequence
tcacggctgccggggcccag

SEQ ID NO: 12016 - DNA, 20 bp, Artificial
  CRISPR gRNA sequence
ggggcccagcagctcgctgc

SEQ ID NO: 12017 - DNA, 20 bp, Artificial
  CRISPR gRNA sequence
agcagctcgctgccagcctt

SEQ ID NO: 12018 - DNA, 20 bp, Artificial
  CRISPR gRNA sequence
cagctcgctgccagccttcg

SEQ ID NO: 12019 - DNA, 20 bp, Artificial
  CRISPR gRNA sequence
agctcgctgccagccttcgg

SEQ ID NO: 12020 - DNA, 20 bp, Artificial
  CRISPR gRNA sequence
ccttcggaggtgtcctcatg

SEQ ID NO: 12021 - DNA, 20 bp, Artificial
  CRISPR gRNA sequence
ttcggaggtgtcctcatgtg

SEQ ID NO: 12022 - DNA, 20 bp, Artificial
  CRISPR gRNA sequence
gtgtcctcatgtggagacgc

SEQ ID NO: 12023 - DNA, 20 bp, Artificial
  CRISPR gRNA sequence
tcatgtggagacgctggcgt

SEQ ID NO: 12024 - DNA, 20 bp, Artificial
  CRISPR gRNA sequence
tggagacgctggcgtaagtc

SEQ ID NO: 12025 - DNA, 20 bp, Artificial
  CRISPR gRNA sequence
ggagacgctggcgtaagtcc

SEQ ID NO: 12026 - DNA, 20 bp, Artificial
  CRISPR gRNA sequence
ggcgtaagtccaggcaaccc

SEQ ID NO: 12027 - DNA, 20 bp, Artificial
  CRISPR gRNA sequence
gtaagtccaggcaaccctgg

SEQ ID NO: 12028 - DNA, 20 bp, Artificial
  CRISPR gRNA sequence
taagtccaggcaaccctggt

SEQ ID NO: 12029 - DNA, 20 bp, Artificial
  CRISPR gRNA sequence
gtccaggcaaccctggtggg

SEQ ID NO: 12030 - DNA, 20 bp, Artificial
  CRISPR gRNA sequence
ccaggcaaccctggtgggtg

SEQ ID NO: 12031 - DNA, 20 bp, Artificial
  CRISPR gRNA sequence
gtggagaacaactcactccc

SEQ ID NO: 12032 - DNA, 20 bp, Artificial
  CRISPR gRNA sequence
tggagaacaactcactcccc

SEQ ID NO: 12033 - DNA, 20 bp, Artificial
  CRISPR gRNA sequence
caactcactccccaggcgtg

SEQ ID NO: 12034 - DNA, 20 bp, Artificial
  CRISPR gRNA sequence
cactccccaggcgtgtggcc

SEQ ID NO: 12035 - DNA, 20 bp, Artificial
  CRISPR gRNA sequence
cgtgtggcccagtgtgaccc

SEQ ID NO: 12036 - DNA, 20 bp, Artificial
  CRISPR gRNA sequence
tgtggcccagtgtgaccccg

SEQ ID NO: 12037 - DNA, 20 bp, Artificial
  CRISPR gRNA sequence
ccttcaccaatctgcaaccc

SEQ ID NO: 12038 - DNA, 20 bp, Artificial
  CRISPR gRNA sequence
cttcaccaatctgcaaccct

SEQ ID NO: 12039 - DNA, 20 bp, Artificial
  CRISPR gRNA sequence
accaatctgcaaccctgggt

SEQ ID NO: 12040 - DNA, 20 bp, Artificial
  CRISPR gRNA sequence
aatctgcaaccctgggtgag

SEQ ID NO: 12041 - DNA, 20 bp, Artificial
  CRISPR gRNA sequence
tgagcagacacttccccctc

SEQ ID NO: 12042 - DNA, 20 bp, Artificial
  CRISPR gRNA sequence
gacacttccccctctggctt

SEQ ID NO: 12043 - DNA, 20 bp, Artificial
  CRISPR gRNA sequence
cttcagcttcttcatctgta

SEQ ID NO: 12044 - DNA, 20 bp, Artificial
  CRISPR gRNA sequence
cagcttcttcatctgtaaag

SEQ ID NO: 12045 - DNA, 20 bp, Artificial
  CRISPR gRNA sequence
agcttcttcatctgtaaagt

SEQ ID NO: 12046 - DNA, 20 bp, Artificial
  CRISPR gRNA sequence
gcttcttcatctgtaaagtg

SEQ ID NO: 12047 - DNA, 20 bp, Artificial
  CRISPR gRNA sequence
cttcatctgtaaagtgggga

SEQ ID NO: 12048 - DNA, 20 bp, Artificial
  CRISPR gRNA sequence
gacagtaataatatccaccc

SEQ ID NO: 12049 - DNA, 20 bp, Artificial
  CRISPR gRNA sequence
cagtaataatatccacccaa

SEQ ID NO: 12050 - DNA, 20 bp, Artificial
  CRISPR gRNA sequence
agtaataatatccacccaag

SEQ ID NO: 12051 - DNA, 20 bp, Artificial
  CRISPR gRNA sequence
atccacccaagaggttttgt

SEQ ID NO: 12052 - DNA, 20 bp, Artificial
  CRISPR gRNA sequence
tccacccaagaggttttgtg

SEQ ID NO: 12053 - DNA, 20 bp, Artificial
  CRISPR gRNA sequence
ttgtgaggcttaaactaatc

SEQ ID NO: 12054 - DNA, 20 bp, Artificial
  CRISPR gRNA sequence
taaactaatcaagccctaca

SEQ ID NO: 12055 - DNA, 20 bp, Artificial
  CRISPR gRNA sequence
ctacaaagctcttataacaa

SEQ ID NO: 12056 - DNA, 20 bp, Artificial
  CRISPR gRNA sequence
caaagctcttataacaacag

SEQ ID NO: 12057 - DNA, 20 bp, Artificial
  CRISPR gRNA sequence
gctcttataacaacagtagc

SEQ ID NO: 12058 - DNA, 20 bp, Artificial
  CRISPR gRNA sequence
aatgccaataaatgctatat

SEQ ID NO: 12059 - DNA, 20 bp, Artificial
  CRISPR gRNA sequence
atgccaataaatgctatatt

SEQ ID NO: 12060 - DNA, 20 bp, Artificial
  CRISPR gRNA sequence
ccatttttgacctgtaaaat

SEQ ID NO: 12061 - DNA, 20 bp, Artificial
  CRISPR gRNA sequence
gtaaaattggcaatttcata

SEQ ID NO: 12062 - DNA, 20 bp, Artificial
  CRISPR gRNA sequence
attggcaatttcatatggtt

SEQ ID NO: 12063 - DNA, 20 bp, Artificial
  CRISPR gRNA sequence
ttggcaatttcatatggttc

SEQ ID NO: 12064 - DNA, 20 bp, Artificial
  CRISPR gRNA sequence
gttcaggtttatcttttatt

SEQ ID NO: 12065 - DNA, 20 bp, Artificial
  CRISPR gRNA sequence
gtcaccatgatgtccaatac

SEQ ID NO: 12066 - DNA, 20 bp, Artificial
  CRISPR gRNA sequence
ggttactttatattctttca

SEQ ID NO: 12067 - DNA, 20 bp, Artificial
  CRISPR gRNA sequence
cacaatcactcacctcttct

SEQ ID NO: 12068 - DNA, 20 bp, Artificial
  CRISPR gRNA sequence
ctcacctcttctaagacgca

SEQ ID NO: 12069 - DNA, 20 bp, Artificial
  CRISPR gRNA sequence
tcacctcttctaagacgcac

SEQ ID NO: 12070 - DNA, 20 bp, Artificial
  CRISPR gRNA sequence
cacctcttctaagacgcaca

SEQ ID NO: 12071 - DNA, 20 bp, Artificial
  CRISPR gRNA sequence
ctcttctaagacgcacaggg

SEQ ID NO: 12072 - DNA, 20 bp, Artificial
  CRISPR gRNA sequence
tcttctaagacgcacagggt

SEQ ID NO: 12073 - DNA, 20 bp, Artificial
  CRISPR gRNA sequence
acgcacagggtgggtcttac

SEQ ID NO: 12074 - DNA, 20 bp, Artificial
  CRISPR gRNA sequence
gtcttacaagacccatttta

SEQ ID NO: 12075 - DNA, 20 bp, Artificial
  CRISPR gRNA sequence
acaagacccattttacagat

SEQ ID NO: 12076 - DNA, 20 bp, Artificial
  CRISPR gRNA sequence
caagacccattttacagatg

SEQ ID NO: 12077 - DNA, 20 bp, Artificial
  CRISPR gRNA sequence
ttttacagatgaggaaaata

SEQ ID NO: 12078 - DNA, 20 bp, Artificial
  CRISPR gRNA sequence
cagatgaggaaaataaagca

SEQ ID NO: 12079 - DNA, 20 bp, Artificial
  CRISPR gRNA sequence
gatgaggaaaataaagcaca

SEQ ID NO: 12080 - DNA, 20 bp, Artificial
  CRISPR gRNA sequence
gaggaaaataaagcacagag

SEQ ID NO: 12081 - DNA, 20 bp, Artificial
  CRISPR gRNA sequence
gagcagttaactaacctttc

SEQ ID NO: 12082 - DNA, 20 bp, Artificial
  CRISPR gRNA sequence
agcagttaactaacctttct

SEQ ID NO: 12083 - DNA, 20 bp, Artificial
  CRISPR gRNA sequence
gcagttaactaacctttctg

SEQ ID NO: 12084 - DNA, 20 bp, Artificial
  CRISPR gRNA sequence
ctaacctttctggggtcaca

SEQ ID NO: 12085 - DNA, 20 bp, Artificial
  CRISPR gRNA sequence
cctttctggggtcacacagc

SEQ ID NO: 12086 - DNA, 20 bp, Artificial
  CRISPR gRNA sequence
tctggggtcacacagcaagt

SEQ ID NO: 12087 - DNA, 20 bp, Artificial
  CRISPR gRNA sequence
gtcacacagcaagtcagctg

SEQ ID NO: 12088 - DNA, 20 bp, Artificial
  CRISPR gRNA sequence
aagtcagctgcagaaccata

SEQ ID NO: 12089 - DNA, 20 bp, Artificial
  CRISPR gRNA sequence
agtcagctgcagaaccataa

SEQ ID NO: 12090 - DNA, 20 bp, Artificial
  CRISPR gRNA sequence
gcagaaccataaaggaatct

SEQ ID NO: 12091 - DNA, 20 bp, Artificial
  CRISPR gRNA sequence
cagaaccataaaggaatctc

SEQ ID NO: 12092 - DNA, 20 bp, Artificial
  CRISPR gRNA sequence
taaaggaatctcgggcctcc

SEQ ID NO: 12093 - DNA, 20 bp, Artificial
  CRISPR gRNA sequence
aaaggaatctcgggcctcct

SEQ ID NO: 12094 - DNA, 20 bp, Artificial
  CRISPR gRNA sequence
cttttccccatgacccacac

SEQ ID NO: 12095 - DNA, 20 bp, Artificial
  CRISPR gRNA sequence
tccccatgacccacaccggt

SEQ ID NO: 12096 - DNA, 20 bp, Artificial
  CRISPR gRNA sequence
cacaccggtcggtatcttgc

SEQ ID NO: 12097 - DNA, 20 bp, Artificial
  CRISPR gRNA sequence
acaccggtcggtatcttgcc

SEQ ID NO: 12098 - DNA, 20 bp, Artificial
  CRISPR gRNA sequence
caccggtcggtatcttgcca

SEQ ID NO: 12099 - DNA, 20 bp, Artificial
  CRISPR gRNA sequence
accggtcggtatcttgccag

SEQ ID NO: 12100 - DNA, 20 bp, Artificial
  CRISPR gRNA sequence
tcggtatcttgccaggggaa

SEQ ID NO: 12101 - DNA, 20 bp, Artificial
  CRISPR gRNA sequence
gggaaaagtccccaacgttc

SEQ ID NO: 12102 - DNA, 20 bp, Artificial
  CRISPR gRNA sequence
ggaaaagtccccaacgttct

SEQ ID NO: 12103 - DNA, 20 bp, Artificial
  CRISPR gRNA sequence
aagtccccaacgttctaggc

SEQ ID NO: 12104 - DNA, 20 bp, Artificial
  CRISPR gRNA sequence
agtccccaacgttctaggct

SEQ ID NO: 12105 - DNA, 20 bp, Artificial
  CRISPR gRNA sequence
ccccaacgttctaggctggg

SEQ ID NO: 12106 - DNA, 20 bp, Artificial
  CRISPR gRNA sequence
caacgttctaggctgggtgg

SEQ ID NO: 12107 - DNA, 20 bp, Artificial
  CRISPR gRNA sequence
aacgttctaggctgggtgga

SEQ ID NO: 12108 - DNA, 20 bp, Artificial
  CRISPR gRNA sequence
cgttctaggctgggtggaag

SEQ ID NO: 12109 - DNA, 20 bp, Artificial
  CRISPR gRNA sequence
gttctaggctgggtggaagg

SEQ ID NO: 12110 - DNA, 20 bp, Artificial
  CRISPR gRNA sequence
ttctaggctgggtggaagga

SEQ ID NO: 12111 - DNA, 20 bp, Artificial
  CRISPR gRNA sequence
gctgggtggaaggagggatt

SEQ ID NO: 12112 - DNA, 20 bp, Artificial
  CRISPR gRNA sequence
ctgggtggaaggagggattt

SEQ ID NO: 12113 - DNA, 20 bp, Artificial
  CRISPR gRNA sequence
tgggtggaaggagggatttg

SEQ ID NO: 12114 - DNA, 20 bp, Artificial
  CRISPR gRNA sequence
gggtggaaggagggatttgg

SEQ ID NO: 12115 - DNA, 20 bp, Artificial
  CRISPR gRNA sequence
tggaaggagggatttggggg

SEQ ID NO: 12116 - DNA, 20 bp, Artificial
  CRISPR gRNA sequence
gatttgggggcagctgtcac

SEQ ID NO: 12117 - DNA, 20 bp, Artificial
  CRISPR gRNA sequence
atttgggggcagctgtcact

SEQ ID NO: 12118 - DNA, 20 bp, Artificial
  CRISPR gRNA sequence
tttgggggcagctgtcactg

SEQ ID NO: 12119 - DNA, 20 bp, Artificial
  CRISPR gRNA sequence
ggcagctgtcactggggccc

SEQ ID NO: 12120 - DNA, 20 bp, Artificial
  CRISPR gRNA sequence
gcagctgtcactggggcccc

SEQ ID NO: 12121 - DNA, 20 bp, Artificial
  CRISPR gRNA sequence
ccgccctctctcctctaacc

SEQ ID NO: 12122 - DNA, 20 bp, Artificial
  CRISPR gRNA sequence
ctctcctctaacctggctct

SEQ ID NO: 12123 - DNA, 20 bp, Artificial
  CRISPR gRNA sequence
ctgagtcccatccccccttg

SEQ ID NO: 12124 - DNA, 20 bp, Artificial
  CRISPR gRNA sequence
tgagtcccatccccccttgc

SEQ ID NO: 12125 - DNA, 20 bp, Artificial
  CRISPR gRNA sequence
ccatccccccttgcaggatg

SEQ ID NO: 12126 - DNA, 20 bp, Artificial
  CRISPR gRNA sequence
tggacgcccaccatcccatt

SEQ ID NO: 12127 - DNA, 20 bp, Artificial
  CRISPR gRNA sequence
ccaccatcccattcagtgtc

SEQ ID NO: 12128 - DNA, 20 bp, Artificial
  CRISPR gRNA sequence
caccatcccattcagtgtcc

SEQ ID NO: 12129 - DNA, 20 bp, Artificial
  CRISPR gRNA sequence
tccaggaacacctgcaacaa

SEQ ID NO: 12130 - DNA, 20 bp, Artificial
  CRISPR gRNA sequence
ccaggaacacctgcaacaac

SEQ ID NO: 12131 - DNA, 20 bp, Artificial
  CRISPR gRNA sequence
acctgcaacaacaggattca

SEQ ID NO: 12132 - DNA, 20 bp, Artificial
  CRISPR gRNA sequence
caacaacaggattcacggat

SEQ ID NO: 12133 - DNA, 20 bp, Artificial
  CRISPR gRNA sequence
caggattcacggatcagcct

SEQ ID NO: 12134 - DNA, 20 bp, Artificial
  CRISPR gRNA sequence
ggatcagcctgagatgatcc

SEQ ID NO: 12135 - DNA, 20 bp, Artificial
  CRISPR gRNA sequence
agatgatcccagctgtgctc

SEQ ID NO: 12136 - DNA, 20 bp, Artificial
  CRISPR gRNA sequence
gatcccagctgtgctctgga

SEQ ID NO: 12137 - DNA, 20 bp, Artificial
  CRISPR gRNA sequence
atcccagctgtgctctggac

SEQ ID NO: 12138 - DNA, 20 bp, Artificial
  CRISPR gRNA sequence
tcccagctgtgctctggaca

SEQ ID NO: 12139 - DNA, 20 bp, Artificial
  CRISPR gRNA sequence
tgtgctctggacagggtaac

SEQ ID NO: 12140 - DNA, 20 bp, Artificial
  CRISPR gRNA sequence
gtgctctggacagggtaacc

SEQ ID NO: 12141 - DNA, 20 bp, Artificial
  CRISPR gRNA sequence
tgctctggacagggtaacca

SEQ ID NO: 12142 - DNA, 20 bp, Artificial
  CRISPR gRNA sequence
tctggacagggtaaccaggg

SEQ ID NO: 12143 - DNA, 20 bp, Artificial
  CRISPR gRNA sequence
ctggacagggtaaccagggt

SEQ ID NO: 12144 - DNA, 20 bp, Artificial
  CRISPR gRNA sequence
cagggtaaccagggtgggct

SEQ ID NO: 12145 - DNA, 20 bp, Artificial
  CRISPR gRNA sequence
agggtaaccagggtgggctt

SEQ ID NO: 12146 - DNA, 20 bp, Artificial
  CRISPR gRNA sequence
ggtaaccagggtgggcttgg

SEQ ID NO: 12147 - DNA, 20 bp, Artificial
  CRISPR gRNA sequence
gtaaccagggtgggcttggg

SEQ ID NO: 12148 - DNA, 20 bp, Artificial
  CRISPR gRNA sequence
taaccagggtgggcttggga

SEQ ID NO: 12149 - DNA, 20 bp, Artificial
  CRISPR gRNA sequence
aaccagggtgggcttgggag

SEQ ID NO: 12150 - DNA, 20 bp, Artificial
  CRISPR gRNA sequence
ccagggtgggcttgggaggg

SEQ ID NO: 12151 - DNA, 20 bp, Artificial
  CRISPR gRNA sequence
agggtgggcttgggagggga

SEQ ID NO: 12152 - DNA, 20 bp, Artificial
  CRISPR gRNA sequence
ggcttgggaggggagagccg

SEQ ID NO: 12153 - DNA, 20 bp, Artificial
  CRISPR gRNA sequence
ttgggaggggagagccgcag

SEQ ID NO: 12154 - DNA, 20 bp, Artificial
  CRISPR gRNA sequence
tgggaggggagagccgcagt

SEQ ID NO: 12155 - DNA, 20 bp, Artificial
  CRISPR gRNA sequence
aggggagagccgcagtgggt

SEQ ID NO: 12156 - DNA, 20 bp, Artificial
  CRISPR gRNA sequence
ggggagagccgcagtgggtt

SEQ ID NO: 12157 - DNA, 20 bp, Artificial
  CRISPR gRNA sequence
gggagagccgcagtgggttg

SEQ ID NO: 12158 - DNA, 20 bp, Artificial
  CRISPR gRNA sequence
ggagagccgcagtgggttgg

SEQ ID NO: 12159 - DNA, 20 bp, Artificial
  CRISPR gRNA sequence
gagccgcagtgggttggggg

SEQ ID NO: 12160 - DNA, 20 bp, Artificial
  CRISPR gRNA sequence
ttgggggcagtgtccttgtg

SEQ ID NO: 12161 - DNA, 20 bp, Artificial
  CRISPR gRNA sequence
tgggggcagtgtccttgtga

SEQ ID NO: 12162 - DNA, 20 bp, Artificial
  CRISPR gRNA sequence
gggcagtgtccttgtgaagg

SEQ ID NO: 12163 - DNA, 20 bp, Artificial
  CRISPR gRNA sequence
tttttgaatgccaccttcac

SEQ ID NO: 12164 - DNA, 20 bp, Artificial
  CRISPR gRNA sequence
ttttgaatgccaccttcaca

SEQ ID NO: 12165 - DNA, 20 bp, Artificial
  CRISPR gRNA sequence
acactgcccccaacccactg

SEQ ID NO: 12166 - DNA, 20 bp, Artificial
  CRISPR gRNA sequence
cactgcggctctcccctccc

SEQ ID NO: 12167 - DNA, 20 bp, Artificial
  CRISPR gRNA sequence
ctcccctcccaagcccaccc

SEQ ID NO: 12168 - DNA, 20 bp, Artificial
  CRISPR gRNA sequence
cccaccctggttaccctgtc

SEQ ID NO: 12169 - DNA, 20 bp, Artificial
  CRISPR gRNA sequence
caccctggttaccctgtcca

SEQ ID NO: 12170 - DNA, 20 bp, Artificial
  CRISPR gRNA sequence
tggttaccctgtccagagca

SEQ ID NO: 12171 - DNA, 20 bp, Artificial
  CRISPR gRNA sequence
taccctgtccagagcacagc

SEQ ID NO: 12172 - DNA, 20 bp, Artificial
  CRISPR gRNA sequence
accctgtccagagcacagct

SEQ ID NO: 12173 - DNA, 20 bp, Artificial
  CRISPR gRNA sequence
gagcacagctgggatcatct

SEQ ID NO: 12174 - DNA, 20 bp, Artificial
  CRISPR gRNA sequence
agcacagctgggatcatctc

SEQ ID NO: 12175 - DNA, 20 bp, Artificial
  CRISPR gRNA sequence
atccgtgaatcctgttgttg

SEQ ID NO: 12176 - DNA, 20 bp, Artificial
  CRISPR gRNA sequence
tccgtgaatcctgttgttgc

SEQ ID NO: 12177 - DNA, 20 bp, Artificial
  CRISPR gRNA sequence
cctgttgttgcaggtgttcc

SEQ ID NO: 12178 - DNA, 20 bp, Artificial
  CRISPR gRNA sequence
aggtgttcctggacactgaa

SEQ ID NO: 12179 - DNA, 20 bp, Artificial
  CRISPR gRNA sequence
ggtgttcctggacactgaat

SEQ ID NO: 12180 - DNA, 20 bp, Artificial
  CRISPR gRNA sequence
ttcctggacactgaatggga

SEQ ID NO: 12181 - DNA, 20 bp, Artificial
  CRISPR gRNA sequence
ctggacactgaatgggatgg

SEQ ID NO: 12182 - DNA, 20 bp, Artificial
  CRISPR gRNA sequence
tggacactgaatgggatggt

SEQ ID NO: 12183 - DNA, 20 bp, Artificial
  CRISPR gRNA sequence
ggtgggcgtccacatcctgc

SEQ ID NO: 12184 - DNA, 20 bp, Artificial
  CRISPR gRNA sequence
gtgggcgtccacatcctgca

SEQ ID NO: 12185 - DNA, 20 bp, Artificial
  CRISPR gRNA sequence
tgggcgtccacatcctgcaa

SEQ ID NO: 12186 - DNA, 20 bp, Artificial
  CRISPR gRNA sequence
gggcgtccacatcctgcaag

SEQ ID NO: 12187 - DNA, 20 bp, Artificial
  CRISPR gRNA sequence
ggcgtccacatcctgcaagg

SEQ ID NO: 12188 - DNA, 20 bp, Artificial
  CRISPR gRNA sequence
gcgtccacatcctgcaaggg

SEQ ID NO: 12189 - DNA, 20 bp, Artificial
  CRISPR gRNA sequence
ccacatcctgcaagggggga

SEQ ID NO: 12190 - DNA, 20 bp, Artificial
  CRISPR gRNA sequence
cacatcctgcaaggggggat

SEQ ID NO: 12191 - DNA, 20 bp, Artificial
  CRISPR gRNA sequence
ctgcaaggggggatgggact

SEQ ID NO: 12192 - DNA, 20 bp, Artificial
  CRISPR gRNA sequence
gcaaggggggatgggactca

SEQ ID NO: 12193 - DNA, 20 bp, Artificial
  CRISPR gRNA sequence
ggggggatgggactcagagc

SEQ ID NO: 12194 - DNA, 20 bp, Artificial
  CRISPR gRNA sequence
gggggatgggactcagagcc

SEQ ID NO: 12195 - DNA, 20 bp, Artificial
  CRISPR gRNA sequence
gatgggactcagagccaggt

SEQ ID NO: 12196 - DNA, 20 bp, Artificial
  CRISPR gRNA sequence
tgggactcagagccaggtta

SEQ ID NO: 12197 - DNA, 20 bp, Artificial
  CRISPR gRNA sequence
gggactcagagccaggttag

SEQ ID NO: 12198 - DNA, 20 bp, Artificial
  CRISPR gRNA sequence
gactcagagccaggttagag

SEQ ID NO: 12199 - DNA, 20 bp, Artificial
  CRISPR gRNA sequence
ctcagagccaggttagagga

SEQ ID NO: 12200 - DNA, 20 bp, Artificial
  CRISPR gRNA sequence
cagagccaggttagaggaga

SEQ ID NO: 12201 - DNA, 20 bp, Artificial
  CRISPR gRNA sequence
agagccaggttagaggagag

SEQ ID NO: 12202 - DNA, 20 bp, Artificial
  CRISPR gRNA sequence
gagccaggttagaggagaga

SEQ ID NO: 12203 - DNA, 20 bp, Artificial
  CRISPR gRNA sequence
ccaggttagaggagagaggg

SEQ ID NO: 12204 - DNA, 20 bp, Artificial
  CRISPR gRNA sequence
ttagaggagagagggcggcc

SEQ ID NO: 12205 - DNA, 20 bp, Artificial
  CRISPR gRNA sequence
tagaggagagagggcggcct

SEQ ID NO: 12206 - DNA, 20 bp, Artificial
  CRISPR gRNA sequence
agaggagagagggcggcctg

SEQ ID NO: 12207 - DNA, 20 bp, Artificial
  CRISPR gRNA sequence
gagagggcggcctggggccc

SEQ ID NO: 12208 - DNA, 20 bp, Artificial
  CRISPR gRNA sequence
gcggcctggggccccagtga

SEQ ID NO: 12209 - DNA, 20 bp, Artificial
  CRISPR gRNA sequence
cccaaatccctccttccacc

SEQ ID NO: 12210 - DNA, 20 bp, Artificial
  CRISPR gRNA sequence
atccctccttccacccagcc

SEQ ID NO: 12211 - DNA, 20 bp, Artificial
  CRISPR gRNA sequence
ttccacccagcctagaacgt

SEQ ID NO: 12212 - DNA, 20 bp, Artificial
  CRISPR gRNA sequence
tccacccagcctagaacgtt

SEQ ID NO: 12213 - DNA, 20 bp, Artificial
  CRISPR gRNA sequence
ccacccagcctagaacgttg

SEQ ID NO: 12214 - DNA, 20 bp, Artificial
  CRISPR gRNA sequence
aacgttggggacttttcccc

SEQ ID NO: 12215 - DNA, 20 bp, Artificial
  CRISPR gRNA sequence
ttggggacttttcccctggc

SEQ ID NO: 12216 - DNA, 20 bp, Artificial
  CRISPR gRNA sequence
tcccctggcaagataccgac

SEQ ID NO: 12217 - DNA, 20 bp, Artificial
  CRISPR gRNA sequence
tggcaagataccgaccggtg

SEQ ID NO: 12218 - DNA, 20 bp, Artificial
  CRISPR gRNA sequence
ggcaagataccgaccggtgt

SEQ ID NO: 12219 - DNA, 20 bp, Artificial
  CRISPR gRNA sequence
ataccgaccggtgtgggtca

SEQ ID NO: 12220 - DNA, 20 bp, Artificial
  CRISPR gRNA sequence
taccgaccggtgtgggtcat

SEQ ID NO: 12221 - DNA, 20 bp, Artificial
  CRISPR gRNA sequence
accgaccggtgtgggtcatg

SEQ ID NO: 12222 - DNA, 20 bp, Artificial
  CRISPR gRNA sequence
ccggtgtgggtcatggggaa

SEQ ID NO: 12223 - DNA, 20 bp, Artificial
  CRISPR gRNA sequence
cggtgtgggtcatggggaaa

SEQ ID NO: 12224 - DNA, 20 bp, Artificial
  CRISPR gRNA sequence
gtgtgggtcatggggaaaag

SEQ ID NO: 12225 - DNA, 20 bp, Artificial
  CRISPR gRNA sequence
tgggtcatggggaaaaggag

SEQ ID NO: 12226 - DNA, 20 bp, Artificial
  CRISPR gRNA sequence
catggggaaaaggagaagcc

SEQ ID NO: 12227 - DNA, 20 bp, Artificial
  CRISPR gRNA sequence
atggggaaaaggagaagcct

SEQ ID NO: 12228 - DNA, 20 bp, Artificial
  CRISPR gRNA sequence
ggggaaaaggagaagcctag

SEQ ID NO: 12229 - DNA, 20 bp, Artificial
  CRISPR gRNA sequence
gggaaaaggagaagcctagg

SEQ ID NO: 12230 - DNA, 20 bp, Artificial
  CRISPR gRNA sequence
aggagaagcctaggaggccc

SEQ ID NO: 12231 - DNA, 20 bp, Artificial
  CRISPR gRNA sequence
ggaggcccgagattccttta

SEQ ID NO: 12232 - DNA, 20 bp, Artificial
  CRISPR gRNA sequence
gagattcctttatggttctg

SEQ ID NO: 12233 - DNA, 20 bp, Artificial
  CRISPR gRNA sequence
gctgacttgctgtgtgaccc

SEQ ID NO: 12234 - DNA, 20 bp, Artificial
  CRISPR gRNA sequence
acttgctgtgtgaccccaga

SEQ ID NO: 12235 - DNA, 20 bp, Artificial
  CRISPR gRNA sequence
cttgctgtgtgaccccagaa

SEQ ID NO: 12236 - DNA, 20 bp, Artificial
  CRISPR gRNA sequence
ctgtgtgaccccagaaaggt

SEQ ID NO: 12237 - DNA, 20 bp, Artificial
  CRISPR gRNA sequence
tattttcctcatctgtaaaa

SEQ ID NO: 12238 - DNA, 20 bp, Artificial
  CRISPR gRNA sequence
attttcctcatctgtaaaat

SEQ ID NO: 12239 - DNA, 20 bp, Artificial
  CRISPR gRNA sequence
atctgtaaaatgggtcttgt

SEQ ID NO: 12240 - DNA, 20 bp, Artificial
  CRISPR gRNA sequence
aagacccaccctgtgcgtct

SEQ ID NO: 12241 - DNA, 20 bp, Artificial
  CRISPR gRNA sequence
acccaccctgtgcgtcttag

SEQ ID NO: 12242 - DNA, 20 bp, Artificial
  CRISPR gRNA sequence
ccaccctgtgcgtcttagaa

SEQ ID NO: 12243 - DNA, 20 bp, Artificial
  CRISPR gRNA sequence
caccctgtgcgtcttagaag

SEQ ID NO: 12244 - DNA, 20 bp, Artificial
  CRISPR gRNA sequence
ctgtgcgtcttagaagaggt

SEQ ID NO: 12245 - DNA, 20 bp, Artificial
  CRISPR gRNA sequence
ttagaagaggtgagtgattg

SEQ ID NO: 12246 - DNA, 20 bp, Artificial
  CRISPR gRNA sequence
agaagaggtgagtgattgtg

SEQ ID NO: 12247 - DNA, 20 bp, Artificial
  CRISPR gRNA sequence
gtgagtgattgtggagataa

SEQ ID NO: 12248 - DNA, 20 bp, Artificial
  CRISPR gRNA sequence
tggagataaaagtgctttga

SEQ ID NO: 12249 - DNA, 20 bp, Artificial
  CRISPR gRNA sequence
aagtgctttgaaagaatata

SEQ ID NO: 12250 - DNA, 20 bp, Artificial
  CRISPR gRNA sequence
ttgaaagaatataaagtaac

SEQ ID NO: 12251 - DNA, 20 bp, Artificial
  CRISPR gRNA sequence
gaatataaagtaaccagtat

SEQ ID NO: 12252 - DNA, 20 bp, Artificial
  CRISPR gRNA sequence
gtaaccagtattggacatca

SEQ ID NO: 12253 - DNA, 20 bp, Artificial
  CRISPR gRNA sequence
acatcatggtgacttaataa

SEQ ID NO: 12254 - DNA, 20 bp, Artificial
  CRISPR gRNA sequence
atatgaaattgccaatttta

SEQ ID NO: 12255 - DNA, 20 bp, Artificial
  CRISPR gRNA sequence
tatgaaattgccaattttac

SEQ ID NO: 12256 - DNA, 20 bp, Artificial
  CRISPR gRNA sequence
ccaattttacaggtcaaaaa

SEQ ID NO: 12257 - DNA, 20 bp, Artificial
  CRISPR gRNA sequence
caattttacaggtcaaaaat

SEQ ID NO: 12258 - DNA, 20 bp, Artificial
  CRISPR gRNA sequence
ttttacaggtcaaaaatggg

SEQ ID NO: 12259 - DNA, 20 bp, Artificial
  CRISPR gRNA sequence
ggtcaaaaatgggtggatgt

SEQ ID NO: 12260 - DNA, 20 bp, Artificial
  CRISPR gRNA sequence
tggatgtcagcaatttcata

SEQ ID NO: 12261 - DNA, 20 bp, Artificial
  CRISPR gRNA sequence
gtcagcaatttcatatggtt

SEQ ID NO: 12262 - DNA, 20 bp, Artificial
  CRISPR gRNA sequence
tcatatggttcagcctaata

SEQ ID NO: 12263 - DNA, 20 bp, Artificial
  CRISPR gRNA sequence
cagcctaatatagcatttat

SEQ ID NO: 12264 - DNA, 20 bp, Artificial
  CRISPR gRNA sequence
ttattggcatttttgtgtgc

SEQ ID NO: 12265 - DNA, 20 bp, Artificial
  CRISPR gRNA sequence
gtgccagctactgttgttat

SEQ ID NO: 12266 - DNA, 20 bp, Artificial
  CRISPR gRNA sequence
gccagctactgttgttataa

SEQ ID NO: 12267 - DNA, 20 bp, Artificial
  CRISPR gRNA sequence
ctgttgttataagagctttg

SEQ ID NO: 12268 - DNA, 20 bp, Artificial
  CRISPR gRNA sequence
tgttgttataagagctttgt

SEQ ID NO: 12269 - DNA, 20 bp, Artificial
  CRISPR gRNA sequence
gttgttataagagctttgta

SEQ ID NO: 12270 - DNA, 20 bp, Artificial
  CRISPR gRNA sequence
agagctttgtagggcttgat

SEQ ID NO: 12271 - DNA, 20 bp, Artificial
  CRISPR gRNA sequence
ttgtagggcttgattagttt

SEQ ID NO: 12272 - DNA, 20 bp, Artificial
  CRISPR gRNA sequence
ttaagcctcacaaaacctct

SEQ ID NO: 12273 - DNA, 20 bp, Artificial
  CRISPR gRNA sequence
taagcctcacaaaacctctt

SEQ ID NO: 12274 - DNA, 20 bp, Artificial
  CRISPR gRNA sequence
gcctcacaaaacctcttggg

SEQ ID NO: 12275 - DNA, 20 bp, Artificial
  CRISPR gRNA sequence
ttattactgtccccacttta

SEQ ID NO: 12276 - DNA, 20 bp, Artificial
  CRISPR gRNA sequence
ctgtccccactttacagatg

SEQ ID NO: 12277 - DNA, 20 bp, Artificial
  CRISPR gRNA sequence
tccccactttacagatgaag

SEQ ID NO: 12278 - DNA, 20 bp, Artificial
  CRISPR gRNA sequence
ctttacagatgaagaagctg

SEQ ID NO: 12279 - DNA, 20 bp, Artificial
  CRISPR gRNA sequence
acagatgaagaagctgaagc

SEQ ID NO: 12280 - DNA, 20 bp, Artificial
  CRISPR gRNA sequence
agatgaagaagctgaagcca

SEQ ID NO: 12281 - DNA, 20 bp, Artificial
  CRISPR gRNA sequence
gatgaagaagctgaagccag

SEQ ID NO: 12282 - DNA, 20 bp, Artificial
  CRISPR gRNA sequence
atgaagaagctgaagccaga

SEQ ID NO: 12283 - DNA, 20 bp, Artificial
  CRISPR gRNA sequence
tgaagaagctgaagccagag

SEQ ID NO: 12284 - DNA, 20 bp, Artificial
  CRISPR gRNA sequence
gaagaagctgaagccagagg

SEQ ID NO: 12285 - DNA, 20 bp, Artificial
  CRISPR gRNA sequence
gaagctgaagccagaggggg

SEQ ID NO: 12286 - DNA, 20 bp, Artificial
  CRISPR gRNA sequence
gggggaagtgtctgctcacc

SEQ ID NO: 12287 - DNA, 20 bp, Artificial
  CRISPR gRNA sequence
ggggaagtgtctgctcaccc

SEQ ID NO: 12288 - DNA, 20 bp, Artificial
  CRISPR gRNA sequence
gggaagtgtctgctcaccca

SEQ ID NO: 12289 - DNA, 20 bp, Artificial
  CRISPR gRNA sequence
tgtctgctcacccagggttg

SEQ ID NO: 12290 - DNA, 20 bp, Artificial
  CRISPR gRNA sequence
gctcacccagggttgcagat

SEQ ID NO: 12291 - DNA, 20 bp, Artificial
  CRISPR gRNA sequence
cccagggttgcagattggtg

SEQ ID NO: 12292 - DNA, 20 bp, Artificial
  CRISPR gRNA sequence
ccagggttgcagattggtga

SEQ ID NO: 12293 - DNA, 20 bp, Artificial
  CRISPR gRNA sequence
cagggttgcagattggtgaa

SEQ ID NO: 12294 - DNA, 20 bp, Artificial
  CRISPR gRNA sequence
ggttgcagattggtgaaggg

SEQ ID NO: 12295 - DNA, 20 bp, Artificial
  CRISPR gRNA sequence
ttgcagattggtgaagggaa

SEQ ID NO: 12296 - DNA, 20 bp, Artificial
  CRISPR gRNA sequence
tgaagggaagagcatgattt

SEQ ID NO: 12297 - DNA, 20 bp, Artificial
  CRISPR gRNA sequence
gaagagcatgatttgagctc

SEQ ID NO: 12298 - DNA, 20 bp, Artificial
  CRISPR gRNA sequence
aagagcatgatttgagctcc

SEQ ID NO: 12299 - DNA, 20 bp, Artificial
  CRISPR gRNA sequence
agagcatgatttgagctccg

SEQ ID NO: 12300 - DNA, 20 bp, Artificial
  CRISPR gRNA sequence
tttgagctccggggtcacac

SEQ ID NO: 12301 - DNA, 20 bp, Artificial
  CRISPR gRNA sequence
ttgagctccggggtcacact

SEQ ID NO: 12302 - DNA, 20 bp, Artificial
  CRISPR gRNA sequence
gtcacactgggccacacgcc

SEQ ID NO: 12303 - DNA, 20 bp, Artificial
  CRISPR gRNA sequence
tcacactgggccacacgcct

SEQ ID NO: 12304 - DNA, 20 bp, Artificial
  CRISPR gRNA sequence
cacactgggccacacgcctg

SEQ ID NO: 12305 - DNA, 20 bp, Artificial
  CRISPR gRNA sequence
cactgggccacacgcctggg

SEQ ID NO: 12306 - DNA, 20 bp, Artificial
  CRISPR gRNA sequence
gggccacacgcctggggagt

SEQ ID NO: 12307 - DNA, 20 bp, Artificial
  CRISPR gRNA sequence
gtgagttgttctccacccac

SEQ ID NO: 12308 - DNA, 20 bp, Artificial
  CRISPR gRNA sequence
tgagttgttctccacccacc

SEQ ID NO: 12309 - DNA, 20 bp, Artificial
  CRISPR gRNA sequence
gagttgttctccacccacca

SEQ ID NO: 12310 - DNA, 20 bp, Artificial
  CRISPR gRNA sequence
ctccacccaccagggttgcc

SEQ ID NO: 12311 - DNA, 20 bp, Artificial
  CRISPR gRNA sequence
agggttgcctggacttacgc

SEQ ID NO: 12312 - DNA, 20 bp, Artificial
  CRISPR gRNA sequence
ttacgccagcgtctccacat

SEQ ID NO: 12313 - DNA, 20 bp, Artificial
  CRISPR gRNA sequence
tacgccagcgtctccacatg

SEQ ID NO: 12314 - DNA, 20 bp, Artificial
  CRISPR gRNA sequence
tccacatgaggacacctccg

SEQ ID NO: 12315 - DNA, 20 bp, Artificial
  CRISPR gRNA sequence
ccacatgaggacacctccga

SEQ ID NO: 12316 - DNA, 20 bp, Artificial
  CRISPR gRNA sequence
atgaggacacctccgaaggc

SEQ ID NO: 12317 - DNA, 20 bp, Artificial
  CRISPR gRNA sequence
aggacacctccgaaggctgg

SEQ ID NO: 12318 - DNA, 20 bp, Artificial
  CRISPR gRNA sequence
cacctccgaaggctggcagc

SEQ ID NO: 12319 - DNA, 20 bp, Artificial
  CRISPR gRNA sequence
gaaggctggcagcgagctgc

SEQ ID NO: 12320 - DNA, 20 bp, Artificial
  CRISPR gRNA sequence
aaggctggcagcgagctgct

SEQ ID NO: 12321 - DNA, 20 bp, Artificial
  CRISPR gRNA sequence
ggcagcgagctgctgggccc

SEQ ID NO: 12322 - DNA, 20 bp, Artificial
  CRISPR gRNA sequence
agcgagctgctgggccccgg

SEQ ID NO: 12323 - DNA, 20 bp, Artificial
  CRISPR gRNA sequence
cagccgtgaacttgttgtac

SEQ ID NO: 12324 - DNA, 20 bp, Artificial
  CRISPR gRNA sequence
gaacttgttgtactggacgc

SEQ ID NO: 12325 - DNA, 20 bp, Artificial
  CRISPR gRNA sequence
ttgttgtactggacgctggc

SEQ ID NO: 12326 - DNA, 20 bp, Artificial
  CRISPR gRNA sequence
gttgtactggacgctggcaa

SEQ ID NO: 12327 - DNA, 20 bp, Artificial
  CRISPR gRNA sequence
ctggcaagagaaactcacct

SEQ ID NO: 12328 - DNA, 20 bp, Artificial
  CRISPR gRNA sequence
tggcaagagaaactcacctt

SEQ ID NO: 12329 - DNA, 20 bp, Artificial
  CRISPR gRNA sequence
ggcaagagaaactcaccttg

SEQ ID NO: 12330 - DNA, 20 bp, Artificial
  CRISPR gRNA sequence
gagaaactcaccttggggcc

SEQ ID NO: 12331 - DNA, 20 bp, Artificial
  CRISPR gRNA sequence
tcaccttggggcctggccct

SEQ ID NO: 12332 - DNA, 20 bp, Artificial
  CRISPR gRNA sequence
caccttggggcctggccctt

SEQ ID NO: 12333 - DNA, 20 bp, Artificial
  CRISPR gRNA sequence
gcctggcccttgggactccc

SEQ ID NO: 12334 - DNA, 20 bp, Artificial
  CRISPR gRNA sequence
cccttgggactccccagctc

SEQ ID NO: 12335 - DNA, 20 bp, Artificial
  CRISPR gRNA sequence
ggactccccagctccagacc

SEQ ID NO: 12336 - DNA, 20 bp, Artificial
  CRISPR gRNA sequence
gactccccagctccagacca

SEQ ID NO: 12337 - DNA, 20 bp, Artificial
  CRISPR gRNA sequence
accaaggccacccccacatc

SEQ ID NO: 12338 - DNA, 20 bp, Artificial
  CRISPR gRNA sequence
acccccacatccagctcttc

SEQ ID NO: 12339 - DNA, 20 bp, Artificial
  CRISPR gRNA sequence
cccccacatccagctcttcc

SEQ ID NO: 12340 - DNA, 20 bp, Artificial
  CRISPR gRNA sequence
atccagctcttccaggacac

SEQ ID NO: 12341 - DNA, 20 bp, Artificial
  CRISPR gRNA sequence
tccagctcttccaggacacc

SEQ ID NO: 12342 - DNA, 20 bp, Artificial
  CRISPR gRNA sequence
ccagctcttccaggacacca

SEQ ID NO: 12343 - DNA, 20 bp, Artificial
  CRISPR gRNA sequence
agctcttccaggacaccagg

SEQ ID NO: 12344 - DNA, 20 bp, Artificial
  CRISPR gRNA sequence
ctcttccaggacaccaggga

SEQ ID NO: 12345 - DNA, 20 bp, Artificial
  CRISPR gRNA sequence
aggacaccagggagagactt

SEQ ID NO: 12346 - DNA, 20 bp, Artificial
  CRISPR gRNA sequence
gacttcagtgtctcccaccc

SEQ ID NO: 12347 - DNA, 20 bp, Artificial
  CRISPR gRNA sequence
acttcagtgtctcccacccc

SEQ ID NO: 12348 - DNA, 20 bp, Artificial
  CRISPR gRNA sequence
agtgtctcccaccccgggct

SEQ ID NO: 12349 - DNA, 20 bp, Artificial
  CRISPR gRNA sequence
gggctgagccacccaccgcc

SEQ ID NO: 12350 - DNA, 20 bp, Artificial
  CRISPR gRNA sequence
cccacactcactccatcacc

SEQ ID NO: 12351 - DNA, 20 bp, Artificial
  CRISPR gRNA sequence
cacactcactccatcacccg

SEQ ID NO: 12352 - DNA, 20 bp, Artificial
  CRISPR gRNA sequence
acactcactccatcacccgg

SEQ ID NO: 12353 - DNA, 20 bp, Artificial
  CRISPR gRNA sequence
cactcactccatcacccgga

SEQ ID NO: 12354 - DNA, 20 bp, Artificial
  CRISPR gRNA sequence
acccggagggacaccatgtc

SEQ ID NO: 12355 - DNA, 20 bp, Artificial
  CRISPR gRNA sequence
cggagggacaccatgtccgg

SEQ ID NO: 12356 - DNA, 20 bp, Artificial
  CRISPR gRNA sequence
caccatgtccggaagcacac

SEQ ID NO: 12357 - DNA, 20 bp, Artificial
  CRISPR gRNA sequence
tgtccggaagcacacgagcc

SEQ ID NO: 12358 - DNA, 20 bp, Artificial
  CRISPR gRNA sequence
aagcacacgagccaagctct

SEQ ID NO: 12359 - DNA, 20 bp, Artificial
  CRISPR gRNA sequence
agctctcggctcccacgtcg

SEQ ID NO: 12360 - DNA, 20 bp, Artificial
  CRISPR gRNA sequence
cggctcccacgtcgcagatg

SEQ ID NO: 12361 - DNA, 20 bp, Artificial
  CRISPR gRNA sequence
cgcagatgcagttattgtac

SEQ ID NO: 12362 - DNA, 20 bp, Artificial
  CRISPR gRNA sequence
gcagttattgtacaagctgt

SEQ ID NO: 12363 - DNA, 20 bp, Artificial
  CRISPR gRNA sequence
attgtacaagctgtcggaaa

SEQ ID NO: 12364 - DNA, 20 bp, Artificial
  CRISPR gRNA sequence
tgtacaagctgtcggaaaca

SEQ ID NO: 12365 - DNA, 20 bp, Artificial
  CRISPR gRNA sequence
gtacaagctgtcggaaacag

SEQ ID NO: 12366 - DNA, 20 bp, Artificial
  CRISPR gRNA sequence
aagctgtcggaaacagaggc

SEQ ID NO: 12367 - DNA, 20 bp, Artificial
  CRISPR gRNA sequence
agctgtcggaaacagaggcc

SEQ ID NO: 12368 - DNA, 20 bp, Artificial
  CRISPR gRNA sequence
gctgtcggaaacagaggcca

SEQ ID NO: 12369 - DNA, 20 bp, Artificial
  CRISPR gRNA sequence
ctgtcggaaacagaggccag

SEQ ID NO: 12370 - DNA, 20 bp, Artificial
  CRISPR gRNA sequence
tgtcggaaacagaggccagg

SEQ ID NO: 12371 - DNA, 20 bp, Artificial
  CRISPR gRNA sequence
tcggaaacagaggccagggg

SEQ ID NO: 12372 - DNA, 20 bp, Artificial
  CRISPR gRNA sequence
cggaaacagaggccaggggg

SEQ ID NO: 12373 - DNA, 20 bp, Artificial
  CRISPR gRNA sequence
ggaaacagaggccaggggga

SEQ ID NO: 12374 - DNA, 20 bp, Artificial
  CRISPR gRNA sequence
cagaggccagggggagggat

SEQ ID NO: 12375 - DNA, 20 bp, Artificial
  CRISPR gRNA sequence
gaggccagggggagggattg

SEQ ID NO: 12376 - DNA, 20 bp, Artificial
  CRISPR gRNA sequence
aggccagggggagggattgg

SEQ ID NO: 12377 - DNA, 20 bp, Artificial
  CRISPR gRNA sequence
agggattggaggcctgtgca

SEQ ID NO: 12378 - DNA, 20 bp, Artificial
  CRISPR gRNA sequence
attggaggcctgtgcatggt

SEQ ID NO: 12379 - DNA, 20 bp, Artificial
  CRISPR gRNA sequence
cctgtgcatggtcagccttc

SEQ ID NO: 12380 - DNA, 20 bp, Artificial
  CRISPR gRNA sequence
gtgcatggtcagccttccag

SEQ ID NO: 12381 - DNA, 20 bp, Artificial
  CRISPR gRNA sequence
cttccagaagccaccatccc

SEQ ID NO: 12382 - DNA, 20 bp, Artificial
  CRISPR gRNA sequence
aagccaccatccctagattc

SEQ ID NO: 12383 - DNA, 20 bp, Artificial
  CRISPR gRNA sequence
ccatccctagattccagaaa

SEQ ID NO: 12384 - DNA, 20 bp, Artificial
  CRISPR gRNA sequence
cctagattccagaaaaagcc

SEQ ID NO: 12385 - DNA, 20 bp, Artificial
  CRISPR gRNA sequence
aagcctggtcccactatccc

SEQ ID NO: 12386 - DNA, 20 bp, Artificial
  CRISPR gRNA sequence
agcctggtcccactatccct

SEQ ID NO: 12387 - DNA, 20 bp, Artificial
  CRISPR gRNA sequence
gcctggtcccactatccctg

SEQ ID NO: 12388 - DNA, 20 bp, Artificial
  CRISPR gRNA sequence
cctggtcccactatccctgg

SEQ ID NO: 12389 - DNA, 20 bp, Artificial
  CRISPR gRNA sequence
ggtcccactatccctggggg

SEQ ID NO: 12390 - DNA, 20 bp, Artificial
  CRISPR gRNA sequence
gtcccactatccctggggga

SEQ ID NO: 12391 - DNA, 20 bp, Artificial
  CRISPR gRNA sequence
aatcaatatttattgcacaa

SEQ ID NO: 12392 - DNA, 20 bp, Artificial
  CRISPR gRNA sequence
tcaatatttattgcacaaca

SEQ ID NO: 12393 - DNA, 20 bp, Artificial
  CRISPR gRNA sequence
atttattgcacaacagagcc

SEQ ID NO: 12394 - DNA, 20 bp, Artificial
  CRISPR gRNA sequence
acagagcctggcattgtgcc

SEQ ID NO: 12395 - DNA, 20 bp, Artificial
  CRISPR gRNA sequence
cattgtgccaagtacttaca

SEQ ID NO: 12396 - DNA, 20 bp, Artificial
  CRISPR gRNA sequence
attgtgccaagtacttacat

SEQ ID NO: 12397 - DNA, 20 bp, Artificial
  CRISPR gRNA sequence
caagtacttacataggccat

SEQ ID NO: 12398 - DNA, 20 bp, Artificial
  CRISPR gRNA sequence
aagtacttacataggccatt

SEQ ID NO: 12399 - DNA, 20 bp, Artificial
  CRISPR gRNA sequence
acttacataggccattggga

SEQ ID NO: 12400 - DNA, 20 bp, Artificial
  CRISPR gRNA sequence
ttgggatggttcccattttc

SEQ ID NO: 12401 - DNA, 20 bp, Artificial
  CRISPR gRNA sequence
ccattttctagatatgaaaa

SEQ ID NO: 12402 - DNA, 20 bp, Artificial
  CRISPR gRNA sequence
attttctagatatgaaaata

SEQ ID NO: 12403 - DNA, 20 bp, Artificial
  CRISPR gRNA sequence
ttttctagatatgaaaatag

SEQ ID NO: 12404 - DNA, 20 bp, Artificial
  CRISPR gRNA sequence
ctagatatgaaaatagaggc

SEQ ID NO: 12405 - DNA, 20 bp, Artificial
  CRISPR gRNA sequence
tagatatgaaaatagaggct

SEQ ID NO: 12406 - DNA, 20 bp, Artificial
  CRISPR gRNA sequence
aatagaggctaggaatgaat

SEQ ID NO: 12407 - DNA, 20 bp, Artificial
  CRISPR gRNA sequence
atgaataagtgacttgctca

SEQ ID NO: 12408 - DNA, 20 bp, Artificial
  CRISPR gRNA sequence
ttgctcaaagtttctgtccc

SEQ ID NO: 12409 - DNA, 20 bp, Artificial
  CRISPR gRNA sequence
tgctcaaagtttctgtcccc

SEQ ID NO: 12410 - DNA, 20 bp, Artificial
  CRISPR gRNA sequence
tttctgtccccaggtcccac

SEQ ID NO: 12411 - DNA, 20 bp, Artificial
  CRISPR gRNA sequence
gtcccactagttctcttgtt

SEQ ID NO: 12412 - DNA, 20 bp, Artificial
  CRISPR gRNA sequence
tcccactagttctcttgttc

SEQ ID NO: 12413 - DNA, 20 bp, Artificial
  CRISPR gRNA sequence
cccactagttctcttgttca

SEQ ID NO: 12414 - DNA, 20 bp, Artificial
  CRISPR gRNA sequence
agttctcttgttcagggctg

SEQ ID NO: 12415 - DNA, 20 bp, Artificial
  CRISPR gRNA sequence
agggctgtggtgattgcttc

SEQ ID NO: 12416 - DNA, 20 bp, Artificial
  CRISPR gRNA sequence
gggctgtggtgattgcttct

SEQ ID NO: 12417 - DNA, 20 bp, Artificial
  CRISPR gRNA sequence
ggtgattgcttctaggatct

SEQ ID NO: 12418 - DNA, 20 bp, Artificial
  CRISPR gRNA sequence
taggatctcagtgtcccctg

SEQ ID NO: 12419 - DNA, 20 bp, Artificial
  CRISPR gRNA sequence
tctcagtgtcccctgcagcc

SEQ ID NO: 12420 - DNA, 20 bp, Artificial
  CRISPR gRNA sequence
tcagtgtcccctgcagcctg

SEQ ID NO: 12421 - DNA, 20 bp, Artificial
  CRISPR gRNA sequence
cagtgtcccctgcagcctgg

SEQ ID NO: 12422 - DNA, 20 bp, Artificial
  CRISPR gRNA sequence
gtcccctgcagcctggaggt

SEQ ID NO: 12423 - DNA, 20 bp, Artificial
  CRISPR gRNA sequence
cagcctggaggtcagccccg

SEQ ID NO: 12424 - DNA, 20 bp, Artificial
  CRISPR gRNA sequence
agcctggaggtcagccccgt

SEQ ID NO: 12425 - DNA, 20 bp, Artificial
  CRISPR gRNA sequence
cctggaggtcagccccgtgg

SEQ ID NO: 12426 - DNA, 20 bp, Artificial
  CRISPR gRNA sequence
ccgtgggagtcaccacctac

SEQ ID NO: 12427 - DNA, 20 bp, Artificial
  CRISPR gRNA sequence
cgtgggagtcaccacctact

SEQ ID NO: 12428 - DNA, 20 bp, Artificial
  CRISPR gRNA sequence
gggattactgccccatttta

SEQ ID NO: 12429 - DNA, 20 bp, Artificial
  CRISPR gRNA sequence
ttactgccccattttaaaga

SEQ ID NO: 12430 - DNA, 20 bp, Artificial
  CRISPR gRNA sequence
tactgccccattttaaagac

SEQ ID NO: 12431 - DNA, 20 bp, Artificial
  CRISPR gRNA sequence
attttaaagacaggcaaacc

SEQ ID NO: 12432 - DNA, 20 bp, Artificial
  CRISPR gRNA sequence
aagacaggcaaaccaagacc

SEQ ID NO: 12433 - DNA, 20 bp, Artificial
  CRISPR gRNA sequence
gacaggcaaaccaagaccca

SEQ ID NO: 12434 - DNA, 20 bp, Artificial
  CRISPR gRNA sequence
caggcaaaccaagacccaga

SEQ ID NO: 12435 - DNA, 20 bp, Artificial
  CRISPR gRNA sequence
aaaccaagacccagagagtt

SEQ ID NO: 12436 - DNA, 20 bp, Artificial
  CRISPR gRNA sequence
gagttgagaccacttctctg

SEQ ID NO: 12437 - DNA, 20 bp, Artificial
  CRISPR gRNA sequence
accacttctctgtggtcaaa

SEQ ID NO: 12438 - DNA, 20 bp, Artificial
  CRISPR gRNA sequence
cttctctgtggtcaaacagt

SEQ ID NO: 12439 - DNA, 20 bp, Artificial
  CRISPR gRNA sequence
ctgtggtcaaacagtgagcc

SEQ ID NO: 12440 - DNA, 20 bp, Artificial
  CRISPR gRNA sequence
tgtggtcaaacagtgagccc

SEQ ID NO: 12441 - DNA, 20 bp, Artificial
  CRISPR gRNA sequence
aaacagtgagcccaggaaaa

SEQ ID NO: 12442 - DNA, 20 bp, Artificial
  CRISPR gRNA sequence
cagtgagcccaggaaaacag

SEQ ID NO: 12443 - DNA, 20 bp, Artificial
  CRISPR gRNA sequence
agtgagcccaggaaaacagc

SEQ ID NO: 12444 - DNA, 20 bp, Artificial
  CRISPR gRNA sequence
caggaaaacagcaggactaa

SEQ ID NO: 12445 - DNA, 20 bp, Artificial
  CRISPR gRNA sequence
aggaaaacagcaggactaaa

SEQ ID NO: 12446 - DNA, 20 bp, Artificial
  CRISPR gRNA sequence
aaaacagcaggactaaaagg

SEQ ID NO: 12447 - DNA, 20 bp, Artificial
  CRISPR gRNA sequence
tcatttcttgccttactgtg

SEQ ID NO: 12448 - DNA, 20 bp, Artificial
  CRISPR gRNA sequence
ccttactgtgtggaaactgt

SEQ ID NO: 12449 - DNA, 20 bp, Artificial
  CRISPR gRNA sequence
aactgtcagaacaacttccc

SEQ ID NO: 12450 - DNA, 20 bp, Artificial
  CRISPR gRNA sequence
aacttcccaagttcaaatcc

SEQ ID NO: 12451 - DNA, 20 bp, Artificial
  CRISPR gRNA sequence
tcttactgcctatgtgacct

SEQ ID NO: 12452 - DNA, 20 bp, Artificial
  CRISPR gRNA sequence
cttactgcctatgtgacctt

SEQ ID NO: 12453 - DNA, 20 bp, Artificial
  CRISPR gRNA sequence
ctgcctatgtgaccttgggc

SEQ ID NO: 12454 - DNA, 20 bp, Artificial
  CRISPR gRNA sequence
gcaagctactcaactcttct

SEQ ID NO: 12455 - DNA, 20 bp, Artificial
  CRISPR gRNA sequence
tactcaactcttctgagact

SEQ ID NO: 12456 - DNA, 20 bp, Artificial
  CRISPR gRNA sequence
cagtttgcccatctgtaaaa

SEQ ID NO: 12457 - DNA, 20 bp, Artificial
  CRISPR gRNA sequence
agtttgcccatctgtaaaat

SEQ ID NO: 12458 - DNA, 20 bp, Artificial
  CRISPR gRNA sequence
catctgtaaaatgggcatga

SEQ ID NO: 12459 - DNA, 20 bp, Artificial
  CRISPR gRNA sequence
tctgtaaaatgggcatgata

SEQ ID NO: 12460 - DNA, 20 bp, Artificial
  CRISPR gRNA sequence
tgggcatgatagagtcattg

SEQ ID NO: 12461 - DNA, 20 bp, Artificial
  CRISPR gRNA sequence
gggcatgatagagtcattgt

SEQ ID NO: 12462 - DNA, 20 bp, Artificial
  CRISPR gRNA sequence
ggcatgatagagtcattgtg

SEQ ID NO: 12463 - DNA, 20 bp, Artificial
  CRISPR gRNA sequence
catgatagagtcattgtggg

SEQ ID NO: 12464 - DNA, 20 bp, Artificial
  CRISPR gRNA sequence
atgatagagtcattgtgggg

SEQ ID NO: 12465 - DNA, 20 bp, Artificial
  CRISPR gRNA sequence
gatagagtcattgtggggag

SEQ ID NO: 12466 - DNA, 20 bp, Artificial
  CRISPR gRNA sequence
atcaatgctgatataacatt

SEQ ID NO: 12467 - DNA, 20 bp, Artificial
  CRISPR gRNA sequence
ataacatttagaacatgcct

SEQ ID NO: 12468 - DNA, 20 bp, Artificial
  CRISPR gRNA sequence
ttagaacatgccttggtgcc

SEQ ID NO: 12469 - DNA, 20 bp, Artificial
  CRISPR gRNA sequence
gcctagaatgaactaaatgt

SEQ ID NO: 12470 - DNA, 20 bp, Artificial
  CRISPR gRNA sequence
aatgaactaaatgttagcta

SEQ ID NO: 12471 - DNA, 20 bp, Artificial
  CRISPR gRNA sequence
ctatggttctgactacatca

SEQ ID NO: 12472 - DNA, 20 bp, Artificial
  CRISPR gRNA sequence
tatggttctgactacatcac

SEQ ID NO: 12473 - DNA, 20 bp, Artificial
  CRISPR gRNA sequence
tgactacatcacaggaacat

SEQ ID NO: 12474 - DNA, 20 bp, Artificial
  CRISPR gRNA sequence
tacatcacaggaacattggt

SEQ ID NO: 12475 - DNA, 20 bp, Artificial
  CRISPR gRNA sequence
acatcacaggaacattggtg

SEQ ID NO: 12476 - DNA, 20 bp, Artificial
  CRISPR gRNA sequence
catcacaggaacattggtga

SEQ ID NO: 12477 - DNA, 20 bp, Artificial
  CRISPR gRNA sequence
aacattggtgagggtcgcat

SEQ ID NO: 12478 - DNA, 20 bp, Artificial
  CRISPR gRNA sequence
gagggtcgcatgagttaaca

SEQ ID NO: 12479 - DNA, 20 bp, Artificial
  CRISPR gRNA sequence
gggtcgcatgagttaacata

SEQ ID NO: 12480 - DNA, 20 bp, Artificial
  CRISPR gRNA sequence
ggtcgcatgagttaacatag

SEQ ID NO: 12481 - DNA, 20 bp, Artificial
  CRISPR gRNA sequence
gtcgcatgagttaacataga

SEQ ID NO: 12482 - DNA, 20 bp, Artificial
  CRISPR gRNA sequence
gttaacatagagggtgtgac

SEQ ID NO: 12483 - DNA, 20 bp, Artificial
  CRISPR gRNA sequence
atagagggtgtgaccagcac

SEQ ID NO: 12484 - DNA, 20 bp, Artificial
  CRISPR gRNA sequence
tagagggtgtgaccagcact

SEQ ID NO: 12485 - DNA, 20 bp, Artificial
  CRISPR gRNA sequence
agagggtgtgaccagcactg

SEQ ID NO: 12486 - DNA, 20 bp, Artificial
  CRISPR gRNA sequence
gagggtgtgaccagcactgg

SEQ ID NO: 12487 - DNA, 20 bp, Artificial
  CRISPR gRNA sequence
ggtgtgaccagcactggggg

SEQ ID NO: 12488 - DNA, 20 bp, Artificial
  CRISPR gRNA sequence
gtgtgaccagcactgggggc

SEQ ID NO: 12489 - DNA, 20 bp, Artificial
  CRISPR gRNA sequence
tgaccagcactgggggcagg

SEQ ID NO: 12490 - DNA, 20 bp, Artificial
  CRISPR gRNA sequence
accagcactgggggcaggaa

SEQ ID NO: 12491 - DNA, 20 bp, Artificial
  CRISPR gRNA sequence
actgggggcaggaagagaaa

SEQ ID NO: 12492 - DNA, 20 bp, Artificial
  CRISPR gRNA sequence
ggggcaggaagagaaaaagc

SEQ ID NO: 12493 - DNA, 20 bp, Artificial
  CRISPR gRNA sequence
gaagagaaaaagccagtcac

SEQ ID NO: 12494 - DNA, 20 bp, Artificial
  CRISPR gRNA sequence
gaaaaagccagtcactggac

SEQ ID NO: 12495 - DNA, 20 bp, Artificial
  CRISPR gRNA sequence
gccagtcactggaccagctc

SEQ ID NO: 12496 - DNA, 20 bp, Artificial
  CRISPR gRNA sequence
tggaccagctccagtttctg

SEQ ID NO: 12497 - DNA, 20 bp, Artificial
  CRISPR gRNA sequence
ttctgcagcatattcacaac

SEQ ID NO: 12498 - DNA, 20 bp, Artificial
  CRISPR gRNA sequence
agcatattcacaaccagcat

SEQ ID NO: 12499 - DNA, 20 bp, Artificial
  CRISPR gRNA sequence
atattcacaaccagcattag

SEQ ID NO: 12500 - DNA, 20 bp, Artificial
  CRISPR gRNA sequence
ttcacaaccagcattagtag

SEQ ID NO: 12501 - DNA, 20 bp, Artificial
  CRISPR gRNA sequence
agcattagtagcagtgaaaa

SEQ ID NO: 12502 - DNA, 20 bp, Artificial
  CRISPR gRNA sequence
agcagtgaaaatagcatgat

SEQ ID NO: 12503 - DNA, 20 bp, Artificial
  CRISPR gRNA sequence
agtgtcactgatgccaactt

SEQ ID NO: 12504 - DNA, 20 bp, Artificial
  CRISPR gRNA sequence
tcagctgtttactcgacacc

SEQ ID NO: 12505 - DNA, 20 bp, Artificial
  CRISPR gRNA sequence
gctgtttactcgacaccaag

SEQ ID NO: 12506 - DNA, 20 bp, Artificial
  CRISPR gRNA sequence
gacaccaagcagccttttaa

SEQ ID NO: 12507 - DNA, 20 bp, Artificial
  CRISPR gRNA sequence
acaccaagcagccttttaac

SEQ ID NO: 12508 - DNA, 20 bp, Artificial
  CRISPR gRNA sequence
caagcagccttttaacaggt

SEQ ID NO: 12509 - DNA, 20 bp, Artificial
  CRISPR gRNA sequence
aagcagccttttaacaggtc

SEQ ID NO: 12510 - DNA, 20 bp, Artificial
  CRISPR gRNA sequence
taacaggtcaggtgctgctg

SEQ ID NO: 12511 - DNA, 20 bp, Artificial
  CRISPR gRNA sequence
aacaggtcaggtgctgctgc

SEQ ID NO: 12512 - DNA, 20 bp, Artificial
  CRISPR gRNA sequence
tgctgctgcgggtatgattt

SEQ ID NO: 12513 - DNA, 20 bp, Artificial
  CRISPR gRNA sequence
gctgctgcgggtatgatttc

SEQ ID NO: 12514 - DNA, 20 bp, Artificial
  CRISPR gRNA sequence
ctgctgcgggtatgatttca

SEQ ID NO: 12515 - DNA, 20 bp, Artificial
  CRISPR gRNA sequence
gccatgactttgccatgatt

SEQ ID NO: 12516 - DNA, 20 bp, Artificial
  CRISPR gRNA sequence
actttgccatgattcagcct

SEQ ID NO: 12517 - DNA, 20 bp, Artificial
  CRISPR gRNA sequence
tcagcctcagaactcccttg

SEQ ID NO: 12518 - DNA, 20 bp, Artificial
  CRISPR gRNA sequence
cagcctcagaactcccttgc

SEQ ID NO: 12519 - DNA, 20 bp, Artificial
  CRISPR gRNA sequence
agcctcagaactcccttgca

SEQ ID NO: 12520 - DNA, 20 bp, Artificial
  CRISPR gRNA sequence
ccttgcagggctgcatataa

SEQ ID NO: 12521 - DNA, 20 bp, Artificial
  CRISPR gRNA sequence
tgcagggctgcatataaaag

SEQ ID NO: 12522 - DNA, 20 bp, Artificial
  CRISPR gRNA sequence
agggctgcatataaaagcag

SEQ ID NO: 12523 - DNA, 20 bp, Artificial
  CRISPR gRNA sequence
gggctgcatataaaagcagc

SEQ ID NO: 12524 - DNA, 20 bp, Artificial
  CRISPR gRNA sequence
gcatataaaagcagcaggtg

SEQ ID NO: 12525 - DNA, 20 bp, Artificial
  CRISPR gRNA sequence
tataaaagcagcaggtgcag

SEQ ID NO: 12526 - DNA, 20 bp, Artificial
  CRISPR gRNA sequence
cgcctgtaatcctaacactt

SEQ ID NO: 12527 - DNA, 20 bp, Artificial
  CRISPR gRNA sequence
cctgtaatcctaacactttg

SEQ ID NO: 12528 - DNA, 20 bp, Artificial
  CRISPR gRNA sequence
ctgtaatcctaacactttgg

SEQ ID NO: 12529 - DNA, 20 bp, Artificial
  CRISPR gRNA sequence
atcctaacactttggaggcc

SEQ ID NO: 12530 - DNA, 20 bp, Artificial
  CRISPR gRNA sequence
tcctaacactttggaggccg

SEQ ID NO: 12531 - DNA, 20 bp, Artificial
  CRISPR gRNA sequence
taacactttggaggccgagg

SEQ ID NO: 12532 - DNA, 20 bp, Artificial
  CRISPR gRNA sequence
aacactttggaggccgaggc

SEQ ID NO: 12533 - DNA, 20 bp, Artificial
  CRISPR gRNA sequence
actttggaggccgaggcggg

SEQ ID NO: 12534 - DNA, 20 bp, Artificial
  CRISPR gRNA sequence
ccgaggcgggtggatcacct

SEQ ID NO: 12535 - DNA, 20 bp, Artificial
  CRISPR gRNA sequence
cgaggcgggtggatcaccta

SEQ ID NO: 12536 - DNA, 20 bp, Artificial
  CRISPR gRNA sequence
gcgggtggatcacctaaggt

SEQ ID NO: 12537 - DNA, 20 bp, Artificial
  CRISPR gRNA sequence
cgggtggatcacctaaggtc

SEQ ID NO: 12538 - DNA, 20 bp, Artificial
  CRISPR gRNA sequence
ggtggatcacctaaggtcgg

SEQ ID NO: 12539 - DNA, 20 bp, Artificial
  CRISPR gRNA sequence
tcacctaaggtcgggagttt

SEQ ID NO: 12540 - DNA, 20 bp, Artificial
  CRISPR gRNA sequence
taaggtcgggagtttgagac

SEQ ID NO: 12541 - DNA, 20 bp, Artificial
  CRISPR gRNA sequence
tgagaccagcctgaccaaca

SEQ ID NO: 12542 - DNA, 20 bp, Artificial
  CRISPR gRNA sequence
agaccagcctgaccaacatg

SEQ ID NO: 12543 - DNA, 20 bp, Artificial
  CRISPR gRNA sequence
ctctactaaaaatacaaaat

SEQ ID NO: 12544 - DNA, 20 bp, Artificial
  CRISPR gRNA sequence
actaaaaatacaaaattagc

SEQ ID NO: 12545 - DNA, 20 bp, Artificial
  CRISPR gRNA sequence
ctaaaaatacaaaattagcc

SEQ ID NO: 12546 - DNA, 20 bp, Artificial
  CRISPR gRNA sequence
acaaaattagccgggtgtga

SEQ ID NO: 12547 - DNA, 20 bp, Artificial
  CRISPR gRNA sequence
atggcacatgcctatactcc

SEQ ID NO: 12548 - DNA, 20 bp, Artificial
  CRISPR gRNA sequence
gcctatactcccagctactt

SEQ ID NO: 12549 - DNA, 20 bp, Artificial
  CRISPR gRNA sequence
ctatactcccagctacttga

SEQ ID NO: 12550 - DNA, 20 bp, Artificial
  CRISPR gRNA sequence
tatactcccagctacttgag

SEQ ID NO: 12551 - DNA, 20 bp, Artificial
  CRISPR gRNA sequence
tcccagctacttgagaggct

SEQ ID NO: 12552 - DNA, 20 bp, Artificial
  CRISPR gRNA sequence
cccagctacttgagaggctg

SEQ ID NO: 12553 - DNA, 20 bp, Artificial
  CRISPR gRNA sequence
agctacttgagaggctgagg

SEQ ID NO: 12554 - DNA, 20 bp, Artificial
  CRISPR gRNA sequence
gctacttgagaggctgaggc

SEQ ID NO: 12555 - DNA, 20 bp, Artificial
  CRISPR gRNA sequence
tacttgagaggctgaggcag

SEQ ID NO: 12556 - DNA, 20 bp, Artificial
  CRISPR gRNA sequence
gcaggagaattgcttgaact

SEQ ID NO: 12557 - DNA, 20 bp, Artificial
  CRISPR gRNA sequence
caggagaattgcttgaactc

SEQ ID NO: 12558 - DNA, 20 bp, Artificial
  CRISPR gRNA sequence
ggagaattgcttgaactcgg

SEQ ID NO: 12559 - DNA, 20 bp, Artificial
  CRISPR gRNA sequence
gagaattgcttgaactcggg

SEQ ID NO: 12560 - DNA, 20 bp, Artificial
  CRISPR gRNA sequence
aattgcttgaactcgggagg

SEQ ID NO: 12561 - DNA, 20 bp, Artificial
  CRISPR gRNA sequence
ttgcttgaactcgggaggcg

SEQ ID NO: 12562 - DNA, 20 bp, Artificial
  CRISPR gRNA sequence
gaactcgggaggcggagttg

SEQ ID NO: 12563 - DNA, 20 bp, Artificial
  CRISPR gRNA sequence
aggcggagttgcagtgaact

SEQ ID NO: 12564 - DNA, 20 bp, Artificial
  CRISPR gRNA sequence
agtgaactgagactgcactc

SEQ ID NO: 12565 - DNA, 20 bp, Artificial
  CRISPR gRNA sequence
ctgagactgcactccagcct

SEQ ID NO: 12566 - DNA, 20 bp, Artificial
  CRISPR gRNA sequence
tgcactccagccttggcaac

SEQ ID NO: 12567 - DNA, 20 bp, Artificial
  CRISPR gRNA sequence
cactccagccttggcaacaa

SEQ ID NO: 12568 - DNA, 20 bp, Artificial
  CRISPR gRNA sequence
aaactctgtctcgaaaaaaa

SEQ ID NO: 12569 - DNA, 20 bp, Artificial
  CRISPR gRNA sequence
aagaaaaaaataaataaatg

SEQ ID NO: 12570 - DNA, 20 bp, Artificial
  CRISPR gRNA sequence
aaaaaaataaataaatgcag

SEQ ID NO: 12571 - DNA, 20 bp, Artificial
  CRISPR gRNA sequence
aaaaaataaataaatgcagc

SEQ ID NO: 12572 - DNA, 20 bp, Artificial
  CRISPR gRNA sequence
agcaggtttacactgctgcc

SEQ ID NO: 12573 - DNA, 20 bp, Artificial
  CRISPR gRNA sequence
aggtttacactgctgccaag

SEQ ID NO: 12574 - DNA, 20 bp, Artificial
  CRISPR gRNA sequence
acactgctgccaagtggatt

SEQ ID NO: 12575 - DNA, 20 bp, Artificial
  CRISPR gRNA sequence
cactgctgccaagtggattc

SEQ ID NO: 12576 - DNA, 20 bp, Artificial
  CRISPR gRNA sequence
ggctaaatcaactcacatca

SEQ ID NO: 12577 - DNA, 20 bp, Artificial
  CRISPR gRNA sequence
gctaaatcaactcacatcac

SEQ ID NO: 12578 - DNA, 20 bp, Artificial
  CRISPR gRNA sequence
aatcaactcacatcacgggt

SEQ ID NO: 12579 - DNA, 20 bp, Artificial
  CRISPR gRNA sequence
aactcacatcacgggtcggc

SEQ ID NO: 12580 - DNA, 20 bp, Artificial
  CRISPR gRNA sequence
catcacgggtcggccggtac

SEQ ID NO: 12581 - DNA, 20 bp, Artificial
  CRISPR gRNA sequence
cgggtcggccggtaccagtg

SEQ ID NO: 12582 - DNA, 20 bp, Artificial
  CRISPR gRNA sequence
gccggtaccagtgcagaaac

SEQ ID NO: 12583 - DNA, 20 bp, Artificial
  CRISPR gRNA sequence
gtaccagtgcagaaactaga

SEQ ID NO: 12584 - DNA, 20 bp, Artificial
  CRISPR gRNA sequence
taccagtgcagaaactagat

SEQ ID NO: 12585 - DNA, 20 bp, Artificial
  CRISPR gRNA sequence
accagtgcagaaactagatg

SEQ ID NO: 12586 - DNA, 20 bp, Artificial
  CRISPR gRNA sequence
ccagtgcagaaactagatgg

SEQ ID NO: 12587 - DNA, 20 bp, Artificial
  CRISPR gRNA sequence
gttttgcaatctctgaaccc

SEQ ID NO: 12588 - DNA, 20 bp, Artificial
  CRISPR gRNA sequence
tttgcaatctctgaaccctg

SEQ ID NO: 12589 - DNA, 20 bp, Artificial
  CRISPR gRNA sequence
gagacccttcctccacccca

SEQ ID NO: 12590 - DNA, 20 bp, Artificial
  CRISPR gRNA sequence
agacccttcctccaccccac

SEQ ID NO: 12591 - DNA, 20 bp, Artificial
  CRISPR gRNA sequence
gacccttcctccaccccaca

SEQ ID NO: 12592 - DNA, 20 bp, Artificial
  CRISPR gRNA sequence
cccttcctccaccccacagg

SEQ ID NO: 12593 - DNA, 20 bp, Artificial
  CRISPR gRNA sequence
cttcctccaccccacaggga

SEQ ID NO: 12594 - DNA, 20 bp, Artificial
  CRISPR gRNA sequence
gaccatatttcatcgatgcc

SEQ ID NO: 12595 - DNA, 20 bp, Artificial
  CRISPR gRNA sequence
gtcaccatttgaatatcatt

SEQ ID NO: 12596 - DNA, 20 bp, Artificial
  CRISPR gRNA sequence
catttgaatatcattgagat

SEQ ID NO: 12597 - DNA, 20 bp, Artificial
  CRISPR gRNA sequence
atttgaatatcattgagatc

SEQ ID NO: 12598 - DNA, 20 bp, Artificial
  CRISPR gRNA sequence
aggatgtgtcttataaccaa

SEQ ID NO: 12599 - DNA, 20 bp, Artificial
  CRISPR gRNA sequence
ttataaccaatagcgtgtca

SEQ ID NO: 12600 - DNA, 20 bp, Artificial
  CRISPR gRNA sequence
gcgtgtcacagtttgcattt

SEQ ID NO: 12601 - DNA, 20 bp, Artificial
  CRISPR gRNA sequence
tttgcattttggcctcatat

SEQ ID NO: 12602 - DNA, 20 bp, Artificial
  CRISPR gRNA sequence
ttgcattttggcctcatatt

SEQ ID NO: 12603 - DNA, 20 bp, Artificial
  CRISPR gRNA sequence
tgcattttggcctcatattg

SEQ ID NO: 12604 - DNA, 20 bp, Artificial
  CRISPR gRNA sequence
ctcatattggggtcttacaa

SEQ ID NO: 12605 - DNA, 20 bp, Artificial
  CRISPR gRNA sequence
tattggggtcttacaatgga

SEQ ID NO: 12606 - DNA, 20 bp, Artificial
  CRISPR gRNA sequence
tcttacaatggatggcatct

SEQ ID NO: 12607 - DNA, 20 bp, Artificial
  CRISPR gRNA sequence
atgaaatatgatgtttctta

SEQ ID NO: 12608 - DNA, 20 bp, Artificial
  CRISPR gRNA sequence
tgaaatatgatgtttcttaa

SEQ ID NO: 12609 - DNA, 20 bp, Artificial
  CRISPR gRNA sequence
gaaatatgatgtttcttaaa

SEQ ID NO: 12610 - DNA, 20 bp, Artificial
  CRISPR gRNA sequence
atgtttcttaaagggtaaat

SEQ ID NO: 12611 - DNA, 20 bp, Artificial
  CRISPR gRNA sequence
tgtttcttaaagggtaaatc

SEQ ID NO: 12612 - DNA, 20 bp, Artificial
  CRISPR gRNA sequence
tcttaaagggtaaatcaggc

SEQ ID NO: 12613 - DNA, 20 bp, Artificial
  CRISPR gRNA sequence
cttaaagggtaaatcaggct

SEQ ID NO: 12614 - DNA, 20 bp, Artificial
  CRISPR gRNA sequence
agggtaaatcaggctgggca

SEQ ID NO: 12615 - DNA, 20 bp, Artificial
  CRISPR gRNA sequence
gtaaatcaggctgggcatgg

SEQ ID NO: 12616 - DNA, 20 bp, Artificial
  CRISPR gRNA sequence
gtggctcacacccgtaatcc

SEQ ID NO: 12617 - DNA, 20 bp, Artificial
  CRISPR gRNA sequence
cacccgtaatcccagcactt

SEQ ID NO: 12618 - DNA, 20 bp, Artificial
  CRISPR gRNA sequence
ccgtaatcccagcactttgg

SEQ ID NO: 12619 - DNA, 20 bp, Artificial
  CRISPR gRNA sequence
cgtaatcccagcactttgga

SEQ ID NO: 12620 - DNA, 20 bp, Artificial
  CRISPR gRNA sequence
tcccagcactttggaaggct

SEQ ID NO: 12621 - DNA, 20 bp, Artificial
  CRISPR gRNA sequence
cccagcactttggaaggctg

SEQ ID NO: 12622 - DNA, 20 bp, Artificial
  CRISPR gRNA sequence
agcactttggaaggctgagg

SEQ ID NO: 12623 - DNA, 20 bp, Artificial
  CRISPR gRNA sequence
gcactttggaaggctgaggt

SEQ ID NO: 12624 - DNA, 20 bp, Artificial
  CRISPR gRNA sequence
ctttggaaggctgaggtggg

SEQ ID NO: 12625 - DNA, 20 bp, Artificial
  CRISPR gRNA sequence
gctgaggtgggtggatcgct

SEQ ID NO: 12626 - DNA, 20 bp, Artificial
  CRISPR gRNA sequence
ctgaggtgggtggatcgctt

SEQ ID NO: 12627 - DNA, 20 bp, Artificial
  CRISPR gRNA sequence
gtgggtggatcgcttgggcc

SEQ ID NO: 12628 - DNA, 20 bp, Artificial
  CRISPR gRNA sequence
tgggtggatcgcttgggccc

SEQ ID NO: 12629 - DNA, 20 bp, Artificial
  CRISPR gRNA sequence
tcgcttgggcccaggatttc

SEQ ID NO: 12630 - DNA, 20 bp, Artificial
  CRISPR gRNA sequence
tgggcccaggatttcaagac

SEQ ID NO: 12631 - DNA, 20 bp, Artificial
  CRISPR gRNA sequence
ccaggatttcaagaccagtc

SEQ ID NO: 12632 - DNA, 20 bp, Artificial
  CRISPR gRNA sequence
caggatttcaagaccagtct

SEQ ID NO: 12633 - DNA, 20 bp, Artificial
  CRISPR gRNA sequence
caagaccagtctgggccaca

SEQ ID NO: 12634 - DNA, 20 bp, Artificial
  CRISPR gRNA sequence
ccagtctgggccacatggcg

SEQ ID NO: 12635 - DNA, 20 bp, Artificial
  CRISPR gRNA sequence
ctctactgaaaacacaaaaa

SEQ ID NO: 12636 - DNA, 20 bp, Artificial
  CRISPR gRNA sequence
ctgaaaacacaaaaatagcc

SEQ ID NO: 12637 - DNA, 20 bp, Artificial
  CRISPR gRNA sequence
aacacaaaaatagcctggtg

SEQ ID NO: 12638 - DNA, 20 bp, Artificial
  CRISPR gRNA sequence
acaaaaatagcctggtgtgg

SEQ ID NO: 12639 - DNA, 20 bp, Artificial
  CRISPR gRNA sequence
aaaatagcctggtgtggtgg

SEQ ID NO: 12640 - DNA, 20 bp, Artificial
  CRISPR gRNA sequence
aaatagcctggtgtggtggc

SEQ ID NO: 12641 - DNA, 20 bp, Artificial
  CRISPR gRNA sequence
gtggcgggcatctgtaatcc

SEQ ID NO: 12642 - DNA, 20 bp, Artificial
  CRISPR gRNA sequence
catctgtaatcccagctact

SEQ ID NO: 12643 - DNA, 20 bp, Artificial
  CRISPR gRNA sequence
atctgtaatcccagctactt

SEQ ID NO: 12644 - DNA, 20 bp, Artificial
  CRISPR gRNA sequence
ctgtaatcccagctacttgg

SEQ ID NO: 12645 - DNA, 20 bp, Artificial
  CRISPR gRNA sequence
tgtaatcccagctacttggg

SEQ ID NO: 12646 - DNA, 20 bp, Artificial
  CRISPR gRNA sequence
tcccagctacttgggaggct

SEQ ID NO: 12647 - DNA, 20 bp, Artificial
  CRISPR gRNA sequence
cccagctacttgggaggctg

SEQ ID NO: 12648 - DNA, 20 bp, Artificial
  CRISPR gRNA sequence
tacttgggaggctgaggcat

SEQ ID NO: 12649 - DNA, 20 bp, Artificial
  CRISPR gRNA sequence
gcatgagaatcacttgaacc

SEQ ID NO: 12650 - DNA, 20 bp, Artificial
  CRISPR gRNA sequence
catgagaatcacttgaaccc

SEQ ID NO: 12651 - DNA, 20 bp, Artificial
  CRISPR gRNA sequence
tgagaatcacttgaacccag

SEQ ID NO: 12652 - DNA, 20 bp, Artificial
  CRISPR gRNA sequence
gagaatcacttgaacccagg

SEQ ID NO: 12653 - DNA, 20 bp, Artificial
  CRISPR gRNA sequence
aatcacttgaacccaggagg

SEQ ID NO: 12654 - DNA, 20 bp, Artificial
  CRISPR gRNA sequence
aacccaggaggcagtgcttg

SEQ ID NO: 12655 - DNA, 20 bp, Artificial
  CRISPR gRNA sequence
caggaggcagtgcttgcagt

SEQ ID NO: 12656 - DNA, 20 bp, Artificial
  CRISPR gRNA sequence
ggcagtgcttgcagtgagct

SEQ ID NO: 12657 - DNA, 20 bp, Artificial
  CRISPR gRNA sequence
gagatcatgccactgcacct

SEQ ID NO: 12658 - DNA, 20 bp, Artificial
  CRISPR gRNA sequence
catgccactgcaccttagcc

SEQ ID NO: 12659 - DNA, 20 bp, Artificial
  CRISPR gRNA sequence
atgccactgcaccttagcct

SEQ ID NO: 12660 - DNA, 20 bp, Artificial
  CRISPR gRNA sequence
gcaccttagcctgggcaata

SEQ ID NO: 12661 - DNA, 20 bp, Artificial
  CRISPR gRNA sequence
cttagcctgggcaataaagt

SEQ ID NO: 12662 - DNA, 20 bp, Artificial
  CRISPR gRNA sequence
ctgggcaataaagtgagact

SEQ ID NO: 12663 - DNA, 20 bp, Artificial
  CRISPR gRNA sequence
aagtgagacttggtctcaaa

SEQ ID NO: 12664 - DNA, 20 bp, Artificial
  CRISPR gRNA sequence
agacttggtctcaaaaagaa

SEQ ID NO: 12665 - DNA, 20 bp, Artificial
  CRISPR gRNA sequence
tggtctcaaaaagaaaagaa

SEQ ID NO: 12666 - DNA, 20 bp, Artificial
  CRISPR gRNA sequence
aaaaagaaaagaaaagaaaa

SEQ ID NO: 12667 - DNA, 20 bp, Artificial
  CRISPR gRNA sequence
gaaaagaaaagaaaaaagaa

SEQ ID NO: 12668 - DNA, 20 bp, Artificial
  CRISPR gRNA sequence
gaaaaaagaaaagtgtaaat

SEQ ID NO: 12669 - DNA, 20 bp, Artificial
  CRISPR gRNA sequence
agaaaagtgtaaatcagatc

SEQ ID NO: 12670 - DNA, 20 bp, Artificial
  CRISPR gRNA sequence
cagatcaagtgtcgccttcc

SEQ ID NO: 12671 - DNA, 20 bp, Artificial
  CRISPR gRNA sequence
agatcaagtgtcgccttccc

SEQ ID NO: 12672 - DNA, 20 bp, Artificial
  CRISPR gRNA sequence
aaatacctcttgtgacccac

SEQ ID NO: 12673 - DNA, 20 bp, Artificial
  CRISPR gRNA sequence
aatacctcttgtgacccaca

SEQ ID NO: 12674 - DNA, 20 bp, Artificial
  CRISPR gRNA sequence
atacctcttgtgacccacaa

SEQ ID NO: 12675 - DNA, 20 bp, Artificial
  CRISPR gRNA sequence
aagggcctccctgtgtgatc

SEQ ID NO: 12676 - DNA, 20 bp, Artificial
  CRISPR gRNA sequence
cccctacttccaccattgcc

SEQ ID NO: 12677 - DNA, 20 bp, Artificial
  CRISPR gRNA sequence
tgtccctcattcactacaca

SEQ ID NO: 12678 - DNA, 20 bp, Artificial
  CRISPR gRNA sequence
tcattcactacacacagcca

SEQ ID NO: 12679 - DNA, 20 bp, Artificial
  CRISPR gRNA sequence
ttcactacacacagccacag

SEQ ID NO: 12680 - DNA, 20 bp, Artificial
  CRISPR gRNA sequence
cccttctgacccttaaaaca

SEQ ID NO: 12681 - DNA, 20 bp, Artificial
  CRISPR gRNA sequence
acacagccccttttcccact

SEQ ID NO: 12682 - DNA, 20 bp, Artificial
  CRISPR gRNA sequence
cacagccccttttcccactt

SEQ ID NO: 12683 - DNA, 20 bp, Artificial
  CRISPR gRNA sequence
acagccccttttcccactta

SEQ ID NO: 12684 - DNA, 20 bp, Artificial
  CRISPR gRNA sequence
cacctgctgttctttcttcc

SEQ ID NO: 12685 - DNA, 20 bp, Artificial
  CRISPR gRNA sequence
cctgctgttctttcttccta

SEQ ID NO: 12686 - DNA, 20 bp, Artificial
  CRISPR gRNA sequence
ttcctagagtccttttcccc

SEQ ID NO: 12687 - DNA, 20 bp, Artificial
  CRISPR gRNA sequence
cctagagtccttttccccta

SEQ ID NO: 12688 - DNA, 20 bp, Artificial
  CRISPR gRNA sequence
ttttcccctagagcttccca

SEQ ID NO: 12689 - DNA, 20 bp, Artificial
  CRISPR gRNA sequence
tcccctagagcttcccacgg

SEQ ID NO: 12690 - DNA, 20 bp, Artificial
  CRISPR gRNA sequence
ccacggaagaatcatctccc

SEQ ID NO: 12691 - DNA, 20 bp, Artificial
  CRISPR gRNA sequence
cggaagaatcatctccccag

SEQ ID NO: 12692 - DNA, 20 bp, Artificial
  CRISPR gRNA sequence
ccagaagtcctgtaccctcc

SEQ ID NO: 12693 - DNA, 20 bp, Artificial
  CRISPR gRNA sequence
cagaagtcctgtaccctcct

SEQ ID NO: 12694 - DNA, 20 bp, Artificial
  CRISPR gRNA sequence
agaagtcctgtaccctcctg

SEQ ID NO: 12695 - DNA, 20 bp, Artificial
  CRISPR gRNA sequence
tgtaccctcctggggcttgt

SEQ ID NO: 12696 - DNA, 20 bp, Artificial
  CRISPR gRNA sequence
gggcttgttagtttccttcc

SEQ ID NO: 12697 - DNA, 20 bp, Artificial
  CRISPR gRNA sequence
tgcctaattcctactacgca

SEQ ID NO: 12698 - DNA, 20 bp, Artificial
  CRISPR gRNA sequence
tactacgcaaagaaactcaa

SEQ ID NO: 12699 - DNA, 20 bp, Artificial
  CRISPR gRNA sequence
acgcaaagaaactcaaaagc

SEQ ID NO: 12700 - DNA, 20 bp, Artificial
  CRISPR gRNA sequence
aagcaagaacgacatctgtc

SEQ ID NO: 12701 - DNA, 20 bp, Artificial
  CRISPR gRNA sequence
ctagttcatacttgtatctc

SEQ ID NO: 12702 - DNA, 20 bp, Artificial
  CRISPR gRNA sequence
atacttgtatctctagtttt

SEQ ID NO: 12703 - DNA, 20 bp, Artificial
  CRISPR gRNA sequence
tttttagcacaattatgaac

SEQ ID NO: 12704 - DNA, 20 bp, Artificial
  CRISPR gRNA sequence
tagcacaattatgaaccaga

SEQ ID NO: 12705 - DNA, 20 bp, Artificial
  CRISPR gRNA sequence
cagattctatttttgcttct

SEQ ID NO: 12706 - DNA, 20 bp, Artificial
  CRISPR gRNA sequence
tgcttctgagtttctttgca

SEQ ID NO: 12707 - DNA, 20 bp, Artificial
  CRISPR gRNA sequence
tctgagtttctttgcatagc

SEQ ID NO: 12708 - DNA, 20 bp, Artificial
  CRISPR gRNA sequence
gagtttctttgcatagcaag

SEQ ID NO: 12709 - DNA, 20 bp, Artificial
  CRISPR gRNA sequence
ttctttgcatagcaagaagt

SEQ ID NO: 12710 - DNA, 20 bp, Artificial
  CRISPR gRNA sequence
ataaataaaatattgtaaaa

SEQ ID NO: 12711 - DNA, 20 bp, Artificial
  CRISPR gRNA sequence
ttgtaaaacagtgatcatgc

SEQ ID NO: 12712 - DNA, 20 bp, Artificial
  CRISPR gRNA sequence
tgtaaaacagtgatcatgct

SEQ ID NO: 12713 - DNA, 20 bp, Artificial
  CRISPR gRNA sequence
aaaacagtgatcatgctggg

SEQ ID NO: 12714 - DNA, 20 bp, Artificial
  CRISPR gRNA sequence
catgctgggaagaaattaac

SEQ ID NO: 12715 - DNA, 20 bp, Artificial
  CRISPR gRNA sequence
atgctgggaagaaattaaca

SEQ ID NO: 12716 - DNA, 20 bp, Artificial
  CRISPR gRNA sequence
gggaagaaattaacaaggct

SEQ ID NO: 12717 - DNA, 20 bp, Artificial
  CRISPR gRNA sequence
ggaagaaattaacaaggctc

SEQ ID NO: 12718 - DNA, 20 bp, Artificial
  CRISPR gRNA sequence
aagaaattaacaaggctcag

SEQ ID NO: 12719 - DNA, 20 bp, Artificial
  CRISPR gRNA sequence
agaaattaacaaggctcagg

SEQ ID NO: 12720 - DNA, 20 bp, Artificial
  CRISPR gRNA sequence
gaaattaacaaggctcagga

SEQ ID NO: 12721 - DNA, 20 bp, Artificial
  CRISPR gRNA sequence
taacaaggctcaggagggta

SEQ ID NO: 12722 - DNA, 20 bp, Artificial
  CRISPR gRNA sequence
aacaaggctcaggagggtat

SEQ ID NO: 12723 - DNA, 20 bp, Artificial
  CRISPR gRNA sequence
gctcaggagggtataggacc

SEQ ID NO: 12724 - DNA, 20 bp, Artificial
  CRISPR gRNA sequence
gggtataggacccagctact

SEQ ID NO: 12725 - DNA, 20 bp, Artificial
  CRISPR gRNA sequence
tataggacccagctacttgg

SEQ ID NO: 12726 - DNA, 20 bp, Artificial
  CRISPR gRNA sequence
ataggacccagctacttgga

SEQ ID NO: 12727 - DNA, 20 bp, Artificial
  CRISPR gRNA sequence
acccagctacttggaaggct

SEQ ID NO: 12728 - DNA, 20 bp, Artificial
  CRISPR gRNA sequence
cccagctacttggaaggctg

SEQ ID NO: 12729 - DNA, 20 bp, Artificial
  CRISPR gRNA sequence
agctacttggaaggctgagg

SEQ ID NO: 12730 - DNA, 20 bp, Artificial
  CRISPR gRNA sequence
gctacttggaaggctgaggt

SEQ ID NO: 12731 - DNA, 20 bp, Artificial
  CRISPR gRNA sequence
tacttggaaggctgaggtgg

SEQ ID NO: 12732 - DNA, 20 bp, Artificial
  CRISPR gRNA sequence
acttggaaggctgaggtggg

SEQ ID NO: 12733 - DNA, 20 bp, Artificial
  CRISPR gRNA sequence
ctgaggtgggaggttcgctt

SEQ ID NO: 12734 - DNA, 20 bp, Artificial
  CRISPR gRNA sequence
gtgggaggttcgcttcagtc

SEQ ID NO: 12735 - DNA, 20 bp, Artificial
  CRISPR gRNA sequence
tgggaggttcgcttcagtcc

SEQ ID NO: 12736 - DNA, 20 bp, Artificial
  CRISPR gRNA sequence
gaggttcgcttcagtccagg

SEQ ID NO: 12737 - DNA, 20 bp, Artificial
  CRISPR gRNA sequence
tcgcttcagtccaggtagtc

SEQ ID NO: 12738 - DNA, 20 bp, Artificial
  CRISPR gRNA sequence
cgcttcagtccaggtagtcg

SEQ ID NO: 12739 - DNA, 20 bp, Artificial
  CRISPR gRNA sequence
agtccaggtagtcgaggctg

SEQ ID NO: 12740 - DNA, 20 bp, Artificial
  CRISPR gRNA sequence
caggtagtcgaggctgtagt

SEQ ID NO: 12741 - DNA, 20 bp, Artificial
  CRISPR gRNA sequence
tgcacccctgcactacaacc

SEQ ID NO: 12742 - DNA, 20 bp, Artificial
  CRISPR gRNA sequence
gcacccctgcactacaacct

SEQ ID NO: 12743 - DNA, 20 bp, Artificial
  CRISPR gRNA sequence
ccctgcactacaacctgggt

SEQ ID NO: 12744 - DNA, 20 bp, Artificial
  CRISPR gRNA sequence
aaataaataaataaataaat

SEQ ID NO: 12745 - DNA, 20 bp, Artificial
  CRISPR gRNA sequence
aaataaataaataaataagt

SEQ ID NO: 12746 - DNA, 20 bp, Artificial
  CRISPR gRNA sequence
aaataaataaataagttggc

SEQ ID NO: 12747 - DNA, 20 bp, Artificial
  CRISPR gRNA sequence
aataaataaataagttggcc

SEQ ID NO: 12748 - DNA, 20 bp, Artificial
  CRISPR gRNA sequence
ataaataagttggccgggca

SEQ ID NO: 12749 - DNA, 20 bp, Artificial
  CRISPR gRNA sequence
aataagttggccgggcatgg

SEQ ID NO: 12750 - DNA, 20 bp, Artificial
  CRISPR gRNA sequence
gtggctcacgcctgtaatcc

SEQ ID NO: 12751 - DNA, 20 bp, Artificial
  CRISPR gRNA sequence
tgtaatcctagtactcactt

SEQ ID NO: 12752 - DNA, 20 bp, Artificial
  CRISPR gRNA sequence
gtaatcctagtactcacttt

SEQ ID NO: 12753 - DNA, 20 bp, Artificial
  CRISPR gRNA sequence
aatcctagtactcactttgg

SEQ ID NO: 12754 - DNA, 20 bp, Artificial
  CRISPR gRNA sequence
atcctagtactcactttggg

SEQ ID NO: 12755 - DNA, 20 bp, Artificial
  CRISPR gRNA sequence
agtactcactttgggaggcc

SEQ ID NO: 12756 - DNA, 20 bp, Artificial
  CRISPR gRNA sequence
gtactcactttgggaggccg

SEQ ID NO: 12757 - DNA, 20 bp, Artificial
  CRISPR gRNA sequence
ctcactttgggaggccgagg

SEQ ID NO: 12758 - DNA, 20 bp, Artificial
  CRISPR gRNA sequence
tcactttgggaggccgaggc

SEQ ID NO: 12759 - DNA, 20 bp, Artificial
  CRISPR gRNA sequence
ctttgggaggccgaggcagg

SEQ ID NO: 12760 - DNA, 20 bp, Artificial
  CRISPR gRNA sequence
ccgaggcaggtggatcacct

SEQ ID NO: 12761 - DNA, 20 bp, Artificial
  CRISPR gRNA sequence
gcaggtggatcacctgagat

SEQ ID NO: 12762 - DNA, 20 bp, Artificial
  CRISPR gRNA sequence
caggtggatcacctgagatc

SEQ ID NO: 12763 - DNA, 20 bp, Artificial
  CRISPR gRNA sequence
ggtggatcacctgagatcag

SEQ ID NO: 12764 - DNA, 20 bp, Artificial
  CRISPR gRNA sequence
tcacctgagatcaggagttt

SEQ ID NO: 12765 - DNA, 20 bp, Artificial
  CRISPR gRNA sequence
tgagatcaggagtttgagac

SEQ ID NO: 12766 - DNA, 20 bp, Artificial
  CRISPR gRNA sequence
tcaggagtttgagaccagcc

SEQ ID NO: 12767 - DNA, 20 bp, Artificial
  CRISPR gRNA sequence
tgagaccagcctggccaaca

SEQ ID NO: 12768 - DNA, 20 bp, Artificial
  CRISPR gRNA sequence
tctactaaaaatataaaaac

SEQ ID NO: 12769 - DNA, 20 bp, Artificial
  CRISPR gRNA sequence
ctaaaaatataaaaactagc

SEQ ID NO: 12770 - DNA, 20 bp, Artificial
  CRISPR gRNA sequence
atataaaaactagctggacg

SEQ ID NO: 12771 - DNA, 20 bp, Artificial
  CRISPR gRNA sequence
taaaaactagctggacgtgg

SEQ ID NO: 12772 - DNA, 20 bp, Artificial
  CRISPR gRNA sequence
aaactagctggacgtggtgg

SEQ ID NO: 12773 - DNA, 20 bp, Artificial
  CRISPR gRNA sequence
aactagctggacgtggtggt

SEQ ID NO: 12774 - DNA, 20 bp, Artificial
  CRISPR gRNA sequence
gtggtgggcgcctataatcc

SEQ ID NO: 12775 - DNA, 20 bp, Artificial
  CRISPR gRNA sequence
cgcctataatcccagctact

SEQ ID NO: 12776 - DNA, 20 bp, Artificial
  CRISPR gRNA sequence
cctataatcccagctactcg

SEQ ID NO: 12777 - DNA, 20 bp, Artificial
  CRISPR gRNA sequence
tcccagctactcggagcact

SEQ ID NO: 12778 - DNA, 20 bp, Artificial
  CRISPR gRNA sequence
cccagctactcggagcactg

SEQ ID NO: 12779 - DNA, 20 bp, Artificial
  CRISPR gRNA sequence
agctactcggagcactgagg

SEQ ID NO: 12780 - DNA, 20 bp, Artificial
  CRISPR gRNA sequence
gctactcggagcactgaggc

SEQ ID NO: 12781 - DNA, 20 bp, Artificial
  CRISPR gRNA sequence
ggagcactgaggcaggcgaa

SEQ ID NO: 12782 - DNA, 20 bp, Artificial
  CRISPR gRNA sequence
gcaggcgaatagcttgaacc

SEQ ID NO: 12783 - DNA, 20 bp, Artificial
  CRISPR gRNA sequence
caggcgaatagcttgaacct

SEQ ID NO: 12784 - DNA, 20 bp, Artificial
  CRISPR gRNA sequence
aggcgaatagcttgaacctg

SEQ ID NO: 12785 - DNA, 20 bp, Artificial
  CRISPR gRNA sequence
ggcgaatagcttgaacctgg

SEQ ID NO: 12786 - DNA, 20 bp, Artificial
  CRISPR gRNA sequence
gcgaatagcttgaacctggg

SEQ ID NO: 12787 - DNA, 20 bp, Artificial
  CRISPR gRNA sequence
cgaatagcttgaacctgggg

SEQ ID NO: 12788 - DNA, 20 bp, Artificial
  CRISPR gRNA sequence
gaatagcttgaacctggggg

SEQ ID NO: 12789 - DNA, 20 bp, Artificial
  CRISPR gRNA sequence
aatagcttgaacctgggggg

SEQ ID NO: 12790 - DNA, 20 bp, Artificial
  CRISPR gRNA sequence
agcttgaacctggggggggg

SEQ ID NO: 12791 - DNA, 20 bp, Artificial
  CRISPR gRNA sequence
ttgaacctgggggggggcag

SEQ ID NO: 12792 - DNA, 20 bp, Artificial
  CRISPR gRNA sequence
ctgggggggggcagaagttg

SEQ ID NO: 12793 - DNA, 20 bp, Artificial
  CRISPR gRNA sequence
gggggggcagaagttgcagt

SEQ ID NO: 12794 - DNA, 20 bp, Artificial
  CRISPR gRNA sequence
ggcagaagttgcagtgagct

SEQ ID NO: 12795 - DNA, 20 bp, Artificial
  CRISPR gRNA sequence
gagatcacaccacttcactc

SEQ ID NO: 12796 - DNA, 20 bp, Artificial
  CRISPR gRNA sequence
cacaccacttcactccagcc

SEQ ID NO: 12797 - DNA, 20 bp, Artificial
  CRISPR gRNA sequence
acaccacttcactccagcct

SEQ ID NO: 12798 - DNA, 20 bp, Artificial
  CRISPR gRNA sequence
cttcactccagcctgggtga

SEQ ID NO: 12799 - DNA, 20 bp, Artificial
  CRISPR gRNA sequence
tcactccagcctgggtgaca

SEQ ID NO: 12800 - DNA, 20 bp, Artificial
  CRISPR gRNA sequence
tccagcctgggtgacagagc

SEQ ID NO: 12801 - DNA, 20 bp, Artificial
  CRISPR gRNA sequence
gcgagactccatctcaaaaa

SEQ ID NO: 12802 - DNA, 20 bp, Artificial
  CRISPR gRNA sequence
attaaaaataaataaataat

SEQ ID NO: 12803 - DNA, 20 bp, Artificial
  CRISPR gRNA sequence
ttaaaaataaataaataata

SEQ ID NO: 12804 - DNA, 20 bp, Artificial
  CRISPR gRNA sequence
taaaaataaataaataataa

SEQ ID NO: 12805 - DNA, 20 bp, Artificial
  CRISPR gRNA sequence
ggaccaaatgccatctttcc

SEQ ID NO: 12806 - DNA, 20 bp, Artificial
  CRISPR gRNA sequence
gaccaaatgccatctttcct

SEQ ID NO: 12807 - DNA, 20 bp, Artificial
  CRISPR gRNA sequence
ctttcctgggaatctgactc

SEQ ID NO: 12808 - DNA, 20 bp, Artificial
  CRISPR gRNA sequence
aatctgactctggttgtcct

SEQ ID NO: 12809 - DNA, 20 bp, Artificial
  CRISPR gRNA sequence
tgactctggttgtcctcagt

SEQ ID NO: 12810 - DNA, 20 bp, Artificial
  CRISPR gRNA sequence
ctggttgtcctcagtaagtg

SEQ ID NO: 12811 - DNA, 20 bp, Artificial
  CRISPR gRNA sequence
ggttgtcctcagtaagtgaa

SEQ ID NO: 12812 - DNA, 20 bp, Artificial
  CRISPR gRNA sequence
cctcagtaagtgaagagctc

SEQ ID NO: 12813 - DNA, 20 bp, Artificial
  CRISPR gRNA sequence
gtaagtgaagagctctggcg

SEQ ID NO: 12814 - DNA, 20 bp, Artificial
  CRISPR gRNA sequence
aagtgaagagctctggcgaa

SEQ ID NO: 12815 - DNA, 20 bp, Artificial
  CRISPR gRNA sequence
agtgaagagctctggcgaag

SEQ ID NO: 12816 - DNA, 20 bp, Artificial
  CRISPR gRNA sequence
tgaagagctctggcgaagag

SEQ ID NO: 12817 - DNA, 20 bp, Artificial
  CRISPR gRNA sequence
aagagctctggcgaagagga

SEQ ID NO: 12818 - DNA, 20 bp, Artificial
  CRISPR gRNA sequence
agctctggcgaagaggagag

SEQ ID NO: 12819 - DNA, 20 bp, Artificial
  CRISPR gRNA sequence
aagaggagagcagtttctct

SEQ ID NO: 12820 - DNA, 20 bp, Artificial
  CRISPR gRNA sequence
gagagcagtttctctcagtc

SEQ ID NO: 12821 - DNA, 20 bp, Artificial
  CRISPR gRNA sequence
gcagtttctctcagtctggc

SEQ ID NO: 12822 - DNA, 20 bp, Artificial
  CRISPR gRNA sequence
tttctctcagtctggcgagt

SEQ ID NO: 12823 - DNA, 20 bp, Artificial
  CRISPR gRNA sequence
ctctcagtctggcgagtaag

SEQ ID NO: 12824 - DNA, 20 bp, Artificial
  CRISPR gRNA sequence
ctcagtctggcgagtaagaa

SEQ ID NO: 12825 - DNA, 20 bp, Artificial
  CRISPR gRNA sequence
gtctggcgagtaagaagagc

SEQ ID NO: 12826 - DNA, 20 bp, Artificial
  CRISPR gRNA sequence
taagaagagctggtaatgct

SEQ ID NO: 12827 - DNA, 20 bp, Artificial
  CRISPR gRNA sequence
aagagctggtaatgctgagt

SEQ ID NO: 12828 - DNA, 20 bp, Artificial
  CRISPR gRNA sequence
gtaatgctgagttggatgac

SEQ ID NO: 12829 - DNA, 20 bp, Artificial
  CRISPR gRNA sequence
taatgctgagttggatgact

SEQ ID NO: 12830 - DNA, 20 bp, Artificial
  CRISPR gRNA sequence
aatgctgagttggatgactg

SEQ ID NO: 12831 - DNA, 20 bp, Artificial
  CRISPR gRNA sequence
gagttggatgactggggctc

SEQ ID NO: 12832 - DNA, 20 bp, Artificial
  CRISPR gRNA sequence
gatgactggggctctggtcc

SEQ ID NO: 12833 - DNA, 20 bp, Artificial
  CRISPR gRNA sequence
ctggggctctggtccaagct

SEQ ID NO: 12834 - DNA, 20 bp, Artificial
  CRISPR gRNA sequence
ctcagtccgctcattacctc

SEQ ID NO: 12835 - DNA, 20 bp, Artificial
  CRISPR gRNA sequence
tcagtccgctcattacctct

SEQ ID NO: 12836 - DNA, 20 bp, Artificial
  CRISPR gRNA sequence
cattacctctgggaccacac

SEQ ID NO: 12837 - DNA, 20 bp, Artificial
  CRISPR gRNA sequence
attacctctgggaccacacc

SEQ ID NO: 12838 - DNA, 20 bp, Artificial
  CRISPR gRNA sequence
ttacctctgggaccacacca

SEQ ID NO: 12839 - DNA, 20 bp, Artificial
  CRISPR gRNA sequence
tctgggaccacaccagggcc

SEQ ID NO: 12840 - DNA, 20 bp, Artificial
  CRISPR gRNA sequence
ggaccacaccagggcctgga

SEQ ID NO: 12841 - DNA, 20 bp, Artificial
  CRISPR gRNA sequence
ccacaccagggcctggatgg

SEQ ID NO: 12842 - DNA, 20 bp, Artificial
  CRISPR gRNA sequence
cctggatggaagtcactcaa

SEQ ID NO: 12843 - DNA, 20 bp, Artificial
  CRISPR gRNA sequence
gatggaagtcactcaaaagc

SEQ ID NO: 12844 - DNA, 20 bp, Artificial
  CRISPR gRNA sequence
tggaagtcactcaaaagcaa

SEQ ID NO: 12845 - DNA, 20 bp, Artificial
  CRISPR gRNA sequence
ggaagtcactcaaaagcaag

SEQ ID NO: 12846 - DNA, 20 bp, Artificial
  CRISPR gRNA sequence
aaagcaagaggtgctatgcc

SEQ ID NO: 12847 - DNA, 20 bp, Artificial
  CRISPR gRNA sequence
aagcaagaggtgctatgcca

SEQ ID NO: 12848 - DNA, 20 bp, Artificial
  CRISPR gRNA sequence
ggtgctatgccaaggcctac

SEQ ID NO: 12849 - DNA, 20 bp, Artificial
  CRISPR gRNA sequence
gctatgccaaggcctaccag

SEQ ID NO: 12850 - DNA, 20 bp, Artificial
  CRISPR gRNA sequence
ctatgccaaggcctaccaga

SEQ ID NO: 12851 - DNA, 20 bp, Artificial
  CRISPR gRNA sequence
tgccaaggcctaccagaagg

SEQ ID NO: 12852 - DNA, 20 bp, Artificial
  CRISPR gRNA sequence
caaggcctaccagaaggtgg

SEQ ID NO: 12853 - DNA, 20 bp, Artificial
  CRISPR gRNA sequence
ggtggcagtgaaacactgac

SEQ ID NO: 12854 - DNA, 20 bp, Artificial
  CRISPR gRNA sequence
tgaaacactgaccggcatgt

SEQ ID NO: 12855 - DNA, 20 bp, Artificial
  CRISPR gRNA sequence
ctgaccggcatgtaagtgac

SEQ ID NO: 12856 - DNA, 20 bp, Artificial
  CRISPR gRNA sequence
tgaccggcatgtaagtgaca

SEQ ID NO: 12857 - DNA, 20 bp, Artificial
  CRISPR gRNA sequence
cggcatgtaagtgacaaggc

SEQ ID NO: 12858 - DNA, 20 bp, Artificial
  CRISPR gRNA sequence
gtaagtgacaaggccggcaa

SEQ ID NO: 12859 - DNA, 20 bp, Artificial
  CRISPR gRNA sequence
ccggcaaaagctgacgtacg

SEQ ID NO: 12860 - DNA, 20 bp, Artificial
  CRISPR gRNA sequence
caaaagctgacgtacgtggt

SEQ ID NO: 12861 - DNA, 20 bp, Artificial
  CRISPR gRNA sequence
gacgtacgtggttagccttc

SEQ ID NO: 12862 - DNA, 20 bp, Artificial
  CRISPR gRNA sequence
gtacgtggttagccttccag

SEQ ID NO: 12863 - DNA, 20 bp, Artificial
  CRISPR gRNA sequence
cttccagaagccaccacccc

SEQ ID NO: 12864 - DNA, 20 bp, Artificial
  CRISPR gRNA sequence
ttccagaagccaccacccct

SEQ ID NO: 12865 - DNA, 20 bp, Artificial
  CRISPR gRNA sequence
aagccaccacccctaggttc

SEQ ID NO: 12866 - DNA, 20 bp, Artificial
  CRISPR gRNA sequence
ccacccctaggttccggaaa

SEQ ID NO: 12867 - DNA, 20 bp, Artificial
  CRISPR gRNA sequence
cctaggttccggaaaaagcc

SEQ ID NO: 12868 - DNA, 20 bp, Artificial
  CRISPR gRNA sequence
aagcctggtcccgccatccc

SEQ ID NO: 12869 - DNA, 20 bp, Artificial
  CRISPR gRNA sequence
agcctggtcccgccatccct

SEQ ID NO: 12870 - DNA, 20 bp, Artificial
  CRISPR gRNA sequence
gcctggtcccgccatccctg

SEQ ID NO: 12871 - DNA, 20 bp, Artificial
  CRISPR gRNA sequence
cctggtcccgccatccctgg

SEQ ID NO: 12872 - DNA, 20 bp, Artificial
  CRISPR gRNA sequence
tcccgccatccctgggggaa

SEQ ID NO: 12873 - DNA, 20 bp, Artificial
  CRISPR gRNA sequence
cccgccatccctgggggaaa

SEQ ID NO: 12874 - DNA, 20 bp, Artificial
  CRISPR gRNA sequence
cgccatccctgggggaaaag

SEQ ID NO: 12875 - DNA, 20 bp, Artificial
  CRISPR gRNA sequence
gagcaatatttattgcataa

SEQ ID NO: 12876 - DNA, 20 bp, Artificial
  CRISPR gRNA sequence
atttattgcataacagaacc

SEQ ID NO: 12877 - DNA, 20 bp, Artificial
  CRISPR gRNA sequence
acagaacctggcattgtgac

SEQ ID NO: 12878 - DNA, 20 bp, Artificial
  CRISPR gRNA sequence
cattgtgacaagtgcttaca

SEQ ID NO: 12879 - DNA, 20 bp, Artificial
  CRISPR gRNA sequence
caagtgcttacatagaccat

SEQ ID NO: 12880 - DNA, 20 bp, Artificial
  CRISPR gRNA sequence
aagtgcttacatagaccatt

SEQ ID NO: 12881 - DNA, 20 bp, Artificial
  CRISPR gRNA sequence
gcttacatagaccattagga

SEQ ID NO: 12882 - DNA, 20 bp, Artificial
  CRISPR gRNA sequence
ttaggatggttcccattttc

SEQ ID NO: 12883 - DNA, 20 bp, Artificial
  CRISPR gRNA sequence
taggatggttcccattttcc

SEQ ID NO: 12884 - DNA, 20 bp, Artificial
  CRISPR gRNA sequence
atggttcccattttccaggt

SEQ ID NO: 12885 - DNA, 20 bp, Artificial
  CRISPR gRNA sequence
ccattttccaggtaagaaaa

SEQ ID NO: 12886 - DNA, 20 bp, Artificial
  CRISPR gRNA sequence
ttttccaggtaagaaaacag

SEQ ID NO: 12887 - DNA, 20 bp, Artificial
  CRISPR gRNA sequence
ccaggtaagaaaacagcggc

SEQ ID NO: 12888 - DNA, 20 bp, Artificial
  CRISPR gRNA sequence
caggtaagaaaacagcggct

SEQ ID NO: 12889 - DNA, 20 bp, Artificial
  CRISPR gRNA sequence
gaatgaataactgacttgct

SEQ ID NO: 12890 - DNA, 20 bp, Artificial
  CRISPR gRNA sequence
atgaataactgacttgctca

SEQ ID NO: 12891 - DNA, 20 bp, Artificial
  CRISPR gRNA sequence
gtcccgctaatccttttgtt

SEQ ID NO: 12892 - DNA, 20 bp, Artificial
  CRISPR gRNA sequence
tcccgctaatccttttgttc

SEQ ID NO: 12893 - DNA, 20 bp, Artificial
  CRISPR gRNA sequence
cccgctaatccttttgttca

SEQ ID NO: 12894 - DNA, 20 bp, Artificial
  CRISPR gRNA sequence
aatccttttgttcagggctg

SEQ ID NO: 12895 - DNA, 20 bp, Artificial
  CRISPR gRNA sequence
agggctgtggtgattgcttc

SEQ ID NO: 12896 - DNA, 20 bp, Artificial
  CRISPR gRNA sequence
gggctgtggtgattgcttct

SEQ ID NO: 12897 - DNA, 20 bp, Artificial
  CRISPR gRNA sequence
ggctgtggtgattgcttcta

SEQ ID NO: 12898 - DNA, 20 bp, Artificial
  CRISPR gRNA sequence
ggtgattgcttctagggtct

SEQ ID NO: 12899 - DNA, 20 bp, Artificial
  CRISPR gRNA sequence
tagggtctcagtgtcccctg

SEQ ID NO: 12900 - DNA, 20 bp, Artificial
  CRISPR gRNA sequence
gtctcagtgtcccctgcagc

SEQ ID NO: 12901 - DNA, 20 bp, Artificial
  CRISPR gRNA sequence
cccctgcagccagcacgatg

SEQ ID NO: 12902 - DNA, 20 bp, Artificial
  CRISPR gRNA sequence
ccctgcagccagcacgatgt

SEQ ID NO: 12903 - DNA, 20 bp, Artificial
  CRISPR gRNA sequence
tgtgggttccctgcgctctg

SEQ ID NO: 12904 - DNA, 20 bp, Artificial
  CRISPR gRNA sequence
ccctgcgctctgcagccccc

SEQ ID NO: 12905 - DNA, 20 bp, Artificial
  CRISPR gRNA sequence
cgctctgcagccccccagct

SEQ ID NO: 12906 - DNA, 20 bp, Artificial
  CRISPR gRNA sequence
cccccagctcagcacctgac

SEQ ID NO: 12907 - DNA, 20 bp, Artificial
  CRISPR gRNA sequence
ctcagcacctgaccggtatc

SEQ ID NO: 12908 - DNA, 20 bp, Artificial
  CRISPR gRNA sequence
tcagcacctgaccggtatcc

SEQ ID NO: 12909 - DNA, 20 bp, Artificial
  CRISPR gRNA sequence
cagcacctgaccggtatccg

SEQ ID NO: 12910 - DNA, 20 bp, Artificial
  CRISPR gRNA sequence
atccggggccccactcacct

SEQ ID NO: 12911 - DNA, 20 bp, Artificial
  CRISPR gRNA sequence
ggccccactcaccttagcct

SEQ ID NO: 12912 - DNA, 20 bp, Artificial
  CRISPR gRNA sequence
cccactcaccttagcctgag

SEQ ID NO: 12913 - DNA, 20 bp, Artificial
  CRISPR gRNA sequence
ccactcaccttagcctgagc

SEQ ID NO: 12914 - DNA, 20 bp, Artificial
  CRISPR gRNA sequence
cactcaccttagcctgagca

SEQ ID NO: 12915 - DNA, 20 bp, Artificial
  CRISPR gRNA sequence
ccttagcctgagcagggatg

SEQ ID NO: 12916 - DNA, 20 bp, Artificial
  CRISPR gRNA sequence
agcctgagcagggatgcagc

SEQ ID NO: 12917 - DNA, 20 bp, Artificial
  CRISPR gRNA sequence
gagcagggatgcagcgagcg

SEQ ID NO: 12918 - DNA, 20 bp, Artificial
  CRISPR gRNA sequence
agcagggatgcagcgagcga

SEQ ID NO: 12919 - DNA, 20 bp, Artificial
  CRISPR gRNA sequence
agggatgcagcgagcgaagg

SEQ ID NO: 12920 - DNA, 20 bp, Artificial
  CRISPR gRNA sequence
gggatgcagcgagcgaaggc

SEQ ID NO: 12921 - DNA, 20 bp, Artificial
  CRISPR gRNA sequence
ggatgcagcgagcgaaggca

SEQ ID NO: 12922 - DNA, 20 bp, Artificial
  CRISPR gRNA sequence
agcgagcgaaggcagggcct

SEQ ID NO: 12923 - DNA, 20 bp, Artificial
  CRISPR gRNA sequence
agcgaaggcagggcctcggc

SEQ ID NO: 12924 - DNA, 20 bp, Artificial
  CRISPR gRNA sequence
gcagggcctcggcgagtttg

SEQ ID NO: 12925 - DNA, 20 bp, Artificial
  CRISPR gRNA sequence
cagggcctcggcgagtttgt

SEQ ID NO: 12926 - DNA, 20 bp, Artificial
  CRISPR gRNA sequence
tcggcgagtttgtaggcacc

SEQ ID NO: 12927 - DNA, 20 bp, Artificial
  CRISPR gRNA sequence
cggcgagtttgtaggcaccc

SEQ ID NO: 12928 - DNA, 20 bp, Artificial
  CRISPR gRNA sequence
gagtttgtaggcacccaggt

SEQ ID NO: 12929 - DNA, 20 bp, Artificial
  CRISPR gRNA sequence
ccaggtcagtgatgttgttc

SEQ ID NO: 12930 - DNA, 20 bp, Artificial
  CRISPR gRNA sequence
caggtcagtgatgttgttct

SEQ ID NO: 12931 - DNA, 20 bp, Artificial
  CRISPR gRNA sequence
tcagtgatgttgttctggga

SEQ ID NO: 12932 - DNA, 20 bp, Artificial
  CRISPR gRNA sequence
tgttgttctgggacagactg

SEQ ID NO: 12933 - DNA, 20 bp, Artificial
  CRISPR gRNA sequence
gttgttctgggacagactgc

SEQ ID NO: 12934 - DNA, 20 bp, Artificial
  CRISPR gRNA sequence
ttgttctgggacagactgcg

SEQ ID NO: 12935 - DNA, 20 bp, Artificial
  CRISPR gRNA sequence
tgggacagactgcggggaca

SEQ ID NO: 12936 - DNA, 20 bp, Artificial
  CRISPR gRNA sequence
acagactgcggggacacagt

SEQ ID NO: 12937 - DNA, 20 bp, Artificial
  CRISPR gRNA sequence
cagactgcggggacacagtg

SEQ ID NO: 12938 - DNA, 20 bp, Artificial
  CRISPR gRNA sequence
agactgcggggacacagtga

SEQ ID NO: 12939 - DNA, 20 bp, Artificial
  CRISPR gRNA sequence
gactgcggggacacagtgag

SEQ ID NO: 12940 - DNA, 20 bp, Artificial
  CRISPR gRNA sequence
actgcggggacacagtgagg

SEQ ID NO: 12941 - DNA, 20 bp, Artificial
  CRISPR gRNA sequence
tgcggggacacagtgagggg

SEQ ID NO: 12942 - DNA, 20 bp, Artificial
  CRISPR gRNA sequence
gcggggacacagtgaggggg

SEQ ID NO: 12943 - DNA, 20 bp, Artificial
  CRISPR gRNA sequence
cggggacacagtgaggggga

SEQ ID NO: 12944 - DNA, 20 bp, Artificial
  CRISPR gRNA sequence
acacagtgagggggagggct

SEQ ID NO: 12945 - DNA, 20 bp, Artificial
  CRISPR gRNA sequence
cacagtgagggggagggctc

SEQ ID NO: 12946 - DNA, 20 bp, Artificial
  CRISPR gRNA sequence
gcatgcctcactttgacctc

SEQ ID NO: 12947 - DNA, 20 bp, Artificial
  CRISPR gRNA sequence
catgcctcactttgacctca

SEQ ID NO: 12948 - DNA, 20 bp, Artificial
  CRISPR gRNA sequence
tgcctcactttgacctcaag

SEQ ID NO: 12949 - DNA, 20 bp, Artificial
  CRISPR gRNA sequence
cctcactttgacctcaagga

SEQ ID NO: 12950 - DNA, 20 bp, Artificial
  CRISPR gRNA sequence
tttgacctcaaggagagttc

SEQ ID NO: 12951 - DNA, 20 bp, Artificial
  CRISPR gRNA sequence
ttgacctcaaggagagttct

SEQ ID NO: 12952 - DNA, 20 bp, Artificial
  CRISPR gRNA sequence
tcaaggagagttctgggtca

SEQ ID NO: 12953 - DNA, 20 bp, Artificial
  CRISPR gRNA sequence
caaggagagttctgggtcat

SEQ ID NO: 12954 - DNA, 20 bp, Artificial
  CRISPR gRNA sequence
tctgggtcataggctgtgaa

SEQ ID NO: 12955 - DNA, 20 bp, Artificial
  CRISPR gRNA sequence
gctgtgaatggcgctgtcga

SEQ ID NO: 12956 - DNA, 20 bp, Artificial
  CRISPR gRNA sequence
atggcgctgtcgacagactt

SEQ ID NO: 12957 - DNA, 20 bp, Artificial
  CRISPR gRNA sequence
gacagacttaagctacctct

SEQ ID NO: 12958 - DNA, 20 bp, Artificial
  CRISPR gRNA sequence
ttaagctacctctcggtaaa

SEQ ID NO: 12959 - DNA, 20 bp, Artificial
  CRISPR gRNA sequence
taagctacctctcggtaaat

SEQ ID NO: 12960 - DNA, 20 bp, Artificial
  CRISPR gRNA sequence
agctacctctcggtaaatag

SEQ ID NO: 12961 - DNA, 20 bp, Artificial
  CRISPR gRNA sequence
gctacctctcggtaaatagg

SEQ ID NO: 12962 - DNA, 20 bp, Artificial
  CRISPR gRNA sequence
ggtaaataggaggatactgt

SEQ ID NO: 12963 - DNA, 20 bp, Artificial
  CRISPR gRNA sequence
gtaaataggaggatactgtt

SEQ ID NO: 12964 - DNA, 20 bp, Artificial
  CRISPR gRNA sequence
gaggatactgttaggtcctg

SEQ ID NO: 12965 - DNA, 20 bp, Artificial
  CRISPR gRNA sequence
tactgttaggtcctgtggcc

SEQ ID NO: 12966 - DNA, 20 bp, Artificial
  CRISPR gRNA sequence
tgttaggtcctgtggccaag

SEQ ID NO: 12967 - DNA, 20 bp, Artificial
  CRISPR gRNA sequence
gttaggtcctgtggccaagt

SEQ ID NO: 12968 - DNA, 20 bp, Artificial
  CRISPR gRNA sequence
taggtcctgtggccaagtgg

SEQ ID NO: 12969 - DNA, 20 bp, Artificial
  CRISPR gRNA sequence
aggtcctgtggccaagtggg

SEQ ID NO: 12970 - DNA, 20 bp, Artificial
  CRISPR gRNA sequence
ggtcctgtggccaagtggga

SEQ ID NO: 12971 - DNA, 20 bp, Artificial
  CRISPR gRNA sequence
cctgtggccaagtgggaggg

SEQ ID NO: 12972 - DNA, 20 bp, Artificial
  CRISPR gRNA sequence
ctgtggccaagtgggagggc

SEQ ID NO: 12973 - DNA, 20 bp, Artificial
  CRISPR gRNA sequence
tgtggccaagtgggagggca

SEQ ID NO: 12974 - DNA, 20 bp, Artificial
  CRISPR gRNA sequence
ccaagtgggagggcagggat

SEQ ID NO: 12975 - DNA, 20 bp, Artificial
  CRISPR gRNA sequence
caagtgggagggcagggatg

SEQ ID NO: 12976 - DNA, 20 bp, Artificial
  CRISPR gRNA sequence
agtgggagggcagggatgag

SEQ ID NO: 12977 - DNA, 20 bp, Artificial
  CRISPR gRNA sequence
gtgggagggcagggatgagg

SEQ ID NO: 12978 - DNA, 20 bp, Artificial
  CRISPR gRNA sequence
ggagggcagggatgaggagg

SEQ ID NO: 12979 - DNA, 20 bp, Artificial
  CRISPR gRNA sequence
ggcagggatgaggaggtgga

SEQ ID NO: 12980 - DNA, 20 bp, Artificial
  CRISPR gRNA sequence
gcagggatgaggaggtggat

SEQ ID NO: 12981 - DNA, 20 bp, Artificial
  CRISPR gRNA sequence
agggatgaggaggtggatgg

SEQ ID NO: 12982 - DNA, 20 bp, Artificial
  CRISPR gRNA sequence
gggatgaggaggtggatggg

SEQ ID NO: 12983 - DNA, 20 bp, Artificial
  CRISPR gRNA sequence
ggatgaggaggtggatggga

SEQ ID NO: 12984 - DNA, 20 bp, Artificial
  CRISPR gRNA sequence
atgaggaggtggatgggagg

SEQ ID NO: 12985 - DNA, 20 bp, Artificial
  CRISPR gRNA sequence
gaggaggtggatgggaggga

SEQ ID NO: 12986 - DNA, 20 bp, Artificial
  CRISPR gRNA sequence
tttccctctgcgccactttt

SEQ ID NO: 12987 - DNA, 20 bp, Artificial
  CRISPR gRNA sequence
tttcagcactataatgaaat

SEQ ID NO: 12988 - DNA, 20 bp, Artificial
  CRISPR gRNA sequence
cactataatgaaataagtgt

SEQ ID NO: 12989 - DNA, 20 bp, Artificial
  CRISPR gRNA sequence
tgttggcattatttgtttaa

SEQ ID NO: 12990 - DNA, 20 bp, Artificial
  CRISPR gRNA sequence
ggctgtgtaatcctttctgc

SEQ ID NO: 12991 - DNA, 20 bp, Artificial
  CRISPR gRNA sequence
gctgtgtaatcctttctgcc

SEQ ID NO: 12992 - DNA, 20 bp, Artificial
  CRISPR gRNA sequence
taatcctttctgccgggttg

SEQ ID NO: 12993 - DNA, 20 bp, Artificial
  CRISPR gRNA sequence
aatcctttctgccgggttgt

SEQ ID NO: 12994 - DNA, 20 bp, Artificial
  CRISPR gRNA sequence
gccgggttgtgggcttcaca

SEQ ID NO: 12995 - DNA, 20 bp, Artificial
  CRISPR gRNA sequence
cgggttgtgggcttcacatg

SEQ ID NO: 12996 - DNA, 20 bp, Artificial
  CRISPR gRNA sequence
gttgtgggcttcacatggag

SEQ ID NO: 12997 - DNA, 20 bp, Artificial
  CRISPR gRNA sequence
ttgtgggcttcacatggagc

SEQ ID NO: 12998 - DNA, 20 bp, Artificial
  CRISPR gRNA sequence
tgtgggcttcacatggagca

SEQ ID NO: 12999 - DNA, 20 bp, Artificial
  CRISPR gRNA sequence
cattactgtatccctgtgcc

SEQ ID NO: 13000 - DNA, 20 bp, Artificial
  CRISPR gRNA sequence
ttactgtatccctgtgccta

SEQ ID NO: 13001 - DNA, 20 bp, Artificial
  CRISPR gRNA sequence
ccctgtgcctagagcactgc

SEQ ID NO: 13002 - DNA, 20 bp, Artificial
  CRISPR gRNA sequence
cctgtgcctagagcactgcc

SEQ ID NO: 13003 - DNA, 20 bp, Artificial
  CRISPR gRNA sequence
ctagagcactgccaggcaca

SEQ ID NO: 13004 - DNA, 20 bp, Artificial
  CRISPR gRNA sequence
gagcactgccaggcacatag

SEQ ID NO: 13005 - DNA, 20 bp, Artificial
  CRISPR gRNA sequence
agcactgccaggcacatagt

SEQ ID NO: 13006 - DNA, 20 bp, Artificial
  CRISPR gRNA sequence
taggtgctcaataaatactt

SEQ ID NO: 13007 - DNA, 20 bp, Artificial
  CRISPR gRNA sequence
gtgctcaataaatacttaag

SEQ ID NO: 13008 - DNA, 20 bp, Artificial
  CRISPR gRNA sequence
tgctcaataaatacttaagt

SEQ ID NO: 13009 - DNA, 20 bp, Artificial
  CRISPR gRNA sequence
gctcaataaatacttaagtg

SEQ ID NO: 13010 - DNA, 20 bp, Artificial
  CRISPR gRNA sequence
caataaatacttaagtgggg

SEQ ID NO: 13011 - DNA, 20 bp, Artificial
  CRISPR gRNA sequence
taaatacttaagtggggtgg

SEQ ID NO: 13012 - DNA, 20 bp, Artificial
  CRISPR gRNA sequence
aaatacttaagtggggtggc

SEQ ID NO: 13013 - DNA, 20 bp, Artificial
  CRISPR gRNA sequence
acttaagtggggtggcgggt

SEQ ID NO: 13014 - DNA, 20 bp, Artificial
  CRISPR gRNA sequence
aagtggggtggcgggtaaga

SEQ ID NO: 13015 - DNA, 20 bp, Artificial
  CRISPR gRNA sequence
gtggggtggcgggtaagaaa

SEQ ID NO: 13016 - DNA, 20 bp, Artificial
  CRISPR gRNA sequence
tggggtggcgggtaagaaag

SEQ ID NO: 13017 - DNA, 20 bp, Artificial
  CRISPR gRNA sequence
ggggtggcgggtaagaaaga

SEQ ID NO: 13018 - DNA, 20 bp, Artificial
  CRISPR gRNA sequence
gggtggcgggtaagaaagag

SEQ ID NO: 13019 - DNA, 20 bp, Artificial
  CRISPR gRNA sequence
ggtggcgggtaagaaagagg

SEQ ID NO: 13020 - DNA, 20 bp, Artificial
  CRISPR gRNA sequence
gcgggtaagaaagaggggga

SEQ ID NO: 13021 - DNA, 20 bp, Artificial
  CRISPR gRNA sequence
ggtaagaaagagggggacgg

SEQ ID NO: 13022 - DNA, 20 bp, Artificial
  CRISPR gRNA sequence
gtaagaaagagggggacgga

SEQ ID NO: 13023 - DNA, 20 bp, Artificial
  CRISPR gRNA sequence
aagagggggacggaaggact

SEQ ID NO: 13024 - DNA, 20 bp, Artificial
  CRISPR gRNA sequence
agagggggacggaaggacta

SEQ ID NO: 13025 - DNA, 20 bp, Artificial
  CRISPR gRNA sequence
agggggacggaaggactaag

SEQ ID NO: 13026 - DNA, 20 bp, Artificial
  CRISPR gRNA sequence
gggacggaaggactaaggag

SEQ ID NO: 13027 - DNA, 20 bp, Artificial
  CRISPR gRNA sequence
aggactaaggagaagaaatc

SEQ ID NO: 13028 - DNA, 20 bp, Artificial
  CRISPR gRNA sequence
aggagaagaaatctagctta

SEQ ID NO: 13029 - DNA, 20 bp, Artificial
  CRISPR gRNA sequence
atctagcttacagtgttacc

SEQ ID NO: 13030 - DNA, 20 bp, Artificial
  CRISPR gRNA sequence
tctagcttacagtgttacct

SEQ ID NO: 13031 - DNA, 20 bp, Artificial
  CRISPR gRNA sequence
tacagtgttacctaggacac

SEQ ID NO: 13032 - DNA, 20 bp, Artificial
  CRISPR gRNA sequence
cctaggacactagaaattac

SEQ ID NO: 13033 - DNA, 20 bp, Artificial
  CRISPR gRNA sequence
taggacactagaaattactg

SEQ ID NO: 13034 - DNA, 20 bp, Artificial
  CRISPR gRNA sequence
gacactagaaattactggag

SEQ ID NO: 13035 - DNA, 20 bp, Artificial
  CRISPR gRNA sequence
aaattactggagaagtccca

SEQ ID NO: 13036 - DNA, 20 bp, Artificial
  CRISPR gRNA sequence
agtcccacagtcctacaatt

SEQ ID NO: 13037 - DNA, 20 bp, Artificial
  CRISPR gRNA sequence
gtcccacagtcctacaatta

SEQ ID NO: 13038 - DNA, 20 bp, Artificial
  CRISPR gRNA sequence
ctacaattaaggaaattgct

SEQ ID NO: 13039 - DNA, 20 bp, Artificial
  CRISPR gRNA sequence
ggaaattgctaagtaaattc

SEQ ID NO: 13040 - DNA, 20 bp, Artificial
  CRISPR gRNA sequence
gtaaattccggtaaattatt

SEQ ID NO: 13041 - DNA, 20 bp, Artificial
  CRISPR gRNA sequence
gtaaattatttggccatcct

SEQ ID NO: 13042 - DNA, 20 bp, Artificial
  CRISPR gRNA sequence
atttggccatcctaagacct

SEQ ID NO: 13043 - DNA, 20 bp, Artificial
  CRISPR gRNA sequence
catcctaagaccttggttgt

SEQ ID NO: 13044 - DNA, 20 bp, Artificial
  CRISPR gRNA sequence
atcctaagaccttggttgtg

SEQ ID NO: 13045 - DNA, 20 bp, Artificial
  CRISPR gRNA sequence
tcctaagaccttggttgtga

SEQ ID NO: 13046 - DNA, 20 bp, Artificial
  CRISPR gRNA sequence
cctaagaccttggttgtgag

SEQ ID NO: 13047 - DNA, 20 bp, Artificial
  CRISPR gRNA sequence
ctaagaccttggttgtgagg

SEQ ID NO: 13048 - DNA, 20 bp, Artificial
  CRISPR gRNA sequence
aagaccttggttgtgagggg

SEQ ID NO: 13049 - DNA, 20 bp, Artificial
  CRISPR gRNA sequence
cttggttgtgagggggagtg

SEQ ID NO: 13050 - DNA, 20 bp, Artificial
  CRISPR gRNA sequence
ttggttgtgagggggagtgt

SEQ ID NO: 13051 - DNA, 20 bp, Artificial
  CRISPR gRNA sequence
gttgtgagggggagtgtggg

SEQ ID NO: 13052 - DNA, 20 bp, Artificial
  CRISPR gRNA sequence
gggaagattttgatatcctc

SEQ ID NO: 13053 - DNA, 20 bp, Artificial
  CRISPR gRNA sequence
ggaagattttgatatcctct

SEQ ID NO: 13054 - DNA, 20 bp, Artificial
  CRISPR gRNA sequence
attttgatatcctctaggtt

SEQ ID NO: 13055 - DNA, 20 bp, Artificial
  CRISPR gRNA sequence
agtaaaaaatcatgttgaac

SEQ ID NO: 13056 - DNA, 20 bp, Artificial
  CRISPR gRNA sequence
gtaaaaaatcatgttgaact

SEQ ID NO: 13057 - DNA, 20 bp, Artificial
  CRISPR gRNA sequence
aaatcatgttgaactgggcg

SEQ ID NO: 13058 - DNA, 20 bp, Artificial
  CRISPR gRNA sequence
tcatgttgaactgggcgtgg

SEQ ID NO: 13059 - DNA, 20 bp, Artificial
  CRISPR gRNA sequence
ctgggcgtggtggctcatgc

SEQ ID NO: 13060 - DNA, 20 bp, Artificial
  CRISPR gRNA sequence
gtggctcatgccggtaatcc

SEQ ID NO: 13061 - DNA, 20 bp, Artificial
  CRISPR gRNA sequence
tgccggtaatcccagcactt

SEQ ID NO: 13062 - DNA, 20 bp, Artificial
  CRISPR gRNA sequence
gccggtaatcccagcacttt

SEQ ID NO: 13063 - DNA, 20 bp, Artificial
  CRISPR gRNA sequence
cggtaatcccagcactttgg

SEQ ID NO: 13064 - DNA, 20 bp, Artificial
  CRISPR gRNA sequence
ggtaatcccagcactttggg

SEQ ID NO: 13065 - DNA, 20 bp, Artificial
  CRISPR gRNA sequence
tcccagcactttgggaggct

SEQ ID NO: 13066 - DNA, 20 bp, Artificial
  CRISPR gRNA sequence
cccagcactttgggaggctg

SEQ ID NO: 13067 - DNA, 20 bp, Artificial
  CRISPR gRNA sequence
agcactttgggaggctgagg

SEQ ID NO: 13068 - DNA, 20 bp, Artificial
  CRISPR gRNA sequence
gcactttgggaggctgaggt

SEQ ID NO: 13069 - DNA, 20 bp, Artificial
  CRISPR gRNA sequence
ctttgggaggctgaggtggg

SEQ ID NO: 13070 - DNA, 20 bp, Artificial
  CRISPR gRNA sequence
ctgaggtgggcggatcactt

SEQ ID NO: 13071 - DNA, 20 bp, Artificial
  CRISPR gRNA sequence
tgaggtgggcggatcacttg

SEQ ID NO: 13072 - DNA, 20 bp, Artificial
  CRISPR gRNA sequence
gtgggcggatcacttgaggt

SEQ ID NO: 13073 - DNA, 20 bp, Artificial
  CRISPR gRNA sequence
tgggcggatcacttgaggtc

SEQ ID NO: 13074 - DNA, 20 bp, Artificial
  CRISPR gRNA sequence
ggcggatcacttgaggtcag

SEQ ID NO: 13075 - DNA, 20 bp, Artificial
  CRISPR gRNA sequence
tcacttgaggtcaggagttc

SEQ ID NO: 13076 - DNA, 20 bp, Artificial
  CRISPR gRNA sequence
tgaggtcaggagttcaagac

SEQ ID NO: 13077 - DNA, 20 bp, Artificial
  CRISPR gRNA sequence
tcaggagttcaagaccagcc

SEQ ID NO: 13078 - DNA, 20 bp, Artificial
  CRISPR gRNA sequence
caagaccagcctggccaacc

SEQ ID NO: 13079 - DNA, 20 bp, Artificial
  CRISPR gRNA sequence
tctactaaaaatacaaaaat

SEQ ID NO: 13080 - DNA, 20 bp, Artificial
  CRISPR gRNA sequence
ctaaaaatacaaaaattagt

SEQ ID NO: 13081 - DNA, 20 bp, Artificial
  CRISPR gRNA sequence
taaaaatacaaaaattagtt

SEQ ID NO: 13082 - DNA, 20 bp, Artificial
  CRISPR gRNA sequence
atacaaaaattagttgggtg

SEQ ID NO: 13083 - DNA, 20 bp, Artificial
  CRISPR gRNA sequence
caaaaattagttgggtgtag

SEQ ID NO: 13084 - DNA, 20 bp, Artificial
  CRISPR gRNA sequence
gtggtgcatgcctgtaattc

SEQ ID NO: 13085 - DNA, 20 bp, Artificial
  CRISPR gRNA sequence
tgcctgtaattccagctact

SEQ ID NO: 13086 - DNA, 20 bp, Artificial
  CRISPR gRNA sequence
gcctgtaattccagctactt

SEQ ID NO: 13087 - DNA, 20 bp, Artificial
  CRISPR gRNA sequence
ctgtaattccagctacttgg

SEQ ID NO: 13088 - DNA, 20 bp, Artificial
  CRISPR gRNA sequence
tgtaattccagctacttggg

SEQ ID NO: 13089 - DNA, 20 bp, Artificial
  CRISPR gRNA sequence
ttccagctacttgggaggct

SEQ ID NO: 13090 - DNA, 20 bp, Artificial
  CRISPR gRNA sequence
tccagctacttgggaggctg

SEQ ID NO: 13091 - DNA, 20 bp, Artificial
  CRISPR gRNA sequence
tacttgggaggctgaggtgt

SEQ ID NO: 13092 - DNA, 20 bp, Artificial
  CRISPR gRNA sequence
gtgtgagaattgcttgaacc

SEQ ID NO: 13093 - DNA, 20 bp, Artificial
  CRISPR gRNA sequence
tgtgagaattgcttgaaccc

SEQ ID NO: 13094 - DNA, 20 bp, Artificial
  CRISPR gRNA sequence
tgagaattgcttgaacccag

SEQ ID NO: 13095 - DNA, 20 bp, Artificial
  CRISPR gRNA sequence
gagaattgcttgaacccagg

SEQ ID NO: 13096 - DNA, 20 bp, Artificial
  CRISPR gRNA sequence
ttgcttgaacccaggaggtg

SEQ ID NO: 13097 - DNA, 20 bp, Artificial
  CRISPR gRNA sequence
gaggtgaagtttgcaataaa

SEQ ID NO: 13098 - DNA, 20 bp, Artificial
  CRISPR gRNA sequence
tagatcgtaccactgcactc

SEQ ID NO: 13099 - DNA, 20 bp, Artificial
  CRISPR gRNA sequence
cgtaccactgcactccagcc

SEQ ID NO: 13100 - DNA, 20 bp, Artificial
  CRISPR gRNA sequence
gtaccactgcactccagcct

SEQ ID NO: 13101 - DNA, 20 bp, Artificial
  CRISPR gRNA sequence
ctgcactccagcctgggcta

SEQ ID NO: 13102 - DNA, 20 bp, Artificial
  CRISPR gRNA sequence
gcactccagcctgggctaca

SEQ ID NO: 13103 - DNA, 20 bp, Artificial
  CRISPR gRNA sequence
tccagcctgggctacagagc

SEQ ID NO: 13104 - DNA, 20 bp, Artificial
  CRISPR gRNA sequence
aaaaaaaaatcccattgaac

SEQ ID NO: 13105 - DNA, 20 bp, Artificial
  CRISPR gRNA sequence
aaaaaaaatcccattgaacc

SEQ ID NO: 13106 - DNA, 20 bp, Artificial
  CRISPR gRNA sequence
aaatcccattgaaccaggca

SEQ ID NO: 13107 - DNA, 20 bp, Artificial
  CRISPR gRNA sequence
gtgactcatgcctgtaatcc

SEQ ID NO: 13108 - DNA, 20 bp, Artificial
  CRISPR gRNA sequence
tgcctgtaatcccagtactt

SEQ ID NO: 13109 - DNA, 20 bp, Artificial
  CRISPR gRNA sequence
gcctgtaatcccagtacttt

SEQ ID NO: 13110 - DNA, 20 bp, Artificial
  CRISPR gRNA sequence
ctgtaatcccagtactttgg

SEQ ID NO: 13111 - DNA, 20 bp, Artificial
  CRISPR gRNA sequence
tgtaatcccagtactttggg

SEQ ID NO: 13112 - DNA, 20 bp, Artificial
  CRISPR gRNA sequence
aatcccagtactttgggagg

SEQ ID NO: 13113 - DNA, 20 bp, Artificial
  CRISPR gRNA sequence
tcccagtactttgggaggca

SEQ ID NO: 13114 - DNA, 20 bp, Artificial
  CRISPR gRNA sequence
cccagtactttgggaggcag

SEQ ID NO: 13115 - DNA, 20 bp, Artificial
  CRISPR gRNA sequence
agtactttgggaggcagagg

SEQ ID NO: 13116 - DNA, 20 bp, Artificial
  CRISPR gRNA sequence
gtactttgggaggcagaggc

SEQ ID NO: 13117 - DNA, 20 bp, Artificial
  CRISPR gRNA sequence
actttgggaggcagaggcag

SEQ ID NO: 13118 - DNA, 20 bp, Artificial
  CRISPR gRNA sequence
ctttgggaggcagaggcagg

SEQ ID NO: 13119 - DNA, 20 bp, Artificial
  CRISPR gRNA sequence
gggaggcagaggcaggagga

SEQ ID NO: 13120 - DNA, 20 bp, Artificial
  CRISPR gRNA sequence
cagaggcaggaggatggctt

SEQ ID NO: 13121 - DNA, 20 bp, Artificial
  CRISPR gRNA sequence
gcaggaggatggcttgagct

SEQ ID NO: 13122 - DNA, 20 bp, Artificial
  CRISPR gRNA sequence
ggaggatggcttgagctcag

SEQ ID NO: 13123 - DNA, 20 bp, Artificial
  CRISPR gRNA sequence
tggcttgagctcagaagttc

SEQ ID NO: 13124 - DNA, 20 bp, Artificial
  CRISPR gRNA sequence
tgagctcagaagttcaagac

SEQ ID NO: 13125 - DNA, 20 bp, Artificial
  CRISPR gRNA sequence
tcagaagttcaagaccagcc

SEQ ID NO: 13126 - DNA, 20 bp, Artificial
  CRISPR gRNA sequence
cagaagttcaagaccagcct

SEQ ID NO: 13127 - DNA, 20 bp, Artificial
  CRISPR gRNA sequence
caagaccagcctgggcaacg

SEQ ID NO: 13128 - DNA, 20 bp, Artificial
  CRISPR gRNA sequence
ctacaaaaaaatacaaaaat

SEQ ID NO: 13129 - DNA, 20 bp, Artificial
  CRISPR gRNA sequence
caaaaaaatacaaaaattag

SEQ ID NO: 13130 - DNA, 20 bp, Artificial
  CRISPR gRNA sequence
aaaaaaatacaaaaattagc

SEQ ID NO: 13131 - DNA, 20 bp, Artificial
  CRISPR gRNA sequence
atacaaaaattagcgggacg

SEQ ID NO: 13132 - DNA, 20 bp, Artificial
  CRISPR gRNA sequence
caaaaattagcgggacgtgg

SEQ ID NO: 13133 - DNA, 20 bp, Artificial
  CRISPR gRNA sequence
gtggtggcatgcacctgtcc

SEQ ID NO: 13134 - DNA, 20 bp, Artificial
  CRISPR gRNA sequence
atgcacctgtcccagctact

SEQ ID NO: 13135 - DNA, 20 bp, Artificial
  CRISPR gRNA sequence
cacctgtcccagctactcag

SEQ ID NO: 13136 - DNA, 20 bp, Artificial
  CRISPR gRNA sequence
acctgtcccagctactcaga

SEQ ID NO: 13137 - DNA, 20 bp, Artificial
  CRISPR gRNA sequence
tcccagctactcagaaggtt

SEQ ID NO: 13138 - DNA, 20 bp, Artificial
  CRISPR gRNA sequence
agctactcagaaggttgaga

SEQ ID NO: 13139 - DNA, 20 bp, Artificial
  CRISPR gRNA sequence
gctactcagaaggttgagat

SEQ ID NO: 13140 - DNA, 20 bp, Artificial
  CRISPR gRNA sequence
tactcagaaggttgagatgg

SEQ ID NO: 13141 - DNA, 20 bp, Artificial
  CRISPR gRNA sequence
actcagaaggttgagatggg

SEQ ID NO: 13142 - DNA, 20 bp, Artificial
  CRISPR gRNA sequence
ttgagatgggaggattgctt

SEQ ID NO: 13143 - DNA, 20 bp, Artificial
  CRISPR gRNA sequence
atgggaggattgcttgagcc

SEQ ID NO: 13144 - DNA, 20 bp, Artificial
  CRISPR gRNA sequence
tgggaggattgcttgagcct

SEQ ID NO: 13145 - DNA, 20 bp, Artificial
  CRISPR gRNA sequence
ggaggattgcttgagcctag

SEQ ID NO: 13146 - DNA, 20 bp, Artificial
  CRISPR gRNA sequence
ttgcttgagcctaggagatt

SEQ ID NO: 13147 - DNA, 20 bp, Artificial
  CRISPR gRNA sequence
tgcttgagcctaggagattg

SEQ ID NO: 13148 - DNA, 20 bp, Artificial
  CRISPR gRNA sequence
agcctaggagattgaggctg

SEQ ID NO: 13149 - DNA, 20 bp, Artificial
  CRISPR gRNA sequence
taggagattgaggctgcagt

SEQ ID NO: 13150 - DNA, 20 bp, Artificial
  CRISPR gRNA sequence
tacaccactgcactccaccc

SEQ ID NO: 13151 - DNA, 20 bp, Artificial
  CRISPR gRNA sequence
acaccactgcactccaccct

SEQ ID NO: 13152 - DNA, 20 bp, Artificial
  CRISPR gRNA sequence
ctgcactccaccctgggtga

SEQ ID NO: 13153 - DNA, 20 bp, Artificial
  CRISPR gRNA sequence
gcactccaccctgggtgaca

SEQ ID NO: 13154 - DNA, 20 bp, Artificial
  CRISPR gRNA sequence
tccaccctgggtgacagagc

SEQ ID NO: 13155 - DNA, 20 bp, Artificial
  CRISPR gRNA sequence
gcgagaccttgtctgaaaaa

SEQ ID NO: 13156 - DNA, 20 bp, Artificial
  CRISPR gRNA sequence
cttatccatctccaacttcc

SEQ ID NO: 13157 - DNA, 20 bp, Artificial
  CRISPR gRNA sequence
tatccatctccaacttccca

SEQ ID NO: 13158 - DNA, 20 bp, Artificial
  CRISPR gRNA sequence
atctccaacttcccagagcc

SEQ ID NO: 13159 - DNA, 20 bp, Artificial
  CRISPR gRNA sequence
caacttcccagagcccagaa

SEQ ID NO: 13160 - DNA, 20 bp, Artificial
  CRISPR gRNA sequence
agcccagaacagtttttaaa

SEQ ID NO: 13161 - DNA, 20 bp, Artificial
  CRISPR gRNA sequence
atctctcctatttcaccccc

SEQ ID NO: 13162 - DNA, 20 bp, Artificial
  CRISPR gRNA sequence
tgttcattgtgtctcctcac

SEQ ID NO: 13163 - DNA, 20 bp, Artificial
  CRISPR gRNA sequence
gtgtctcctcactagaattt

SEQ ID NO: 13164 - DNA, 20 bp, Artificial
  CRISPR gRNA sequence
cactagaatttaagattcct

SEQ ID NO: 13165 - DNA, 20 bp, Artificial
  CRISPR gRNA sequence
actagaatttaagattcctg

SEQ ID NO: 13166 - DNA, 20 bp, Artificial
  CRISPR gRNA sequence
gaatttaagattcctgaggt

SEQ ID NO: 13167 - DNA, 20 bp, Artificial
  CRISPR gRNA sequence
aatttaagattcctgaggtc

SEQ ID NO: 13168 - DNA, 20 bp, Artificial
  CRISPR gRNA sequence
atttaagattcctgaggtca

SEQ ID NO: 13169 - DNA, 20 bp, Artificial
  CRISPR gRNA sequence
tttaagattcctgaggtcag

SEQ ID NO: 13170 - DNA, 20 bp, Artificial
  CRISPR gRNA sequence
ggatttatttgttttgttta

SEQ ID NO: 13171 - DNA, 20 bp, Artificial
  CRISPR gRNA sequence
ttatttgttttgtttaaagc

SEQ ID NO: 13172 - DNA, 20 bp, Artificial
  CRISPR gRNA sequence
tatttgttttgtttaaagct

SEQ ID NO: 13173 - DNA, 20 bp, Artificial
  CRISPR gRNA sequence
tttgtttaaagctgggtctc

SEQ ID NO: 13174 - DNA, 20 bp, Artificial
  CRISPR gRNA sequence
ttgtttaaagctgggtctcc

SEQ ID NO: 13175 - DNA, 20 bp, Artificial
  CRISPR gRNA sequence
tgtttaaagctgggtctcca

SEQ ID NO: 13176 - DNA, 20 bp, Artificial
  CRISPR gRNA sequence
aaagctgggtctccagggcc

SEQ ID NO: 13177 - DNA, 20 bp, Artificial
  CRISPR gRNA sequence
ctgggtctccagggcctaga

SEQ ID NO: 13178 - DNA, 20 bp, Artificial
  CRISPR gRNA sequence
tgggtctccagggcctagaa

SEQ ID NO: 13179 - DNA, 20 bp, Artificial
  CRISPR gRNA sequence
cctagaaaggtgcctgcaca

SEQ ID NO: 13180 - DNA, 20 bp, Artificial
  CRISPR gRNA sequence
agaaaggtgcctgcacatag

SEQ ID NO: 13181 - DNA, 20 bp, Artificial
  CRISPR gRNA sequence
gaaaggtgcctgcacatagt

SEQ ID NO: 13182 - DNA, 20 bp, Artificial
  CRISPR gRNA sequence
ttgttgattaaattaataaa

SEQ ID NO: 13183 - DNA, 20 bp, Artificial
  CRISPR gRNA sequence
tgattaaattaataaatggt

SEQ ID NO: 13184 - DNA, 20 bp, Artificial
  CRISPR gRNA sequence
gattaaattaataaatggtt

SEQ ID NO: 13185 - DNA, 20 bp, Artificial
  CRISPR gRNA sequence
aaattaataaatggttgggt

SEQ ID NO: 13186 - DNA, 20 bp, Artificial
  CRISPR gRNA sequence
aataaatggttgggtaagta

SEQ ID NO: 13187 - DNA, 20 bp, Artificial
  CRISPR gRNA sequence
gggtaagtaaagaaatgatt

SEQ ID NO: 13188 - DNA, 20 bp, Artificial
  CRISPR gRNA sequence
aagtaaagaaatgattgagt

SEQ ID NO: 13189 - DNA, 20 bp, Artificial
  CRISPR gRNA sequence
taaagaaatgattgagtgag

SEQ ID NO: 13190 - DNA, 20 bp, Artificial
  CRISPR gRNA sequence
gaaatgattgagtgagcggt

SEQ ID NO: 13191 - DNA, 20 bp, Artificial
  CRISPR gRNA sequence
gattgagtgagcggttggat

SEQ ID NO: 13192 - DNA, 20 bp, Artificial
  CRISPR gRNA sequence
attgagtgagcggttggatg

SEQ ID NO: 13193 - DNA, 20 bp, Artificial
  CRISPR gRNA sequence
ttgagtgagcggttggatga

SEQ ID NO: 13194 - DNA, 20 bp, Artificial
  CRISPR gRNA sequence
gagtgagcggttggatgagg

SEQ ID NO: 13195 - DNA, 20 bp, Artificial
  CRISPR gRNA sequence
agcggttggatgagggagta

SEQ ID NO: 13196 - DNA, 20 bp, Artificial
  CRISPR gRNA sequence
gagtaaagaaatgactgcat

SEQ ID NO: 13197 - DNA, 20 bp, Artificial
  CRISPR gRNA sequence
gaaatgactgcataagtgaa

SEQ ID NO: 13198 - DNA, 20 bp, Artificial
  CRISPR gRNA sequence
tgaatggatgaatcattgaa

SEQ ID NO: 13199 - DNA, 20 bp, Artificial
  CRISPR gRNA sequence
atggatgaatcattgaatgg

SEQ ID NO: 13200 - DNA, 20 bp, Artificial
  CRISPR gRNA sequence
tggatgaatcattgaatgga

SEQ ID NO: 13201 - DNA, 20 bp, Artificial
  CRISPR gRNA sequence
tcattgaatggaaggatgaa

SEQ ID NO: 13202 - DNA, 20 bp, Artificial
  CRISPR gRNA sequence
aggatgaatggctgattgaa

SEQ ID NO: 13203 - DNA, 20 bp, Artificial
  CRISPR gRNA sequence
ggatgaatggctgattgaat

SEQ ID NO: 13204 - DNA, 20 bp, Artificial
  CRISPR gRNA sequence
ggctgattgaataggtgaat

SEQ ID NO: 13205 - DNA, 20 bp, Artificial
  CRISPR gRNA sequence
tgaataggtgaatgagtgaa

SEQ ID NO: 13206 - DNA, 20 bp, Artificial
  CRISPR gRNA sequence
gagtgaatggatgaatccac

SEQ ID NO: 13207 - DNA, 20 bp, Artificial
  CRISPR gRNA sequence
agtgaatggatgaatccact

SEQ ID NO: 13208 - DNA, 20 bp, Artificial
  CRISPR gRNA sequence
gtgaatggatgaatccactg

SEQ ID NO: 13209 - DNA, 20 bp, Artificial
  CRISPR gRNA sequence
atggatgaatccactggggc

SEQ ID NO: 13210 - DNA, 20 bp, Artificial
  CRISPR gRNA sequence
tggatgaatccactggggct

SEQ ID NO: 13211 - DNA, 20 bp, Artificial
  CRISPR gRNA sequence
gaatccactggggctgggca

SEQ ID NO: 13212 - DNA, 20 bp, Artificial
  CRISPR gRNA sequence
ccactggggctgggcatggt

SEQ ID NO: 13213 - DNA, 20 bp, Artificial
  CRISPR gRNA sequence
gtaagtcacacctataatcc

SEQ ID NO: 13214 - DNA, 20 bp, Artificial
  CRISPR gRNA sequence
cacctataatcccagcactt

SEQ ID NO: 13215 - DNA, 20 bp, Artificial
  CRISPR gRNA sequence
acctataatcccagcacttt

SEQ ID NO: 13216 - DNA, 20 bp, Artificial
  CRISPR gRNA sequence
tataatcccagcactttggg

SEQ ID NO: 13217 - DNA, 20 bp, Artificial
  CRISPR gRNA sequence
aatcccagcactttgggaag

SEQ ID NO: 13218 - DNA, 20 bp, Artificial
  CRISPR gRNA sequence
tcccagcactttgggaagcg

SEQ ID NO: 13219 - DNA, 20 bp, Artificial
  CRISPR gRNA sequence
cccagcactttgggaagcgg

SEQ ID NO: 13220 - DNA, 20 bp, Artificial
  CRISPR gRNA sequence
gcactttgggaagcggaggt

SEQ ID NO: 13221 - DNA, 20 bp, Artificial
  CRISPR gRNA sequence
cactttgggaagcggaggtg

SEQ ID NO: 13222 - DNA, 20 bp, Artificial
  CRISPR gRNA sequence
ctttgggaagcggaggtgag

SEQ ID NO: 13223 - DNA, 20 bp, Artificial
  CRISPR gRNA sequence
cggaggtgaggagattcctt

SEQ ID NO: 13224 - DNA, 20 bp, Artificial
  CRISPR gRNA sequence
ggaggtgaggagattccttg

SEQ ID NO: 13225 - DNA, 20 bp, Artificial
  CRISPR gRNA sequence
gtgaggagattccttgaggc

SEQ ID NO: 13226 - DNA, 20 bp, Artificial
  CRISPR gRNA sequence
tgaggagattccttgaggcc

SEQ ID NO: 13227 - DNA, 20 bp, Artificial
  CRISPR gRNA sequence
aggagattccttgaggccag

SEQ ID NO: 13228 - DNA, 20 bp, Artificial
  CRISPR gRNA sequence
ttccttgaggccaggagttc

SEQ ID NO: 13229 - DNA, 20 bp, Artificial
  CRISPR gRNA sequence
tccttgaggccaggagttca

SEQ ID NO: 13230 - DNA, 20 bp, Artificial
  CRISPR gRNA sequence
aggccaggagttcaaggctg

SEQ ID NO: 13231 - DNA, 20 bp, Artificial
  CRISPR gRNA sequence
gccaggagttcaaggctgca

SEQ ID NO: 13232 - DNA, 20 bp, Artificial
  CRISPR gRNA sequence
ccaggagttcaaggctgcag

SEQ ID NO: 13233 - DNA, 20 bp, Artificial
  CRISPR gRNA sequence
aggctgcagaggtatgatca

SEQ ID NO: 13234 - DNA, 20 bp, Artificial
  CRISPR gRNA sequence
atgatcatagcactatattc

SEQ ID NO: 13235 - DNA, 20 bp, Artificial
  CRISPR gRNA sequence
catagcactatattctagcc

SEQ ID NO: 13236 - DNA, 20 bp, Artificial
  CRISPR gRNA sequence
atagcactatattctagcct

SEQ ID NO: 13237 - DNA, 20 bp, Artificial
  CRISPR gRNA sequence
atattctagcctgggtgaca

SEQ ID NO: 13238 - DNA, 20 bp, Artificial
  CRISPR gRNA sequence
tctagcctgggtgacacagc

SEQ ID NO: 13239 - DNA, 20 bp, Artificial
  CRISPR gRNA sequence
aatttaaattaattttgaaa

SEQ ID NO: 13240 - DNA, 20 bp, Artificial
  CRISPR gRNA sequence
taaattaattttgaaaaagt

SEQ ID NO: 13241 - DNA, 20 bp, Artificial
  CRISPR gRNA sequence
ttaattttgaaaaagtcagc

SEQ ID NO: 13242 - DNA, 20 bp, Artificial
  CRISPR gRNA sequence
tgaaaaagtcagccggactt

SEQ ID NO: 13243 - DNA, 20 bp, Artificial
  CRISPR gRNA sequence
gaaaaagtcagccggacttt

SEQ ID NO: 13244 - DNA, 20 bp, Artificial
  CRISPR gRNA sequence
aaaaagtcagccggactttg

SEQ ID NO: 13245 - DNA, 20 bp, Artificial
  CRISPR gRNA sequence
aaaagtcagccggactttgg

SEQ ID NO: 13246 - DNA, 20 bp, Artificial
  CRISPR gRNA sequence
cggactttgggggcccgatt

SEQ ID NO: 13247 - DNA, 20 bp, Artificial
  CRISPR gRNA sequence
actttgggggcccgattcag

SEQ ID NO: 13248 - DNA, 20 bp, Artificial
  CRISPR gRNA sequence
ctttgggggcccgattcagc

SEQ ID NO: 13249 - DNA, 20 bp, Artificial
  CRISPR gRNA sequence
tgggggcccgattcagcagg

SEQ ID NO: 13250 - DNA, 20 bp, Artificial
  CRISPR gRNA sequence
gggggcccgattcagcagga

SEQ ID NO: 13251 - DNA, 20 bp, Artificial
  CRISPR gRNA sequence
ggggcccgattcagcaggaa

SEQ ID NO: 13252 - DNA, 20 bp, Artificial
  CRISPR gRNA sequence
gcccgattcagcaggaaggg

SEQ ID NO: 13253 - DNA, 20 bp, Artificial
  CRISPR gRNA sequence
cccgattcagcaggaagggc

SEQ ID NO: 13254 - DNA, 20 bp, Artificial
  CRISPR gRNA sequence
ttcagcaggaagggcaggcc

SEQ ID NO: 13255 - DNA, 20 bp, Artificial
  CRISPR gRNA sequence
caggcccagctcactcactt

SEQ ID NO: 13256 - DNA, 20 bp, Artificial
  CRISPR gRNA sequence
aggcccagctcactcacttg

SEQ ID NO: 13257 - DNA, 20 bp, Artificial
  CRISPR gRNA sequence
ggcccagctcactcacttga

SEQ ID NO: 13258 - DNA, 20 bp, Artificial
  CRISPR gRNA sequence
tcactcacttgagggtttcc

SEQ ID NO: 13259 - DNA, 20 bp, Artificial
  CRISPR gRNA sequence
cactcacttgagggtttcca

SEQ ID NO: 13260 - DNA, 20 bp, Artificial
  CRISPR gRNA sequence
ttgagggtttccaaggactt

SEQ ID NO: 13261 - DNA, 20 bp, Artificial
  CRISPR gRNA sequence
gggtttccaaggacttcagc

SEQ ID NO: 13262 - DNA, 20 bp, Artificial
  CRISPR gRNA sequence
ggtttccaaggacttcagct

SEQ ID NO: 13263 - DNA, 20 bp, Artificial
  CRISPR gRNA sequence
gtttccaaggacttcagctg

SEQ ID NO: 13264 - DNA, 20 bp, Artificial
  CRISPR gRNA sequence
tttccaaggacttcagctgg

SEQ ID NO: 13265 - DNA, 20 bp, Artificial
  CRISPR gRNA sequence
ccaaggacttcagctggggg

SEQ ID NO: 13266 - DNA, 20 bp, Artificial
  CRISPR gRNA sequence
caaggacttcagctggggga

SEQ ID NO: 13267 - DNA, 20 bp, Artificial
  CRISPR gRNA sequence
ggacttcagctgggggaagg

SEQ ID NO: 13268 - DNA, 20 bp, Artificial
  CRISPR gRNA sequence
tcagctgggggaaggtggct

SEQ ID NO: 13269 - DNA, 20 bp, Artificial
  CRISPR gRNA sequence
agctgggggaaggtggctga

SEQ ID NO: 13270 - DNA, 20 bp, Artificial
  CRISPR gRNA sequence
ggaaggtggctgagagctgc

SEQ ID NO: 13271 - DNA, 20 bp, Artificial
  CRISPR gRNA sequence
tccccgatcttgttctcact

SEQ ID NO: 13272 - DNA, 20 bp, Artificial
  CRISPR gRNA sequence
ttgttctcactcagcgcatc

SEQ ID NO: 13273 - DNA, 20 bp, Artificial
  CRISPR gRNA sequence
tgttctcactcagcgcatcc

SEQ ID NO: 13274 - DNA, 20 bp, Artificial
  CRISPR gRNA sequence
cactcagcgcatccaggctg

SEQ ID NO: 13275 - DNA, 20 bp, Artificial
  CRISPR gRNA sequence
actcagcgcatccaggctgc

SEQ ID NO: 13276 - DNA, 20 bp, Artificial
  CRISPR gRNA sequence
cagcgcatccaggctgcagg

SEQ ID NO: 13277 - DNA, 20 bp, Artificial
  CRISPR gRNA sequence
atccaggctgcaggtggaat

SEQ ID NO: 13278 - DNA, 20 bp, Artificial
  CRISPR gRNA sequence
aggctgcaggtggaatcaga

SEQ ID NO: 13279 - DNA, 20 bp, Artificial
  CRISPR gRNA sequence
ggctgcaggtggaatcagat

SEQ ID NO: 13280 - DNA, 20 bp, Artificial
  CRISPR gRNA sequence
gctgcaggtggaatcagatg

SEQ ID NO: 13281 - DNA, 20 bp, Artificial
  CRISPR gRNA sequence
ctgcaggtggaatcagatgg

SEQ ID NO: 13282 - DNA, 20 bp, Artificial
  CRISPR gRNA sequence
tggaatcagatgggggccat

SEQ ID NO: 13283 - DNA, 20 bp, Artificial
  CRISPR gRNA sequence
atcagatgggggccatcagc

SEQ ID NO: 13284 - DNA, 20 bp, Artificial
  CRISPR gRNA sequence
ggggccatcagctagcgtcc

SEQ ID NO: 13285 - DNA, 20 bp, Artificial
  CRISPR gRNA sequence
gggccatcagctagcgtcct

SEQ ID NO: 13286 - DNA, 20 bp, Artificial
  CRISPR gRNA sequence
ggccatcagctagcgtcctg

SEQ ID NO: 13287 - DNA, 20 bp, Artificial
  CRISPR gRNA sequence
ccatctgacccttcccatcc

SEQ ID NO: 13288 - DNA, 20 bp, Artificial
  CRISPR gRNA sequence
ctgacccttcccatcccagt

SEQ ID NO: 13289 - DNA, 20 bp, Artificial
  CRISPR gRNA sequence
tgacccttcccatcccagtg

SEQ ID NO: 13290 - DNA, 20 bp, Artificial
  CRISPR gRNA sequence
gacccttcccatcccagtga

SEQ ID NO: 13291 - DNA, 20 bp, Artificial
  CRISPR gRNA sequence
catcccagtgagggcctcct

SEQ ID NO: 13292 - DNA, 20 bp, Artificial
  CRISPR gRNA sequence
agtgagggcctcctcagccc

SEQ ID NO: 13293 - DNA, 20 bp, Artificial
  CRISPR gRNA sequence
cacctgcccttcccaccccc

SEQ ID NO: 13294 - DNA, 20 bp, Artificial
  CRISPR gRNA sequence
cccccagctctaatacacca

SEQ ID NO: 13295 - DNA, 20 bp, Artificial
  CRISPR gRNA sequence
ccccagctctaatacaccat

SEQ ID NO: 13296 - DNA, 20 bp, Artificial
  CRISPR gRNA sequence
cagctctaatacaccatagg

SEQ ID NO: 13297 - DNA, 20 bp, Artificial
  CRISPR gRNA sequence
tctaatacaccataggcagc

SEQ ID NO: 13298 - DNA, 20 bp, Artificial
  CRISPR gRNA sequence
taggcagccggcacattcct

SEQ ID NO: 13299 - DNA, 20 bp, Artificial
  CRISPR gRNA sequence
cggcacattcctgagctttt

SEQ ID NO: 13300 - DNA, 20 bp, Artificial
  CRISPR gRNA sequence
cattcctgagcttttcagac

SEQ ID NO: 13301 - DNA, 20 bp, Artificial
  CRISPR gRNA sequence
attcctgagcttttcagacg

SEQ ID NO: 13302 - DNA, 20 bp, Artificial
  CRISPR gRNA sequence
cagacgaggacttcatcacc

SEQ ID NO: 13303 - DNA, 20 bp, Artificial
  CRISPR gRNA sequence
agacgaggacttcatcacct

SEQ ID NO: 13304 - DNA, 20 bp, Artificial
  CRISPR gRNA sequence
gacgaggacttcatcacctg

SEQ ID NO: 13305 - DNA, 20 bp, Artificial
  CRISPR gRNA sequence
acgaggacttcatcacctgg

SEQ ID NO: 13306 - DNA, 20 bp, Artificial
  CRISPR gRNA sequence
catcacctgggggctccaac

SEQ ID NO: 13307 - DNA, 20 bp, Artificial
  CRISPR gRNA sequence
atcacctgggggctccaacc

SEQ ID NO: 13308 - DNA, 20 bp, Artificial
  CRISPR gRNA sequence
acctgggggctccaaccagg

SEQ ID NO: 13309 - DNA, 20 bp, Artificial
  CRISPR gRNA sequence
gggggctccaaccaggcagc

SEQ ID NO: 13310 - DNA, 20 bp, Artificial
  CRISPR gRNA sequence
gggctccaaccaggcagcca

SEQ ID NO: 13311 - DNA, 20 bp, Artificial
  CRISPR gRNA sequence
ggctccaaccaggcagccag

SEQ ID NO: 13312 - DNA, 20 bp, Artificial
  CRISPR gRNA sequence
gctccaaccaggcagccaga

SEQ ID NO: 13313 - DNA, 20 bp, Artificial
  CRISPR gRNA sequence
aaccaggcagccagagggca

SEQ ID NO: 13314 - DNA, 20 bp, Artificial
  CRISPR gRNA sequence
gggcaaagtctaactcatga

SEQ ID NO: 13315 - DNA, 20 bp, Artificial
  CRISPR gRNA sequence
gatggacttgaatccctgtt

SEQ ID NO: 13316 - DNA, 20 bp, Artificial
  CRISPR gRNA sequence
tgaatccctgtttagcttct

SEQ ID NO: 13317 - DNA, 20 bp, Artificial
  CRISPR gRNA sequence
gaatccctgtttagcttctt

SEQ ID NO: 13318 - DNA, 20 bp, Artificial
  CRISPR gRNA sequence
tgtttagcttcttaggaact

SEQ ID NO: 13319 - DNA, 20 bp, Artificial
  CRISPR gRNA sequence
ttcttaggaactaagcccct

SEQ ID NO: 13320 - DNA, 20 bp, Artificial
  CRISPR gRNA sequence
tcttaggaactaagcccctg

SEQ ID NO: 13321 - DNA, 20 bp, Artificial
  CRISPR gRNA sequence
ggaactaagcccctgaggct

SEQ ID NO: 13322 - DNA, 20 bp, Artificial
  CRISPR gRNA sequence
cttccttaacctccactgta

SEQ ID NO: 13323 - DNA, 20 bp, Artificial
  CRISPR gRNA sequence
ccttaacctccactgtaaag

SEQ ID NO: 13324 - DNA, 20 bp, Artificial
  CRISPR gRNA sequence
cttaacctccactgtaaagt

SEQ ID NO: 13325 - DNA, 20 bp, Artificial
  CRISPR gRNA sequence
tatgctccccaatccctccc

SEQ ID NO: 13326 - DNA, 20 bp, Artificial
  CRISPR gRNA sequence
ccctccccagctgaattgct

SEQ ID NO: 13327 - DNA, 20 bp, Artificial
  CRISPR gRNA sequence
ctccccagctgaattgctga

SEQ ID NO: 13328 - DNA, 20 bp, Artificial
  CRISPR gRNA sequence
cccagctgaattgctgagag

SEQ ID NO: 13329 - DNA, 20 bp, Artificial
  CRISPR gRNA sequence
aattgctgagagcagcaaat

SEQ ID NO: 13330 - DNA, 20 bp, Artificial
  CRISPR gRNA sequence
attgctgagagcagcaaatg

SEQ ID NO: 13331 - DNA, 20 bp, Artificial
  CRISPR gRNA sequence
agagcagcaaatgaggttgt

SEQ ID NO: 13332 - DNA, 20 bp, Artificial
  CRISPR gRNA sequence
gagcagcaaatgaggttgtg

SEQ ID NO: 13333 - DNA, 20 bp, Artificial
  CRISPR gRNA sequence
agcaaatgaggttgtgagga

SEQ ID NO: 13334 - DNA, 20 bp, Artificial
  CRISPR gRNA sequence
gcaaatgaggttgtgaggaa

SEQ ID NO: 13335 - DNA, 20 bp, Artificial
  CRISPR gRNA sequence
aaatgaggttgtgaggaaag

SEQ ID NO: 13336 - DNA, 20 bp, Artificial
  CRISPR gRNA sequence
ttgtgaggaaaggagtttca

SEQ ID NO: 13337 - DNA, 20 bp, Artificial
  CRISPR gRNA sequence
tgtgaggaaaggagtttcaa

SEQ ID NO: 13338 - DNA, 20 bp, Artificial
  CRISPR gRNA sequence
aggagtttcaaaggtcacga

SEQ ID NO: 13339 - DNA, 20 bp, Artificial
  CRISPR gRNA sequence
ggagtttcaaaggtcacgaa

SEQ ID NO: 13340 - DNA, 20 bp, Artificial
  CRISPR gRNA sequence
tctacaactttttttgtcac

SEQ ID NO: 13341 - DNA, 20 bp, Artificial
  CRISPR gRNA sequence
ctacaactttttttgtcact

SEQ ID NO: 13342 - DNA, 20 bp, Artificial
  CRISPR gRNA sequence
tacaactttttttgtcactg

SEQ ID NO: 13343 - DNA, 20 bp, Artificial
  CRISPR gRNA sequence
ctggggattcccatctgatg

SEQ ID NO: 13344 - DNA, 20 bp, Artificial
  CRISPR gRNA sequence
tcatctcatcactcatgtgc

SEQ ID NO: 13345 - DNA, 20 bp, Artificial
  CRISPR gRNA sequence
actcatgtgccagccacatt

SEQ ID NO: 13346 - DNA, 20 bp, Artificial
  CRISPR gRNA sequence
ctcatgtgccagccacattg

SEQ ID NO: 13347 - DNA, 20 bp, Artificial
  CRISPR gRNA sequence
tgccagccacattgaggatg

SEQ ID NO: 13348 - DNA, 20 bp, Artificial
  CRISPR gRNA sequence
cagccacattgaggatgcag

SEQ ID NO: 13349 - DNA, 20 bp, Artificial
  CRISPR gRNA sequence
agccacattgaggatgcagt

SEQ ID NO: 13350 - DNA, 20 bp, Artificial
  CRISPR gRNA sequence
cacattgaggatgcagtagg

SEQ ID NO: 13351 - DNA, 20 bp, Artificial
  CRISPR gRNA sequence
attgaggatgcagtaggcgg

SEQ ID NO: 13352 - DNA, 20 bp, Artificial
  CRISPR gRNA sequence
tgaggatgcagtaggcggaa

SEQ ID NO: 13353 - DNA, 20 bp, Artificial
  CRISPR gRNA sequence
aggatgcagtaggcggaaga

SEQ ID NO: 13354 - DNA, 20 bp, Artificial
  CRISPR gRNA sequence
gtaggcggaagagagaaaaa

SEQ ID NO: 13355 - DNA, 20 bp, Artificial
  CRISPR gRNA sequence
taggcggaagagagaaaaaa

SEQ ID NO: 13356 - DNA, 20 bp, Artificial
  CRISPR gRNA sequence
aggcggaagagagaaaaaaa

SEQ ID NO: 13357 - DNA, 20 bp, Artificial
  CRISPR gRNA sequence
aagagagaaaaaaagggaca

SEQ ID NO: 13358 - DNA, 20 bp, Artificial
  CRISPR gRNA sequence
gagaaaaaaagggacaaagt

SEQ ID NO: 13359 - DNA, 20 bp, Artificial
  CRISPR gRNA sequence
agaaaaaaagggacaaagtg

SEQ ID NO: 13360 - DNA, 20 bp, Artificial
  CRISPR gRNA sequence
gaaaaaaagggacaaagtga

SEQ ID NO: 13361 - DNA, 20 bp, Artificial
  CRISPR gRNA sequence
agtgagggcttttctttctg

SEQ ID NO: 13362 - DNA, 20 bp, Artificial
  CRISPR gRNA sequence
gtgagggcttttctttctgc

SEQ ID NO: 13363 - DNA, 20 bp, Artificial
  CRISPR gRNA sequence
ttttctttctgcaggtgcct

SEQ ID NO: 13364 - DNA, 20 bp, Artificial
  CRISPR gRNA sequence
tttctttctgcaggtgcctt

SEQ ID NO: 13365 - DNA, 20 bp, Artificial
  CRISPR gRNA sequence
ttctttctgcaggtgccttg

SEQ ID NO: 13366 - DNA, 20 bp, Artificial
  CRISPR gRNA sequence
tctttctgcaggtgccttgg

SEQ ID NO: 13367 - DNA, 20 bp, Artificial
  CRISPR gRNA sequence
ttctgcaggtgccttggggg

SEQ ID NO: 13368 - DNA, 20 bp, Artificial
  CRISPR gRNA sequence
tctgcaggtgccttgggggc

SEQ ID NO: 13369 - DNA, 20 bp, Artificial
  CRISPR gRNA sequence
ggtgccttgggggcaggatt

SEQ ID NO: 13370 - DNA, 20 bp, Artificial
  CRISPR gRNA sequence
gtgccttgggggcaggattt

SEQ ID NO: 13371 - DNA, 20 bp, Artificial
  CRISPR gRNA sequence
tgccttgggggcaggatttg

SEQ ID NO: 13372 - DNA, 20 bp, Artificial
  CRISPR gRNA sequence
gatttggggttgtcaaaacc

SEQ ID NO: 13373 - DNA, 20 bp, Artificial
  CRISPR gRNA sequence
tttggggttgtcaaaaccca

SEQ ID NO: 13374 - DNA, 20 bp, Artificial
  CRISPR gRNA sequence
ttggggttgtcaaaacccag

SEQ ID NO: 13375 - DNA, 20 bp, Artificial
  CRISPR gRNA sequence
tgtcaaaacccagaggttgc

SEQ ID NO: 13376 - DNA, 20 bp, Artificial
  CRISPR gRNA sequence
gtcaaaacccagaggttgct

SEQ ID NO: 13377 - DNA, 20 bp, Artificial
  CRISPR gRNA sequence
ccagaggttgctgggcactg

SEQ ID NO: 13378 - DNA, 20 bp, Artificial
  CRISPR gRNA sequence
ggcactgtagcatgcacctg

SEQ ID NO: 13379 - DNA, 20 bp, Artificial
  CRISPR gRNA sequence
gtagcatgcacctgtggtcc

SEQ ID NO: 13380 - DNA, 20 bp, Artificial
  CRISPR gRNA sequence
cacctgtggtcccagctact

SEQ ID NO: 13381 - DNA, 20 bp, Artificial
  CRISPR gRNA sequence
acctgtggtcccagctactc

SEQ ID NO: 13382 - DNA, 20 bp, Artificial
  CRISPR gRNA sequence
ctgtggtcccagctactcag

SEQ ID NO: 13383 - DNA, 20 bp, Artificial
  CRISPR gRNA sequence
tgtggtcccagctactcagg

SEQ ID NO: 13384 - DNA, 20 bp, Artificial
  CRISPR gRNA sequence
tcccagctactcaggaggct

SEQ ID NO: 13385 - DNA, 20 bp, Artificial
  CRISPR gRNA sequence
cccagctactcaggaggctg

SEQ ID NO: 13386 - DNA, 20 bp, Artificial
  CRISPR gRNA sequence
agctactcaggaggctgagg

SEQ ID NO: 13387 - DNA, 20 bp, Artificial
  CRISPR gRNA sequence
gctactcaggaggctgaggc

SEQ ID NO: 13388 - DNA, 20 bp, Artificial
  CRISPR gRNA sequence
tactcaggaggctgaggcag

SEQ ID NO: 13389 - DNA, 20 bp, Artificial
  CRISPR gRNA sequence
actcaggaggctgaggcagg

SEQ ID NO: 13390 - DNA, 20 bp, Artificial
  CRISPR gRNA sequence
ctgaggcaggaggactactt

SEQ ID NO: 13391 - DNA, 20 bp, Artificial
  CRISPR gRNA sequence
tgaggcaggaggactacttg

SEQ ID NO: 13392 - DNA, 20 bp, Artificial
  CRISPR gRNA sequence
gcaggaggactacttgaggc

SEQ ID NO: 13393 - DNA, 20 bp, Artificial
  CRISPR gRNA sequence
caggaggactacttgaggcc

SEQ ID NO: 13394 - DNA, 20 bp, Artificial
  CRISPR gRNA sequence
ctacttgaggccaggaattc

SEQ ID NO: 13395 - DNA, 20 bp, Artificial
  CRISPR gRNA sequence
tacttgaggccaggaattcg

SEQ ID NO: 13396 - DNA, 20 bp, Artificial
  CRISPR gRNA sequence
aggccaggaattcgaggctg

SEQ ID NO: 13397 - DNA, 20 bp, Artificial
  CRISPR gRNA sequence
caggaattcgaggctgcagt

SEQ ID NO: 13398 - DNA, 20 bp, Artificial
  CRISPR gRNA sequence
gctgcagtgagctatgatca

SEQ ID NO: 13399 - DNA, 20 bp, Artificial
  CRISPR gRNA sequence
tatgatcacagcactgcacc

SEQ ID NO: 13400 - DNA, 20 bp, Artificial
  CRISPR gRNA sequence
cagcactgcacccagatgtt

SEQ ID NO: 13401 - DNA, 20 bp, Artificial
  CRISPR gRNA sequence
gcactgcacccagatgttga

SEQ ID NO: 13402 - DNA, 20 bp, Artificial
  CRISPR gRNA sequence
cactgcacccagatgttgag

SEQ ID NO: 13403 - DNA, 20 bp, Artificial
  CRISPR gRNA sequence
tgcacccagatgttgagagg

SEQ ID NO: 13404 - DNA, 20 bp, Artificial
  CRISPR gRNA sequence
gcacccagatgttgagagga

SEQ ID NO: 13405 - DNA, 20 bp, Artificial
  CRISPR gRNA sequence
cacccagatgttgagaggaa

SEQ ID NO: 13406 - DNA, 20 bp, Artificial
  CRISPR gRNA sequence
acccagatgttgagaggaag

SEQ ID NO: 13407 - DNA, 20 bp, Artificial
  CRISPR gRNA sequence
atgttgagaggaaggggtcc

SEQ ID NO: 13408 - DNA, 20 bp, Artificial
  CRISPR gRNA sequence
gttgagaggaaggggtccca

SEQ ID NO: 13409 - DNA, 20 bp, Artificial
  CRISPR gRNA sequence
cccagagtctatactcactc

SEQ ID NO: 13410 - DNA, 20 bp, Artificial
  CRISPR gRNA sequence
tatactcactccagatgctg

SEQ ID NO: 13411 - DNA, 20 bp, Artificial
  CRISPR gRNA sequence
atactcactccagatgctgc

SEQ ID NO: 13412 - DNA, 20 bp, Artificial
  CRISPR gRNA sequence
tactcactccagatgctgca

SEQ ID NO: 13413 - DNA, 20 bp, Artificial
  CRISPR gRNA sequence
ctcactccagatgctgcagg

SEQ ID NO: 13414 - DNA, 20 bp, Artificial
  CRISPR gRNA sequence
tcactccagatgctgcaggg

SEQ ID NO: 13415 - DNA, 20 bp, Artificial
  CRISPR gRNA sequence
ccagatgctgcagggaggaa

SEQ ID NO: 13416 - DNA, 20 bp, Artificial
  CRISPR gRNA sequence
cagatgctgcagggaggaaa

SEQ ID NO: 13417 - DNA, 20 bp, Artificial
  CRISPR gRNA sequence
tgcagggaggaaaaggccgt

SEQ ID NO: 13418 - DNA, 20 bp, Artificial
  CRISPR gRNA sequence
gcagggaggaaaaggccgtg

SEQ ID NO: 13419 - DNA, 20 bp, Artificial
  CRISPR gRNA sequence
aaggccgtgaggatccgcac

SEQ ID NO: 13420 - DNA, 20 bp, Artificial
  CRISPR gRNA sequence
cgtgaggatccgcaccagtt

SEQ ID NO: 13421 - DNA, 20 bp, Artificial
  CRISPR gRNA sequence
gtgaggatccgcaccagttt

SEQ ID NO: 13422 - DNA, 20 bp, Artificial
  CRISPR gRNA sequence
tgaggatccgcaccagtttg

SEQ ID NO: 13423 - DNA, 20 bp, Artificial
  CRISPR gRNA sequence
gatccgcaccagtttgggga

SEQ ID NO: 13424 - DNA, 20 bp, Artificial
  CRISPR gRNA sequence
gcaccagtttggggaaagcc

SEQ ID NO: 13425 - DNA, 20 bp, Artificial
  CRISPR gRNA sequence
caccagtttggggaaagcct

SEQ ID NO: 13426 - DNA, 20 bp, Artificial
  CRISPR gRNA sequence
accagtttggggaaagcctg

SEQ ID NO: 13427 - DNA, 20 bp, Artificial
  CRISPR gRNA sequence
ccagtttggggaaagcctgg

SEQ ID NO: 13428 - DNA, 20 bp, Artificial
  CRISPR gRNA sequence
tggggaaagcctgggggcct

SEQ ID NO: 13429 - DNA, 20 bp, Artificial
  CRISPR gRNA sequence
gaaagcctgggggcctgaga

SEQ ID NO: 13430 - DNA, 20 bp, Artificial
  CRISPR gRNA sequence
aaagcctgggggcctgagac

SEQ ID NO: 13431 - DNA, 20 bp, Artificial
  CRISPR gRNA sequence
aagcctgggggcctgagaca

SEQ ID NO: 13432 - DNA, 20 bp, Artificial
  CRISPR gRNA sequence
tgggggcctgagacagggcc

SEQ ID NO: 13433 - DNA, 20 bp, Artificial
  CRISPR gRNA sequence
gcctgagacagggcccagcc

SEQ ID NO: 13434 - DNA, 20 bp, Artificial
  CRISPR gRNA sequence
cctgagacagggcccagcct

SEQ ID NO: 13435 - DNA, 20 bp, Artificial
  CRISPR gRNA sequence
tgagacagggcccagcctag

SEQ ID NO: 13436 - DNA, 20 bp, Artificial
  CRISPR gRNA sequence
gagacagggcccagcctagg

SEQ ID NO: 13437 - DNA, 20 bp, Artificial
  CRISPR gRNA sequence
agggcccagcctaggaggca

SEQ ID NO: 13438 - DNA, 20 bp, Artificial
  CRISPR gRNA sequence
ggcccagcctaggaggcaaa

SEQ ID NO: 13439 - DNA, 20 bp, Artificial
  CRISPR gRNA sequence
cagcctaggaggcaaagagc

SEQ ID NO: 13440 - DNA, 20 bp, Artificial
  CRISPR gRNA sequence
agcctaggaggcaaagagca

SEQ ID NO: 13441 - DNA, 20 bp, Artificial
  CRISPR gRNA sequence
gcctaggaggcaaagagcaa

SEQ ID NO: 13442 - DNA, 20 bp, Artificial
  CRISPR gRNA sequence
aggaggcaaagagcaagggt

SEQ ID NO: 13443 - DNA, 20 bp, Artificial
  CRISPR gRNA sequence
aagagcaagggtaagacctc

SEQ ID NO: 13444 - DNA, 20 bp, Artificial
  CRISPR gRNA sequence
aagggtaagacctccagtca

SEQ ID NO: 13445 - DNA, 20 bp, Artificial
  CRISPR gRNA sequence
aagacctccagtcacagtca

SEQ ID NO: 13446 - DNA, 20 bp, Artificial
  CRISPR gRNA sequence
cacagtcacagcccctcatt

SEQ ID NO: 13447 - DNA, 20 bp, Artificial
  CRISPR gRNA sequence
cacagcccctcattcagccc

SEQ ID NO: 13448 - DNA, 20 bp, Artificial
  CRISPR gRNA sequence
acagcccctcattcagcccc

SEQ ID NO: 13449 - DNA, 20 bp, Artificial
  CRISPR gRNA sequence
cagcccctcattcagcccca

SEQ ID NO: 13450 - DNA, 20 bp, Artificial
  CRISPR gRNA sequence
cccctcattcagccccaggg

SEQ ID NO: 13451 - DNA, 20 bp, Artificial
  CRISPR gRNA sequence
ccctcattcagccccagggt

SEQ ID NO: 13452 - DNA, 20 bp, Artificial
  CRISPR gRNA sequence
cctcattcagccccagggtg

SEQ ID NO: 13453 - DNA, 20 bp, Artificial
  CRISPR gRNA sequence
cattcagccccagggtgggg

SEQ ID NO: 13454 - DNA, 20 bp, Artificial
  CRISPR gRNA sequence
ttcagccccagggtggggca

SEQ ID NO: 13455 - DNA, 20 bp, Artificial
  CRISPR gRNA sequence
ccccagggtggggcagagac

SEQ ID NO: 13456 - DNA, 20 bp, Artificial
  CRISPR gRNA sequence
cccagggtggggcagagaca

SEQ ID NO: 13457 - DNA, 20 bp, Artificial
  CRISPR gRNA sequence
ggtggggcagagacaaggca

SEQ ID NO: 13458 - DNA, 20 bp, Artificial
  CRISPR gRNA sequence
ggggcagagacaaggcacag

SEQ ID NO: 13459 - DNA, 20 bp, Artificial
  CRISPR gRNA sequence
cagagacaaggcacagaagt

SEQ ID NO: 13460 - DNA, 20 bp, Artificial
  CRISPR gRNA sequence
agagacaaggcacagaagtc

SEQ ID NO: 13461 - DNA, 20 bp, Artificial
  CRISPR gRNA sequence
acagaagtcaggtcctgtct

SEQ ID NO: 13462 - DNA, 20 bp, Artificial
  CRISPR gRNA sequence
cagaagtcaggtcctgtctg

SEQ ID NO: 13463 - DNA, 20 bp, Artificial
  CRISPR gRNA sequence
cctcctcttcccttccaccc

SEQ ID NO: 13464 - DNA, 20 bp, Artificial
  CRISPR gRNA sequence
tcccttccaccccagcctct

SEQ ID NO: 13465 - DNA, 20 bp, Artificial
  CRISPR gRNA sequence
cccttccaccccagcctctt

SEQ ID NO: 13466 - DNA, 20 bp, Artificial
  CRISPR gRNA sequence
gtccctgcaacccttccacg

SEQ ID NO: 13467 - DNA, 20 bp, Artificial
  CRISPR gRNA sequence
tccctgcaacccttccacgt

SEQ ID NO: 13468 - DNA, 20 bp, Artificial
  CRISPR gRNA sequence
ggaccccaatcttttctgct

SEQ ID NO: 13469 - DNA, 20 bp, Artificial
  CRISPR gRNA sequence
gaccccaatcttttctgctt

SEQ ID NO: 13470 - DNA, 20 bp, Artificial
  CRISPR gRNA sequence
accccaatcttttctgcttg

SEQ ID NO: 13471 - DNA, 20 bp, Artificial
  CRISPR gRNA sequence
ccaatcttttctgcttgggg

SEQ ID NO: 13472 - DNA, 20 bp, Artificial
  CRISPR gRNA sequence
tctgcttggggtagatttca

SEQ ID NO: 13473 - DNA, 20 bp, Artificial
  CRISPR gRNA sequence
tagatttcatagccccccat

SEQ ID NO: 13474 - DNA, 20 bp, Artificial
  CRISPR gRNA sequence
gatttcatagccccccataa

SEQ ID NO: 13475 - DNA, 20 bp, Artificial
  CRISPR gRNA sequence
atttcatagccccccataag

SEQ ID NO: 13476 - DNA, 20 bp, Artificial
  CRISPR gRNA sequence
catagccccccataagaggc

SEQ ID NO: 13477 - DNA, 20 bp, Artificial
  CRISPR gRNA sequence
ccccccataagaggccagtt

SEQ ID NO: 13478 - DNA, 20 bp, Artificial
  CRISPR gRNA sequence
cccccataagaggccagttg

SEQ ID NO: 13479 - DNA, 20 bp, Artificial
  CRISPR gRNA sequence
cataagaggccagttgaggc

SEQ ID NO: 13480 - DNA, 20 bp, Artificial
  CRISPR gRNA sequence
ataagaggccagttgaggct

SEQ ID NO: 13481 - DNA, 20 bp, Artificial
  CRISPR gRNA sequence
aggccagttgaggctgggaa

SEQ ID NO: 13482 - DNA, 20 bp, Artificial
  CRISPR gRNA sequence
ccagttgaggctgggaacag

SEQ ID NO: 13483 - DNA, 20 bp, Artificial
  CRISPR gRNA sequence
gtggctcatgtctgtaattc

SEQ ID NO: 13484 - DNA, 20 bp, Artificial
  CRISPR gRNA sequence
tgtctgtaattccagcattt

SEQ ID NO: 13485 - DNA, 20 bp, Artificial
  CRISPR gRNA sequence
gtctgtaattccagcatttt

SEQ ID NO: 13486 - DNA, 20 bp, Artificial
  CRISPR gRNA sequence
ctgtaattccagcattttgg

SEQ ID NO: 13487 - DNA, 20 bp, Artificial
  CRISPR gRNA sequence
tgtaattccagcattttggg

SEQ ID NO: 13488 - DNA, 20 bp, Artificial
  CRISPR gRNA sequence
ttccagcattttgggaggcc

SEQ ID NO: 13489 - DNA, 20 bp, Artificial
  CRISPR gRNA sequence
tccagcattttgggaggcca

SEQ ID NO: 13490 - DNA, 20 bp, Artificial
  CRISPR gRNA sequence
gcattttgggaggccaaggt

SEQ ID NO: 13491 - DNA, 20 bp, Artificial
  CRISPR gRNA sequence
attttgggaggccaaggtaa

SEQ ID NO: 13492 - DNA, 20 bp, Artificial
  CRISPR gRNA sequence
ttttgggaggccaaggtaag

SEQ ID NO: 13493 - DNA, 20 bp, Artificial
  CRISPR gRNA sequence
ccaaggtaagaggactgctt

SEQ ID NO: 13494 - DNA, 20 bp, Artificial
  CRISPR gRNA sequence
gtaagaggactgcttgagcc

SEQ ID NO: 13495 - DNA, 20 bp, Artificial
  CRISPR gRNA sequence
taagaggactgcttgagccc

SEQ ID NO: 13496 - DNA, 20 bp, Artificial
  CRISPR gRNA sequence
agaggactgcttgagcccag

SEQ ID NO: 13497 - DNA, 20 bp, Artificial
  CRISPR gRNA sequence
ctgcttgagcccaggagttc

SEQ ID NO: 13498 - DNA, 20 bp, Artificial
  CRISPR gRNA sequence
tgagcccaggagttcaagac

SEQ ID NO: 13499 - DNA, 20 bp, Artificial
  CRISPR gRNA sequence
ccaggagttcaagaccagct

SEQ ID NO: 13500 - DNA, 20 bp, Artificial
  CRISPR gRNA sequence
caggagttcaagaccagctt

SEQ ID NO: 13501 - DNA, 20 bp, Artificial
  CRISPR gRNA sequence
caagaccagcttgggcaaca

SEQ ID NO: 13502 - DNA, 20 bp, Artificial
  CRISPR gRNA sequence
accagcttgggcaacatagt

SEQ ID NO: 13503 - DNA, 20 bp, Artificial
  CRISPR gRNA sequence
ttgggcaacatagtgagact

SEQ ID NO: 13504 - DNA, 20 bp, Artificial
  CRISPR gRNA sequence
tctacaaaaaacacaataat

SEQ ID NO: 13505 - DNA, 20 bp, Artificial
  CRISPR gRNA sequence
aaaaaacacaataattagcc

SEQ ID NO: 13506 - DNA, 20 bp, Artificial
  CRISPR gRNA sequence
acacaataattagccaagtg

SEQ ID NO: 13507 - DNA, 20 bp, Artificial
  CRISPR gRNA sequence
caataattagccaagtgtgg

SEQ ID NO: 13508 - DNA, 20 bp, Artificial
  CRISPR gRNA sequence
aagtgtggtggtgtgtcctg

SEQ ID NO: 13509 - DNA, 20 bp, Artificial
  CRISPR gRNA sequence
ggtggtgtgtcctgtggtct

SEQ ID NO: 13510 - DNA, 20 bp, Artificial
  CRISPR gRNA sequence
gtcctgtggtctcagcttct

SEQ ID NO: 13511 - DNA, 20 bp, Artificial
  CRISPR gRNA sequence
tcctgtggtctcagcttctt

SEQ ID NO: 13512 - DNA, 20 bp, Artificial
  CRISPR gRNA sequence
ctgtggtctcagcttcttag

SEQ ID NO: 13513 - DNA, 20 bp, Artificial
  CRISPR gRNA sequence
tgtggtctcagcttcttagg

SEQ ID NO: 13514 - DNA, 20 bp, Artificial
  CRISPR gRNA sequence
tctcagcttcttaggaggct

SEQ ID NO: 13515 - DNA, 20 bp, Artificial
  CRISPR gRNA sequence
ctcagcttcttaggaggctg

SEQ ID NO: 13516 - DNA, 20 bp, Artificial
  CRISPR gRNA sequence
agcttcttaggaggctgagg

SEQ ID NO: 13517 - DNA, 20 bp, Artificial
  CRISPR gRNA sequence
ttcttaggaggctgaggtgg

SEQ ID NO: 13518 - DNA, 20 bp, Artificial
  CRISPR gRNA sequence
ctgaggtggaagcatcgctt

SEQ ID NO: 13519 - DNA, 20 bp, Artificial
  CRISPR gRNA sequence
gtggaagcatcgcttgagcc

SEQ ID NO: 13520 - DNA, 20 bp, Artificial
  CRISPR gRNA sequence
tggaagcatcgcttgagccc

SEQ ID NO: 13521 - DNA, 20 bp, Artificial
  CRISPR gRNA sequence
gaagcatcgcttgagcccag

SEQ ID NO: 13522 - DNA, 20 bp, Artificial
  CRISPR gRNA sequence
aagcatcgcttgagcccagg

SEQ ID NO: 13523 - DNA, 20 bp, Artificial
  CRISPR gRNA sequence
catcgcttgagcccaggagg

SEQ ID NO: 13524 - DNA, 20 bp, Artificial
  CRISPR gRNA sequence
tcgcttgagcccaggaggtg

SEQ ID NO: 13525 - DNA, 20 bp, Artificial
  CRISPR gRNA sequence
cgcttgagcccaggaggtgg

SEQ ID NO: 13526 - DNA, 20 bp, Artificial
  CRISPR gRNA sequence
agcccaggaggtggaggatg

SEQ ID NO: 13527 - DNA, 20 bp, Artificial
  CRISPR gRNA sequence
caggaggtggaggatgcagt

SEQ ID NO: 13528 - DNA, 20 bp, Artificial
  CRISPR gRNA sequence
atgatcacaccactgcactc

SEQ ID NO: 13529 - DNA, 20 bp, Artificial
  CRISPR gRNA sequence
cacaccactgcactccagcc

SEQ ID NO: 13530 - DNA, 20 bp, Artificial
  CRISPR gRNA sequence
acaccactgcactccagcct

SEQ ID NO: 13531 - DNA, 20 bp, Artificial
  CRISPR gRNA sequence
cactgcactccagcctgggt

SEQ ID NO: 13532 - DNA, 20 bp, Artificial
  CRISPR gRNA sequence
ctgcactccagcctgggtaa

SEQ ID NO: 13533 - DNA, 20 bp, Artificial
  CRISPR gRNA sequence
actccagcctgggtaagagc

SEQ ID NO: 13534 - DNA, 20 bp, Artificial
  CRISPR gRNA sequence
agcgagaccctgtctcaaaa

SEQ ID NO: 13535 - DNA, 20 bp, Artificial
  CRISPR gRNA sequence
aaaaagaaaaaaaacaaaaa

SEQ ID NO: 13536 - DNA, 20 bp, Artificial
  CRISPR gRNA sequence
gaaaaaaaacaaaaaaagaa

SEQ ID NO: 13537 - DNA, 20 bp, Artificial
  CRISPR gRNA sequence
aaacaaaaaaagaaaagaaa

SEQ ID NO: 13538 - DNA, 20 bp, Artificial
  CRISPR gRNA sequence
acaaaaaaagaaaagaaaaa

SEQ ID NO: 13539 - DNA, 20 bp, Artificial
  CRISPR gRNA sequence
caaaaaaagaaaagaaaaag

SEQ ID NO: 13540 - DNA, 20 bp, Artificial
  CRISPR gRNA sequence
aaaagaaaagaaaaagaggt

SEQ ID NO: 13541 - DNA, 20 bp, Artificial
  CRISPR gRNA sequence
gaaaagaaaaagaggtaagt

SEQ ID NO: 13542 - DNA, 20 bp, Artificial
  CRISPR gRNA sequence
aaaagaaaaagaggtaagtt

SEQ ID NO: 13543 - DNA, 20 bp, Artificial
  CRISPR gRNA sequence
ggtaagttgggctcccatct

SEQ ID NO: 13544 - DNA, 20 bp, Artificial
  CRISPR gRNA sequence
gtaagttgggctcccatctt

SEQ ID NO: 13545 - DNA, 20 bp, Artificial
  CRISPR gRNA sequence
taagttgggctcccatcttg

SEQ ID NO: 13546 - DNA, 20 bp, Artificial
  CRISPR gRNA sequence
gctcccatcttggggctccc

SEQ ID NO: 13547 - DNA, 20 bp, Artificial
  CRISPR gRNA sequence
gctccccagcttttgtctct

SEQ ID NO: 13548 - DNA, 20 bp, Artificial
  CRISPR gRNA sequence
ccccagcttttgtctctaag

SEQ ID NO: 13549 - DNA, 20 bp, Artificial
  CRISPR gRNA sequence
cccagcttttgtctctaagt

SEQ ID NO: 13550 - DNA, 20 bp, Artificial
  CRISPR gRNA sequence
ccagcttttgtctctaagta

SEQ ID NO: 13551 - DNA, 20 bp, Artificial
  CRISPR gRNA sequence
agcttttgtctctaagtagg

SEQ ID NO: 13552 - DNA, 20 bp, Artificial
  CRISPR gRNA sequence
tttgtctctaagtagggagc

SEQ ID NO: 13553 - DNA, 20 bp, Artificial
  CRISPR gRNA sequence
cttactcttcccaacatcca

SEQ ID NO: 13554 - DNA, 20 bp, Artificial
  CRISPR gRNA sequence
cagatacccttctcccgccg

SEQ ID NO: 13555 - DNA, 20 bp, Artificial
  CRISPR gRNA sequence
acccttctcccgccgcagcc

SEQ ID NO: 13556 - DNA, 20 bp, Artificial
  CRISPR gRNA sequence
cccttctcccgccgcagcct

SEQ ID NO: 13557 - DNA, 20 bp, Artificial
  CRISPR gRNA sequence
ccttctcccgccgcagcctg

SEQ ID NO: 13558 - DNA, 20 bp, Artificial
  CRISPR gRNA sequence
tctcccgccgcagcctgggg

SEQ ID NO: 13559 - DNA, 20 bp, Artificial
  CRISPR gRNA sequence
ctcccgccgcagcctgggga

SEQ ID NO: 13560 - DNA, 20 bp, Artificial
  CRISPR gRNA sequence
tcccgccgcagcctggggaa

SEQ ID NO: 13561 - DNA, 20 bp, Artificial
  CRISPR gRNA sequence
cccgccgcagcctggggaag

SEQ ID NO: 13562 - DNA, 20 bp, Artificial
  CRISPR gRNA sequence
gggaaggggtcctgaaatgc

SEQ ID NO: 13563 - DNA, 20 bp, Artificial
  CRISPR gRNA sequence
tgccagctgacgaccactgc

SEQ ID NO: 13564 - DNA, 20 bp, Artificial
  CRISPR gRNA sequence
cagctgacgaccactgccag

SEQ ID NO: 13565 - DNA, 20 bp, Artificial
  CRISPR gRNA sequence
gaccactgccagtggtaaac

SEQ ID NO: 13566 - DNA, 20 bp, Artificial
  CRISPR gRNA sequence
accactgccagtggtaaacc

SEQ ID NO: 13567 - DNA, 20 bp, Artificial
  CRISPR gRNA sequence
actgccagtggtaaaccagg

SEQ ID NO: 13568 - DNA, 20 bp, Artificial
  CRISPR gRNA sequence
cctttgcattttaataacaa

SEQ ID NO: 13569 - DNA, 20 bp, Artificial
  CRISPR gRNA sequence
ctttgcattttaataacaaa

SEQ ID NO: 13570 - DNA, 20 bp, Artificial
  CRISPR gRNA sequence
aacaaaaggaaccatttgtt

SEQ ID NO: 13571 - DNA, 20 bp, Artificial
  CRISPR gRNA sequence
atttgttgagcatttattat

SEQ ID NO: 13572 - DNA, 20 bp, Artificial
  CRISPR gRNA sequence
gttgagcatttattataagc

SEQ ID NO: 13573 - DNA, 20 bp, Artificial
  CRISPR gRNA sequence
ttgagcatttattataagcc

SEQ ID NO: 13574 - DNA, 20 bp, Artificial
  CRISPR gRNA sequence
tgagcatttattataagcca

SEQ ID NO: 13575 - DNA, 20 bp, Artificial
  CRISPR gRNA sequence
gagcatttattataagccag

SEQ ID NO: 13576 - DNA, 20 bp, Artificial
  CRISPR gRNA sequence
attataagccaggggcatgc

SEQ ID NO: 13577 - DNA, 20 bp, Artificial
  CRISPR gRNA sequence
ttataagccaggggcatgct

SEQ ID NO: 13578 - DNA, 20 bp, Artificial
  CRISPR gRNA sequence
ggcatgctaggcccttccct

SEQ ID NO: 13579 - DNA, 20 bp, Artificial
  CRISPR gRNA sequence
gctaggcccttccctcggcc

SEQ ID NO: 13580 - DNA, 20 bp, Artificial
  CRISPR gRNA sequence
ctagatctcatttactcctc

SEQ ID NO: 13581 - DNA, 20 bp, Artificial
  CRISPR gRNA sequence
catttactcctcaagactct

SEQ ID NO: 13582 - DNA, 20 bp, Artificial
  CRISPR gRNA sequence
ctcctcaagactctgagcta

SEQ ID NO: 13583 - DNA, 20 bp, Artificial
  CRISPR gRNA sequence
tcctcaagactctgagctat

SEQ ID NO: 13584 - DNA, 20 bp, Artificial
  CRISPR gRNA sequence
tcttatctccattttacata

SEQ ID NO: 13585 - DNA, 20 bp, Artificial
  CRISPR gRNA sequence
cttatctccattttacatat

SEQ ID NO: 13586 - DNA, 20 bp, Artificial
  CRISPR gRNA sequence
ttatctccattttacatata

SEQ ID NO: 13587 - DNA, 20 bp, Artificial
  CRISPR gRNA sequence
attttacatatagggaaact

SEQ ID NO: 13588 - DNA, 20 bp, Artificial
  CRISPR gRNA sequence
ttttacatatagggaaactg

SEQ ID NO: 13589 - DNA, 20 bp, Artificial
  CRISPR gRNA sequence
atatagggaaactgaggcac

SEQ ID NO: 13590 - DNA, 20 bp, Artificial
  CRISPR gRNA sequence
tatagggaaactgaggcact

SEQ ID NO: 13591 - DNA, 20 bp, Artificial
  CRISPR gRNA sequence
tgaggcactaggcgatcaaa

SEQ ID NO: 13592 - DNA, 20 bp, Artificial
  CRISPR gRNA sequence
aggcgatcaaatagctcaca

SEQ ID NO: 13593 - DNA, 20 bp, Artificial
  CRISPR gRNA sequence
ggcgatcaaatagctcacac

SEQ ID NO: 13594 - DNA, 20 bp, Artificial
  CRISPR gRNA sequence
gcgatcaaatagctcacaca

SEQ ID NO: 13595 - DNA, 20 bp, Artificial
  CRISPR gRNA sequence
atagctcacacagggtcaca

SEQ ID NO: 13596 - DNA, 20 bp, Artificial
  CRISPR gRNA sequence
tcacacagggtcacacagcc

SEQ ID NO: 13597 - DNA, 20 bp, Artificial
  CRISPR gRNA sequence
acacagcctggatcaacatt

SEQ ID NO: 13598 - DNA, 20 bp, Artificial
  CRISPR gRNA sequence
acagcctggatcaacattta

SEQ ID NO: 13599 - DNA, 20 bp, Artificial
  CRISPR gRNA sequence
gcctggatcaacatttagag

SEQ ID NO: 13600 - DNA, 20 bp, Artificial
  CRISPR gRNA sequence
caacatttagagcagacttc

SEQ ID NO: 13601 - DNA, 20 bp, Artificial
  CRISPR gRNA sequence
aacatttagagcagacttca

SEQ ID NO: 13602 - DNA, 20 bp, Artificial
  CRISPR gRNA sequence
acatttagagcagacttcaa

SEQ ID NO: 13603 - DNA, 20 bp, Artificial
  CRISPR gRNA sequence
catttagagcagacttcaag

SEQ ID NO: 13604 - DNA, 20 bp, Artificial
  CRISPR gRNA sequence
agagcagacttcaaggggat

SEQ ID NO: 13605 - DNA, 20 bp, Artificial
  CRISPR gRNA sequence
ttcaaggggatgagaaaaat

SEQ ID NO: 13606 - DNA, 20 bp, Artificial
  CRISPR gRNA sequence
tcaaggggatgagaaaaata

SEQ ID NO: 13607 - DNA, 20 bp, Artificial
  CRISPR gRNA sequence
tgagaaaaataaggacaacg

SEQ ID NO: 13608 - DNA, 20 bp, Artificial
  CRISPR gRNA sequence
gagaaaaataaggacaacga

SEQ ID NO: 13609 - DNA, 20 bp, Artificial
  CRISPR gRNA sequence
agaaaaataaggacaacgaa

SEQ ID NO: 13610 - DNA, 20 bp, Artificial
  CRISPR gRNA sequence
aaggacaacgaagggccgtt

SEQ ID NO: 13611 - DNA, 20 bp, Artificial
  CRISPR gRNA sequence
ggccgtttagtttaaaaata

SEQ ID NO: 13612 - DNA, 20 bp, Artificial
  CRISPR gRNA sequence
ggttaaatgcattccatata

SEQ ID NO: 13613 - DNA, 20 bp, Artificial
  CRISPR gRNA sequence
ttaaatgcattccatataaa

SEQ ID NO: 13614 - DNA, 20 bp, Artificial
  CRISPR gRNA sequence
cctttgaactttttcaatat

SEQ ID NO: 13615 - DNA, 20 bp, Artificial
  CRISPR gRNA sequence
atattagaatgatcattctt

SEQ ID NO: 13616 - DNA, 20 bp, Artificial
  CRISPR gRNA sequence
atcattctttggtaaaatta

SEQ ID NO: 13617 - DNA, 20 bp, Artificial
  CRISPR gRNA sequence
ctttggtaaaattatggtgc

SEQ ID NO: 13618 - DNA, 20 bp, Artificial
  CRISPR gRNA sequence
tggtaaaattatggtgccag

SEQ ID NO: 13619 - DNA, 20 bp, Artificial
  CRISPR gRNA sequence
taaaattatggtgccagcag

SEQ ID NO: 13620 - DNA, 20 bp, Artificial
  CRISPR gRNA sequence
aaaattatggtgccagcagt

SEQ ID NO: 13621 - DNA, 20 bp, Artificial
  CRISPR gRNA sequence
tgttatttgtttgtttgaat

SEQ ID NO: 13622 - DNA, 20 bp, Artificial
  CRISPR gRNA sequence
ccttgataaacattaaaaaa

SEQ ID NO: 13623 - DNA, 20 bp, Artificial
  CRISPR gRNA sequence
taaaaaacagtaaccgcgca

SEQ ID NO: 13624 - DNA, 20 bp, Artificial
  CRISPR gRNA sequence
aattcattccgaaatgttct

SEQ ID NO: 13625 - DNA, 20 bp, Artificial
  CRISPR gRNA sequence
tctcggcctctgaaatcctg

SEQ ID NO: 13626 - DNA, 20 bp, Artificial
  CRISPR gRNA sequence
cctctgaaatcctgaagtct

SEQ ID NO: 13627 - DNA, 20 bp, Artificial
  CRISPR gRNA sequence
atcctgaagtctgagaacac

SEQ ID NO: 13628 - DNA, 20 bp, Artificial
  CRISPR gRNA sequence
aagtctgagaacactggcct

SEQ ID NO: 13629 - DNA, 20 bp, Artificial
  CRISPR gRNA sequence
gagaacactggcctcagcaa

SEQ ID NO: 13630 - DNA, 20 bp, Artificial
  CRISPR gRNA sequence
agaacactggcctcagcaaa

SEQ ID NO: 13631 - DNA, 20 bp, Artificial
  CRISPR gRNA sequence
ctggcctcagcaaaaggcca

SEQ ID NO: 13632 - DNA, 20 bp, Artificial
  CRISPR gRNA sequence
tggcctcagcaaaaggccac

SEQ ID NO: 13633 - DNA, 20 bp, Artificial
  CRISPR gRNA sequence
tcagcaaaaggccacaggat

SEQ ID NO: 13634 - DNA, 20 bp, Artificial
  CRISPR gRNA sequence
agcaaaaggccacaggatca

SEQ ID NO: 13635 - DNA, 20 bp, Artificial
  CRISPR gRNA sequence
acaggatcagagtttgactc

SEQ ID NO: 13636 - DNA, 20 bp, Artificial
  CRISPR gRNA sequence
caggatcagagtttgactcc

SEQ ID NO: 13637 - DNA, 20 bp, Artificial
  CRISPR gRNA sequence
cagagtttgactccaggatc

SEQ ID NO: 13638 - DNA, 20 bp, Artificial
  CRISPR gRNA sequence
tgactccaggatctggcatt

SEQ ID NO: 13639 - DNA, 20 bp, Artificial
  CRISPR gRNA sequence
tggcatttggctccctgcta

SEQ ID NO: 13640 - DNA, 20 bp, Artificial
  CRISPR gRNA sequence
ggcatttggctccctgctaa

SEQ ID NO: 13641 - DNA, 20 bp, Artificial
  CRISPR gRNA sequence
tggctccctgctaaaggcct

SEQ ID NO: 13642 - DNA, 20 bp, Artificial
  CRISPR gRNA sequence
tggcaaatcccttcaccctt

SEQ ID NO: 13643 - DNA, 20 bp, Artificial
  CRISPR gRNA sequence
aatatttcaccccaatctta

SEQ ID NO: 13644 - DNA, 20 bp, Artificial
  CRISPR gRNA sequence
atatttcaccccaatcttat

SEQ ID NO: 13645 - DNA, 20 bp, Artificial
  CRISPR gRNA sequence
tatttcaccccaatcttatg

SEQ ID NO: 13646 - DNA, 20 bp, Artificial
  CRISPR gRNA sequence
atttcaccccaatcttatgg

SEQ ID NO: 13647 - DNA, 20 bp, Artificial
  CRISPR gRNA sequence
cccaatcttatgggggttct

SEQ ID NO: 13648 - DNA, 20 bp, Artificial
  CRISPR gRNA sequence
cttatgggggttcttggatt

SEQ ID NO: 13649 - DNA, 20 bp, Artificial
  CRISPR gRNA sequence
ttatgggggttcttggatta

SEQ ID NO: 13650 - DNA, 20 bp, Artificial
  CRISPR gRNA sequence
accgcttgcctactatgtgc

SEQ ID NO: 13651 - DNA, 20 bp, Artificial
  CRISPR gRNA sequence
ccgcttgcctactatgtgcc

SEQ ID NO: 13652 - DNA, 20 bp, Artificial
  CRISPR gRNA sequence
tgcctactatgtgccaggcc

SEQ ID NO: 13653 - DNA, 20 bp, Artificial
  CRISPR gRNA sequence
gcctactatgtgccaggccc

SEQ ID NO: 13654 - DNA, 20 bp, Artificial
  CRISPR gRNA sequence
cctactatgtgccaggccca

SEQ ID NO: 13655 - DNA, 20 bp, Artificial
  CRISPR gRNA sequence
tactatgtgccaggcccagg

SEQ ID NO: 13656 - DNA, 20 bp, Artificial
  CRISPR gRNA sequence
actatgtgccaggcccaggg

SEQ ID NO: 13657 - DNA, 20 bp, Artificial
  CRISPR gRNA sequence
tgtgccaggcccagggagga

SEQ ID NO: 13658 - DNA, 20 bp, Artificial
  CRISPR gRNA sequence
aggcccagggaggaaagttg

SEQ ID NO: 13659 - DNA, 20 bp, Artificial
  CRISPR gRNA sequence
ggcccagggaggaaagttgt

SEQ ID NO: 13660 - DNA, 20 bp, Artificial
  CRISPR gRNA sequence
gaggaaagttgtgggccaaa

SEQ ID NO: 13661 - DNA, 20 bp, Artificial
  CRISPR gRNA sequence
agacgaaaatccctgccttc

SEQ ID NO: 13662 - DNA, 20 bp, Artificial
  CRISPR gRNA sequence
gacgaaaatccctgccttct

SEQ ID NO: 13663 - DNA, 20 bp, Artificial
  CRISPR gRNA sequence
ccttctgggtgctgacattc

SEQ ID NO: 13664 - DNA, 20 bp, Artificial
  CRISPR gRNA sequence
cttctgggtgctgacattcc

SEQ ID NO: 13665 - DNA, 20 bp, Artificial
  CRISPR gRNA sequence
ttctgggtgctgacattcca

SEQ ID NO: 13666 - DNA, 20 bp, Artificial
  CRISPR gRNA sequence
tctgggtgctgacattccag

SEQ ID NO: 13667 - DNA, 20 bp, Artificial
  CRISPR gRNA sequence
ctgggtgctgacattccagg

SEQ ID NO: 13668 - DNA, 20 bp, Artificial
  CRISPR gRNA sequence
tgggtgctgacattccaggg

SEQ ID NO: 13669 - DNA, 20 bp, Artificial
  CRISPR gRNA sequence
gtgctgacattccagggggg

SEQ ID NO: 13670 - DNA, 20 bp, Artificial
  CRISPR gRNA sequence
tgacattccaggggggaaga

SEQ ID NO: 13671 - DNA, 20 bp, Artificial
  CRISPR gRNA sequence
attccaggggggaagataga

SEQ ID NO: 13672 - DNA, 20 bp, Artificial
  CRISPR gRNA sequence
ggaagatagacagataatca

SEQ ID NO: 13673 - DNA, 20 bp, Artificial
  CRISPR gRNA sequence
agacagataatcaaagaaat

SEQ ID NO: 13674 - DNA, 20 bp, Artificial
  CRISPR gRNA sequence
agataatcaaagaaatcgga

SEQ ID NO: 13675 - DNA, 20 bp, Artificial
  CRISPR gRNA sequence
aatcaaagaaatcggaaagc

SEQ ID NO: 13676 - DNA, 20 bp, Artificial
  CRISPR gRNA sequence
cggaaagcaagctgatgtct

SEQ ID NO: 13677 - DNA, 20 bp, Artificial
  CRISPR gRNA sequence
gtctgagacaatgaatcata

SEQ ID NO: 13678 - DNA, 20 bp, Artificial
  CRISPR gRNA sequence
atgaatcatatggaaatata

SEQ ID NO: 13679 - DNA, 20 bp, Artificial
  CRISPR gRNA sequence
aatcatatggaaatatacag

SEQ ID NO: 13680 - DNA, 20 bp, Artificial
  CRISPR gRNA sequence
atatggaaatatacagtggt

SEQ ID NO: 13681 - DNA, 20 bp, Artificial
  CRISPR gRNA sequence
tatggaaatatacagtggtg

SEQ ID NO: 13682 - DNA, 20 bp, Artificial
  CRISPR gRNA sequence
atggaaatatacagtggtga

SEQ ID NO: 13683 - DNA, 20 bp, Artificial
  CRISPR gRNA sequence
tggaaatatacagtggtgag

SEQ ID NO: 13684 - DNA, 20 bp, Artificial
  CRISPR gRNA sequence
ggaaatatacagtggtgagg

SEQ ID NO: 13685 - DNA, 20 bp, Artificial
  CRISPR gRNA sequence
atatacagtggtgaggggga

SEQ ID NO: 13686 - DNA, 20 bp, Artificial
  CRISPR gRNA sequence
atacagtggtgagggggatg

SEQ ID NO: 13687 - DNA, 20 bp, Artificial
  CRISPR gRNA sequence
ggagttttttttttaaccat

SEQ ID NO: 13688 - DNA, 20 bp, Artificial
  CRISPR gRNA sequence
gagttttttttttaaccatg

SEQ ID NO: 13689 - DNA, 20 bp, Artificial
  CRISPR gRNA sequence
agttttttttttaaccatga

SEQ ID NO: 13690 - DNA, 20 bp, Artificial
  CRISPR gRNA sequence
gttttttttttaaccatgag

SEQ ID NO: 13691 - DNA, 20 bp, Artificial
  CRISPR gRNA sequence
ttttttaaccatgaggggaa

SEQ ID NO: 13692 - DNA, 20 bp, Artificial
  CRISPR gRNA sequence
ttttaaccatgaggggaatg

SEQ ID NO: 13693 - DNA, 20 bp, Artificial
  CRISPR gRNA sequence
ttatttatttatttattttt

SEQ ID NO: 13694 - DNA, 20 bp, Artificial
  CRISPR gRNA sequence
ttatttatttatttttgaga

SEQ ID NO: 13695 - DNA, 20 bp, Artificial
  CRISPR gRNA sequence
tatttatttatttttgagat

SEQ ID NO: 13696 - DNA, 20 bp, Artificial
  CRISPR gRNA sequence
atttatttatttttgagatg

SEQ ID NO: 13697 - DNA, 20 bp, Artificial
  CRISPR gRNA sequence
ggggtctcactctgtcatcc

SEQ ID NO: 13698 - DNA, 20 bp, Artificial
  CRISPR gRNA sequence
tctcactctgtcatccaagc

SEQ ID NO: 13699 - DNA, 20 bp, Artificial
  CRISPR gRNA sequence
ctgtcatccaagctggactg

SEQ ID NO: 13700 - DNA, 20 bp, Artificial
  CRISPR gRNA sequence
tcatccaagctggactgcag

SEQ ID NO: 13701 - DNA, 20 bp, Artificial
  CRISPR gRNA sequence
ggactgcagtggcgtgatct

SEQ ID NO: 13702 - DNA, 20 bp, Artificial
  CRISPR gRNA sequence
tcaccgcaacctccgcctcc

SEQ ID NO: 13703 - DNA, 20 bp, Artificial
  CRISPR gRNA sequence
ttcaaatgattctcctgcct

SEQ ID NO: 13704 - DNA, 20 bp, Artificial
  CRISPR gRNA sequence
ttctcctgcctcagcctccc

SEQ ID NO: 13705 - DNA, 20 bp, Artificial
  CRISPR gRNA sequence
tcctgcctcagcctcccaag

SEQ ID NO: 13706 - DNA, 20 bp, Artificial
  CRISPR gRNA sequence
ctcccaagtagctgtgacta

SEQ ID NO: 13707 - DNA, 20 bp, Artificial
  CRISPR gRNA sequence
tcccaagtagctgtgactac

SEQ ID NO: 13708 - DNA, 20 bp, Artificial
  CRISPR gRNA sequence
caggcacctgccaccatgcc

SEQ ID NO: 13709 - DNA, 20 bp, Artificial
  CRISPR gRNA sequence
gctaatttgttttgtatatt

SEQ ID NO: 13710 - DNA, 20 bp, Artificial
  CRISPR gRNA sequence
aatttgttttgtatatttag

SEQ ID NO: 13711 - DNA, 20 bp, Artificial
  CRISPR gRNA sequence
tttgttttgtatatttagta

SEQ ID NO: 13712 - DNA, 20 bp, Artificial
  CRISPR gRNA sequence
ttttgtatatttagtagaga

SEQ ID NO: 13713 - DNA, 20 bp, Artificial
  CRISPR gRNA sequence
tttgtatatttagtagagat

SEQ ID NO: 13714 - DNA, 20 bp, Artificial
  CRISPR gRNA sequence
ttgtatatttagtagagatg

SEQ ID NO: 13715 - DNA, 20 bp, Artificial
  CRISPR gRNA sequence
gagatggggtttcactatgt

SEQ ID NO: 13716 - DNA, 20 bp, Artificial
  CRISPR gRNA sequence
tggggtttcactatgttggc

SEQ ID NO: 13717 - DNA, 20 bp, Artificial
  CRISPR gRNA sequence
ggggtttcactatgttggcc

SEQ ID NO: 13718 - DNA, 20 bp, Artificial
  CRISPR gRNA sequence
tttcactatgttggccaggc

SEQ ID NO: 13719 - DNA, 20 bp, Artificial
  CRISPR gRNA sequence
ccaggctggtctcaaactcc

SEQ ID NO: 13720 - DNA, 20 bp, Artificial
  CRISPR gRNA sequence
gccttgtgatccacctgcct

SEQ ID NO: 13721 - DNA, 20 bp, Artificial
  CRISPR gRNA sequence
ccacctgcctcggcctccca

SEQ ID NO: 13722 - DNA, 20 bp, Artificial
  CRISPR gRNA sequence
gcctcggcctcccaaagtgc

SEQ ID NO: 13723 - DNA, 20 bp, Artificial
  CRISPR gRNA sequence
cctcggcctcccaaagtgct

SEQ ID NO: 13724 - DNA, 20 bp, Artificial
  CRISPR gRNA sequence
ctcccaaagtgctgggatta

SEQ ID NO: 13725 - DNA, 20 bp, Artificial
  CRISPR gRNA sequence
tcccaaagtgctgggattac

SEQ ID NO: 13726 - DNA, 20 bp, Artificial
  CRISPR gRNA sequence
agtgctgggattacaggcat

SEQ ID NO: 13727 - DNA, 20 bp, Artificial
  CRISPR gRNA sequence
caggcataagccactgcgcc

SEQ ID NO: 13728 - DNA, 20 bp, Artificial
  CRISPR gRNA sequence
cataagccactgcgcctggc

SEQ ID NO: 13729 - DNA, 20 bp, Artificial
  CRISPR gRNA sequence
taagccactgcgcctggcca

SEQ ID NO: 13730 - DNA, 20 bp, Artificial
  CRISPR gRNA sequence
agagttttatttttaactgt

SEQ ID NO: 13731 - DNA, 20 bp, Artificial
  CRISPR gRNA sequence
gagttttatttttaactgtg

SEQ ID NO: 13732 - DNA, 20 bp, Artificial
  CRISPR gRNA sequence
agttttatttttaactgtga

SEQ ID NO: 13733 - DNA, 20 bp, Artificial
  CRISPR gRNA sequence
ttatttttaactgtgagggt

SEQ ID NO: 13734 - DNA, 20 bp, Artificial
  CRISPR gRNA sequence
tttaactgtgagggtcagaa

SEQ ID NO: 13735 - DNA, 20 bp, Artificial
  CRISPR gRNA sequence
gggtcagaaaagacctcact

SEQ ID NO: 13736 - DNA, 20 bp, Artificial
  CRISPR gRNA sequence
ggtcagaaaagacctcactg

SEQ ID NO: 13737 - DNA, 20 bp, Artificial
  CRISPR gRNA sequence
agaaaagacctcactgaggc

SEQ ID NO: 13738 - DNA, 20 bp, Artificial
  CRISPR gRNA sequence
gaaaagacctcactgaggcc

SEQ ID NO: 13739 - DNA, 20 bp, Artificial
  CRISPR gRNA sequence
gacctcactgaggccgggtg

SEQ ID NO: 13740 - DNA, 20 bp, Artificial
  CRISPR gRNA sequence
ctcactgaggccgggtgtgg

SEQ ID NO: 13741 - DNA, 20 bp, Artificial
  CRISPR gRNA sequence
gtggctcacgcctgtaatcc

SEQ ID NO: 13742 - DNA, 20 bp, Artificial
  CRISPR gRNA sequence
cgcctgtaatcccagcactt

SEQ ID NO: 13743 - DNA, 20 bp, Artificial
  CRISPR gRNA sequence
gcctgtaatcccagcacttt

SEQ ID NO: 13744 - DNA, 20 bp, Artificial
  CRISPR gRNA sequence
ctgtaatcccagcactttgg

SEQ ID NO: 13745 - DNA, 20 bp, Artificial
  CRISPR gRNA sequence
tgtaatcccagcactttggg

SEQ ID NO: 13746 - DNA, 20 bp, Artificial
  CRISPR gRNA sequence
tcccagcactttgggaggcc

SEQ ID NO: 13747 - DNA, 20 bp, Artificial
  CRISPR gRNA sequence
cccagcactttgggaggccg

SEQ ID NO: 13748 - DNA, 20 bp, Artificial
  CRISPR gRNA sequence
agcactttgggaggccgagg

SEQ ID NO: 13749 - DNA, 20 bp, Artificial
  CRISPR gRNA sequence
gcactttgggaggccgaggt

SEQ ID NO: 13750 - DNA, 20 bp, Artificial
  CRISPR gRNA sequence
cactttgggaggccgaggtg

SEQ ID NO: 13751 - DNA, 20 bp, Artificial
  CRISPR gRNA sequence
actttgggaggccgaggtgg

SEQ ID NO: 13752 - DNA, 20 bp, Artificial
  CRISPR gRNA sequence
ctttgggaggccgaggtggg

SEQ ID NO: 13753 - DNA, 20 bp, Artificial
  CRISPR gRNA sequence
ggccgaggtggggggatcac

SEQ ID NO: 13754 - DNA, 20 bp, Artificial
  CRISPR gRNA sequence
gccgaggtggggggatcacg

SEQ ID NO: 13755 - DNA, 20 bp, Artificial
  CRISPR gRNA sequence
aggtggggggatcacgaggt

SEQ ID NO: 13756 - DNA, 20 bp, Artificial
  CRISPR gRNA sequence
tggggggatcacgaggtcag

SEQ ID NO: 13757 - DNA, 20 bp, Artificial
  CRISPR gRNA sequence
gatcacgaggtcagaagatt

SEQ ID NO: 13758 - DNA, 20 bp, Artificial
  CRISPR gRNA sequence
tcagaagattgagaccatcc

SEQ ID NO: 13759 - DNA, 20 bp, Artificial
  CRISPR gRNA sequence
tgagaccatcctggctaaca

SEQ ID NO: 13760 - DNA, 20 bp, Artificial
  CRISPR gRNA sequence
ctactaaaaatacaaaaaat

SEQ ID NO: 13761 - DNA, 20 bp, Artificial
  CRISPR gRNA sequence
taaaaatacaaaaaattagc

SEQ ID NO: 13762 - DNA, 20 bp, Artificial
  CRISPR gRNA sequence
tacaaaaaattagccagatg

SEQ ID NO: 13763 - DNA, 20 bp, Artificial
  CRISPR gRNA sequence
gatgtggtgacatgtgcctg

SEQ ID NO: 13764 - DNA, 20 bp, Artificial
  CRISPR gRNA sequence
gtgacatgtgcctgtagtcc

SEQ ID NO: 13765 - DNA, 20 bp, Artificial
  CRISPR gRNA sequence
tgcctgtagtcccagctact

SEQ ID NO: 13766 - DNA, 20 bp, Artificial
  CRISPR gRNA sequence
gcctgtagtcccagctactc

SEQ ID NO: 13767 - DNA, 20 bp, Artificial
  CRISPR gRNA sequence
ctgtagtcccagctactcgg

SEQ ID NO: 13768 - DNA, 20 bp, Artificial
  CRISPR gRNA sequence
tgtagtcccagctactcggg

SEQ ID NO: 13769 - DNA, 20 bp, Artificial
  CRISPR gRNA sequence
tcccagctactcgggaggct

SEQ ID NO: 13770 - DNA, 20 bp, Artificial
  CRISPR gRNA sequence
cccagctactcgggaggctg

SEQ ID NO: 13771 - DNA, 20 bp, Artificial
  CRISPR gRNA sequence
gctactcgggaggctgaggc

SEQ ID NO: 13772 - DNA, 20 bp, Artificial
  CRISPR gRNA sequence
tactcgggaggctgaggcaa

SEQ ID NO: 13773 - DNA, 20 bp, Artificial
  CRISPR gRNA sequence
gctgaggcaagagaatcact

SEQ ID NO: 13774 - DNA, 20 bp, Artificial
  CRISPR gRNA sequence
gcaagagaatcacttggact

SEQ ID NO: 13775 - DNA, 20 bp, Artificial
  CRISPR gRNA sequence
caagagaatcacttggactt

SEQ ID NO: 13776 - DNA, 20 bp, Artificial
  CRISPR gRNA sequence
agagaatcacttggacttgg

SEQ ID NO: 13777 - DNA, 20 bp, Artificial
  CRISPR gRNA sequence
gagaatcacttggacttggg

SEQ ID NO: 13778 - DNA, 20 bp, Artificial
  CRISPR gRNA sequence
gaatcacttggacttgggag

SEQ ID NO: 13779 - DNA, 20 bp, Artificial
  CRISPR gRNA sequence
aatcacttggacttgggagg

SEQ ID NO: 13780 - DNA, 20 bp, Artificial
  CRISPR gRNA sequence
tcacttggacttgggaggag

SEQ ID NO: 13781 - DNA, 20 bp, Artificial
  CRISPR gRNA sequence
cacttggacttgggaggagg

SEQ ID NO: 13782 - DNA, 20 bp, Artificial
  CRISPR gRNA sequence
gacttgggaggaggaggttg

SEQ ID NO: 13783 - DNA, 20 bp, Artificial
  CRISPR gRNA sequence
tgggaggaggaggttgcagt

SEQ ID NO: 13784 - DNA, 20 bp, Artificial
  CRISPR gRNA sequence
ggaggaggttgcagtgagtc

SEQ ID NO: 13785 - DNA, 20 bp, Artificial
  CRISPR gRNA sequence
gagattgtgccactgcactc

SEQ ID NO: 13786 - DNA, 20 bp, Artificial
  CRISPR gRNA sequence
tgtgccactgcactccagcc

SEQ ID NO: 13787 - DNA, 20 bp, Artificial
  CRISPR gRNA sequence
gtgccactgcactccagcct

SEQ ID NO: 13788 - DNA, 20 bp, Artificial
  CRISPR gRNA sequence
ctgcactccagcctgggtga

SEQ ID NO: 13789 - DNA, 20 bp, Artificial
  CRISPR gRNA sequence
gcactccagcctgggtgaca

SEQ ID NO: 13790 - DNA, 20 bp, Artificial
  CRISPR gRNA sequence
tccagcctgggtgacagagc

SEQ ID NO: 13791 - DNA, 20 bp, Artificial
  CRISPR gRNA sequence
gcgagactccacctcaaaaa

SEQ ID NO: 13792 - DNA, 20 bp, Artificial
  CRISPR gRNA sequence
ctccacctcaaaaaaagaaa

SEQ ID NO: 13793 - DNA, 20 bp, Artificial
  CRISPR gRNA sequence
tcaaaaaaagaaaaagaaaa

SEQ ID NO: 13794 - DNA, 20 bp, Artificial
  CRISPR gRNA sequence
caaaaaaagaaaaagaaaaa

SEQ ID NO: 13795 - DNA, 20 bp, Artificial
  CRISPR gRNA sequence
aagaaaaagaaaaaaggaaa

SEQ ID NO: 13796 - DNA, 20 bp, Artificial
  CRISPR gRNA sequence
aaaagaaaaaaggaaaaaga

SEQ ID NO: 13797 - DNA, 20 bp, Artificial
  CRISPR gRNA sequence
gaaaaaaggaaaaagaaaga

SEQ ID NO: 13798 - DNA, 20 bp, Artificial
  CRISPR gRNA sequence
aaaggaaaaagaaagaaaga

SEQ ID NO: 13799 - DNA, 20 bp, Artificial
  CRISPR gRNA sequence
aaggaaaaagaaagaaagaa

SEQ ID NO: 13800 - DNA, 20 bp, Artificial
  CRISPR gRNA sequence
aggaaaaagaaagaaagaaa

SEQ ID NO: 13801 - DNA, 20 bp, Artificial
  CRISPR gRNA sequence
aaaagaaagaaagaaaggga

SEQ ID NO: 13802 - DNA, 20 bp, Artificial
  CRISPR gRNA sequence
gaaagaaagaaagggaaaga

SEQ ID NO: 13803 - DNA, 20 bp, Artificial
  CRISPR gRNA sequence
gaaagaaagggaaagaaaga

SEQ ID NO: 13804 - DNA, 20 bp, Artificial
  CRISPR gRNA sequence
gaaagggaaagaaagaaaga

SEQ ID NO: 13805 - DNA, 20 bp, Artificial
  CRISPR gRNA sequence
aaagggaaagaaagaaagaa

SEQ ID NO: 13806 - DNA, 20 bp, Artificial
  CRISPR gRNA sequence
agggaaagaaagaaagaaag

SEQ ID NO: 13807 - DNA, 20 bp, Artificial
  CRISPR gRNA sequence
gggaaagaaagaaagaaagg

SEQ ID NO: 13808 - DNA, 20 bp, Artificial
  CRISPR gRNA sequence
ggaaagaaagaaagaaagga

SEQ ID NO: 13809 - DNA, 20 bp, Artificial
  CRISPR gRNA sequence
agaaagaaagaaaggaggga

SEQ ID NO: 13810 - DNA, 20 bp, Artificial
  CRISPR gRNA sequence
agaaagaaaggagggaaaga

SEQ ID NO: 13811 - DNA, 20 bp, Artificial
  CRISPR gRNA sequence
agaaaggagggaaagaaaga

SEQ ID NO: 13812 - DNA, 20 bp, Artificial
  CRISPR gRNA sequence
aggagggaaagaaagaaaga

SEQ ID NO: 13813 - DNA, 20 bp, Artificial
  CRISPR gRNA sequence
gaaagaaagaaagaaagaaa

SEQ ID NO: 13814 - DNA, 20 bp, Artificial
  CRISPR gRNA sequence
aaagaaagaaagaaagaaac

SEQ ID NO: 13815 - DNA, 20 bp, Artificial
  CRISPR gRNA sequence
aagaaagaaagaaagaaaca

SEQ ID NO: 13816 - DNA, 20 bp, Artificial
  CRISPR gRNA sequence
aagaaagaaagaaacaggga

SEQ ID NO: 13817 - DNA, 20 bp, Artificial
  CRISPR gRNA sequence
aagaaagaaacagggaaaga

SEQ ID NO: 13818 - DNA, 20 bp, Artificial
  CRISPR gRNA sequence
agaaacagggaaagaaagaa

SEQ ID NO: 13819 - DNA, 20 bp, Artificial
  CRISPR gRNA sequence
cagggaaagaaagaaaagaa

SEQ ID NO: 13820 - DNA, 20 bp, Artificial
  CRISPR gRNA sequence
agggaaagaaagaaaagaaa

SEQ ID NO: 13821 - DNA, 20 bp, Artificial
  CRISPR gRNA sequence
agaaaagaaaaggcctcact

SEQ ID NO: 13822 - DNA, 20 bp, Artificial
  CRISPR gRNA sequence
agaaaaggcctcactgagta

SEQ ID NO: 13823 - DNA, 20 bp, Artificial
  CRISPR gRNA sequence
aggcctcactgagtaaagac

SEQ ID NO: 13824 - DNA, 20 bp, Artificial
  CRISPR gRNA sequence
gcctcactgagtaaagacca

SEQ ID NO: 13825 - DNA, 20 bp, Artificial
  CRISPR gRNA sequence
cctcactgagtaaagaccag

SEQ ID NO: 13826 - DNA, 20 bp, Artificial
  CRISPR gRNA sequence
tcactgagtaaagaccagag

SEQ ID NO: 13827 - DNA, 20 bp, Artificial
  CRISPR gRNA sequence
cactgagtaaagaccagagg

SEQ ID NO: 13828 - DNA, 20 bp, Artificial
  CRISPR gRNA sequence
agtaaagaccagaggaggtg

SEQ ID NO: 13829 - DNA, 20 bp, Artificial
  CRISPR gRNA sequence
gtaaagaccagaggaggtga

SEQ ID NO: 13830 - DNA, 20 bp, Artificial
  CRISPR gRNA sequence
accagaggaggtgaaggcat

SEQ ID NO: 13831 - DNA, 20 bp, Artificial
  CRISPR gRNA sequence
aggtgaaggcatgagccatg

SEQ ID NO: 13832 - DNA, 20 bp, Artificial
  CRISPR gRNA sequence
gcatgagccatgcagatatc

SEQ ID NO: 13833 - DNA, 20 bp, Artificial
  CRISPR gRNA sequence
catgagccatgcagatatct

SEQ ID NO: 13834 - DNA, 20 bp, Artificial
  CRISPR gRNA sequence
atgagccatgcagatatctg

SEQ ID NO: 13835 - DNA, 20 bp, Artificial
  CRISPR gRNA sequence
gagccatgcagatatctggg

SEQ ID NO: 13836 - DNA, 20 bp, Artificial
  CRISPR gRNA sequence
ccatgcagatatctggggag

SEQ ID NO: 13837 - DNA, 20 bp, Artificial
  CRISPR gRNA sequence
atatctggggagaagtattc

SEQ ID NO: 13838 - DNA, 20 bp, Artificial
  CRISPR gRNA sequence
tatctggggagaagtattcc

SEQ ID NO: 13839 - DNA, 20 bp, Artificial
  CRISPR gRNA sequence
ctggggagaagtattccagg

SEQ ID NO: 13840 - DNA, 20 bp, Artificial
  CRISPR gRNA sequence
ggggagaagtattccaggca

SEQ ID NO: 13841 - DNA, 20 bp, Artificial
  CRISPR gRNA sequence
gggagaagtattccaggcag

SEQ ID NO: 13842 - DNA, 20 bp, Artificial
  CRISPR gRNA sequence
ggagaagtattccaggcaga

SEQ ID NO: 13843 - DNA, 20 bp, Artificial
  CRISPR gRNA sequence
agtattccaggcagagggca

SEQ ID NO: 13844 - DNA, 20 bp, Artificial
  CRISPR gRNA sequence
ttccaggcagagggcacagc

SEQ ID NO: 13845 - DNA, 20 bp, Artificial
  CRISPR gRNA sequence
cagagggcacagccggtgca

SEQ ID NO: 13846 - DNA, 20 bp, Artificial
  CRISPR gRNA sequence
agagggcacagccggtgcaa

SEQ ID NO: 13847 - DNA, 20 bp, Artificial
  CRISPR gRNA sequence
gcacagccggtgcaaaggcc

SEQ ID NO: 13848 - DNA, 20 bp, Artificial
  CRISPR gRNA sequence
acagccggtgcaaaggcctg

SEQ ID NO: 13849 - DNA, 20 bp, Artificial
  CRISPR gRNA sequence
cagccggtgcaaaggcctgg

SEQ ID NO: 13850 - DNA, 20 bp, Artificial
  CRISPR gRNA sequence
ccggtgcaaaggcctggagg

SEQ ID NO: 13851 - DNA, 20 bp, Artificial
  CRISPR gRNA sequence
gtgcaaaggcctggaggcag

SEQ ID NO: 13852 - DNA, 20 bp, Artificial
  CRISPR gRNA sequence
cctggaggcagaagcatgcc

SEQ ID NO: 13853 - DNA, 20 bp, Artificial
  CRISPR gRNA sequence
ctggaggcagaagcatgcct

SEQ ID NO: 13854 - DNA, 20 bp, Artificial
  CRISPR gRNA sequence
ggaggcagaagcatgcctag

SEQ ID NO: 13855 - DNA, 20 bp, Artificial
  CRISPR gRNA sequence
gaggcagaagcatgcctagg

SEQ ID NO: 13856 - DNA, 20 bp, Artificial
  CRISPR gRNA sequence
aagcatgcctaggaggttga

SEQ ID NO: 13857 - DNA, 20 bp, Artificial
  CRISPR gRNA sequence
atgcctaggaggttgaaagc

SEQ ID NO: 13858 - DNA, 20 bp, Artificial
  CRISPR gRNA sequence
ctaggaggttgaaagccagc

SEQ ID NO: 13859 - DNA, 20 bp, Artificial
  CRISPR gRNA sequence
taggaggttgaaagccagca

SEQ ID NO: 13860 - DNA, 20 bp, Artificial
  CRISPR gRNA sequence
ggaggttgaaagccagcaag

SEQ ID NO: 13861 - DNA, 20 bp, Artificial
  CRISPR gRNA sequence
gaggttgaaagccagcaagg

SEQ ID NO: 13862 - DNA, 20 bp, Artificial
  CRISPR gRNA sequence
aagccagcaaggaggccctg

SEQ ID NO: 13863 - DNA, 20 bp, Artificial
  CRISPR gRNA sequence
cagcaaggaggccctgtggc

SEQ ID NO: 13864 - DNA, 20 bp, Artificial
  CRISPR gRNA sequence
aggaggccctgtggctggaa

SEQ ID NO: 13865 - DNA, 20 bp, Artificial
  CRISPR gRNA sequence
gaggccctgtggctggaatg

SEQ ID NO: 13866 - DNA, 20 bp, Artificial
  CRISPR gRNA sequence
ggccctgtggctggaatgga

SEQ ID NO: 13867 - DNA, 20 bp, Artificial
  CRISPR gRNA sequence
ccctgtggctggaatggaga

SEQ ID NO: 13868 - DNA, 20 bp, Artificial
  CRISPR gRNA sequence
gctggaatggagagagcacc

SEQ ID NO: 13869 - DNA, 20 bp, Artificial
  CRISPR gRNA sequence
gaatggagagagcacccagc

SEQ ID NO: 13870 - DNA, 20 bp, Artificial
  CRISPR gRNA sequence
gagagagcacccagcgagtg

SEQ ID NO: 13871 - DNA, 20 bp, Artificial
  CRISPR gRNA sequence
agagagcacccagcgagtgt

SEQ ID NO: 13872 - DNA, 20 bp, Artificial
  CRISPR gRNA sequence
agagcacccagcgagtgtag

SEQ ID NO: 13873 - DNA, 20 bp, Artificial
  CRISPR gRNA sequence
acccagcgagtgtaggagat

SEQ ID NO: 13874 - DNA, 20 bp, Artificial
  CRISPR gRNA sequence
cccagcgagtgtaggagata

SEQ ID NO: 13875 - DNA, 20 bp, Artificial
  CRISPR gRNA sequence
ccagcgagtgtaggagataa

SEQ ID NO: 13876 - DNA, 20 bp, Artificial
  CRISPR gRNA sequence
gtgtaggagataagggtgaa

SEQ ID NO: 13877 - DNA, 20 bp, Artificial
  CRISPR gRNA sequence
tgtaggagataagggtgaac

SEQ ID NO: 13878 - DNA, 20 bp, Artificial
  CRISPR gRNA sequence
ggagataagggtgaacaggt

SEQ ID NO: 13879 - DNA, 20 bp, Artificial
  CRISPR gRNA sequence
gataagggtgaacaggtgag

SEQ ID NO: 13880 - DNA, 20 bp, Artificial
  CRISPR gRNA sequence
ataagggtgaacaggtgagt

SEQ ID NO: 13881 - DNA, 20 bp, Artificial
  CRISPR gRNA sequence
taagggtgaacaggtgagtg

SEQ ID NO: 13882 - DNA, 20 bp, Artificial
  CRISPR gRNA sequence
caggtgagtggggactgaac

SEQ ID NO: 13883 - DNA, 20 bp, Artificial
  CRISPR gRNA sequence
aggtgagtggggactgaact

SEQ ID NO: 13884 - DNA, 20 bp, Artificial
  CRISPR gRNA sequence
ggtgagtggggactgaactg

SEQ ID NO: 13885 - DNA, 20 bp, Artificial
  CRISPR gRNA sequence
gagtggggactgaactgggg

SEQ ID NO: 13886 - DNA, 20 bp, Artificial
  CRISPR gRNA sequence
agtggggactgaactgggga

SEQ ID NO: 13887 - DNA, 20 bp, Artificial
  CRISPR gRNA sequence
aaggactctgtgtacaaacg

SEQ ID NO: 13888 - DNA, 20 bp, Artificial
  CRISPR gRNA sequence
gtgtacaaacgaagtccctg

SEQ ID NO: 13889 - DNA, 20 bp, Artificial
  CRISPR gRNA sequence
tgtacaaacgaagtccctgt

SEQ ID NO: 13890 - DNA, 20 bp, Artificial
  CRISPR gRNA sequence
gtacaaacgaagtccctgta

SEQ ID NO: 13891 - DNA, 20 bp, Artificial
  CRISPR gRNA sequence
cgaagtccctgtagggttgt

SEQ ID NO: 13892 - DNA, 20 bp, Artificial
  CRISPR gRNA sequence
agtccctgtagggttgtgag

SEQ ID NO: 13893 - DNA, 20 bp, Artificial
  CRISPR gRNA sequence
ctgtagggttgtgagtggct

SEQ ID NO: 13894 - DNA, 20 bp, Artificial
  CRISPR gRNA sequence
ggctaagaaccctgatttga

SEQ ID NO: 13895 - DNA, 20 bp, Artificial
  CRISPR gRNA sequence
aagaaccctgatttgacaga

SEQ ID NO: 13896 - DNA, 20 bp, Artificial
  CRISPR gRNA sequence
ccctgatttgacagacagat

SEQ ID NO: 13897 - DNA, 20 bp, Artificial
  CRISPR gRNA sequence
cctgatttgacagacagatg

SEQ ID NO: 13898 - DNA, 20 bp, Artificial
  CRISPR gRNA sequence
tgacagacagatgaggtcta

SEQ ID NO: 13899 - DNA, 20 bp, Artificial
  CRISPR gRNA sequence
gacagacagatgaggtctac

SEQ ID NO: 13900 - DNA, 20 bp, Artificial
  CRISPR gRNA sequence
acagacagatgaggtctaca

SEQ ID NO: 13901 - DNA, 20 bp, Artificial
  CRISPR gRNA sequence
gatgaggtctacagggtgcc

SEQ ID NO: 13902 - DNA, 20 bp, Artificial
  CRISPR gRNA sequence
atgaggtctacagggtgcct

SEQ ID NO: 13903 - DNA, 20 bp, Artificial
  CRISPR gRNA sequence
gtctacagggtgcctgggca

SEQ ID NO: 13904 - DNA, 20 bp, Artificial
  CRISPR gRNA sequence
tacagggtgcctgggcacag

SEQ ID NO: 13905 - DNA, 20 bp, Artificial
  CRISPR gRNA sequence
agggtgcctgggcacagtag

SEQ ID NO: 13906 - DNA, 20 bp, Artificial
  CRISPR gRNA sequence
cctgggcacagtagaagcct

SEQ ID NO: 13907 - DNA, 20 bp, Artificial
  CRISPR gRNA sequence
gtagaagcctgagaaaatgc

SEQ ID NO: 13908 - DNA, 20 bp, Artificial
  CRISPR gRNA sequence
gcctgagaaaatgccagaaa

SEQ ID NO: 13909 - DNA, 20 bp, Artificial
  CRISPR gRNA sequence
tccttccttccttccttcct

SEQ ID NO: 13910 - DNA, 20 bp, Artificial
  CRISPR gRNA sequence
ttccttcctcagaacctcct

SEQ ID NO: 13911 - DNA, 20 bp, Artificial
  CRISPR gRNA sequence
tccttcctcagaacctcctc

SEQ ID NO: 13912 - DNA, 20 bp, Artificial
  CRISPR gRNA sequence
ccttcctcagaacctcctcg

SEQ ID NO: 13913 - DNA, 20 bp, Artificial
  CRISPR gRNA sequence
cttcctcagaacctcctcgg

SEQ ID NO: 13914 - DNA, 20 bp, Artificial
  CRISPR gRNA sequence
agaacctcctcgggggcttc

SEQ ID NO: 13915 - DNA, 20 bp, Artificial
  CRISPR gRNA sequence
cctcgggggcttccggtctc

SEQ ID NO: 13916 - DNA, 20 bp, Artificial
  CRISPR gRNA sequence
ctcgggggcttccggtctcc

SEQ ID NO: 13917 - DNA, 20 bp, Artificial
  CRISPR gRNA sequence
gggggcttccggtctccagg

SEQ ID NO: 13918 - DNA, 20 bp, Artificial
  CRISPR gRNA sequence
tctccaggtggctgatcacc

SEQ ID NO: 13919 - DNA, 20 bp, Artificial
  CRISPR gRNA sequence
ggtggctgatcacccggctc

SEQ ID NO: 13920 - DNA, 20 bp, Artificial
  CRISPR gRNA sequence
gtggctgatcacccggctct

SEQ ID NO: 13921 - DNA, 20 bp, Artificial
  CRISPR gRNA sequence
ctctaggctgttccacccca

SEQ ID NO: 13922 - DNA, 20 bp, Artificial
  CRISPR gRNA sequence
accccatggccgctgttccc

SEQ ID NO: 13923 - DNA, 20 bp, Artificial
  CRISPR gRNA sequence
cccatggccgctgttcccca

SEQ ID NO: 13924 - DNA, 20 bp, Artificial
  CRISPR gRNA sequence
ggccgctgttccccagagcg

SEQ ID NO: 13925 - DNA, 20 bp, Artificial
  CRISPR gRNA sequence
gcgcagttccgatcttgaac

SEQ ID NO: 13926 - DNA, 20 bp, Artificial
  CRISPR gRNA sequence
cgcagttccgatcttgaact

SEQ ID NO: 13927 - DNA, 20 bp, Artificial
  CRISPR gRNA sequence
gcagttccgatcttgaacta

SEQ ID NO: 13928 - DNA, 20 bp, Artificial
  CRISPR gRNA sequence
cagttccgatcttgaactag

SEQ ID NO: 13929 - DNA, 20 bp, Artificial
  CRISPR gRNA sequence
tcttgaactaggggcttttt

SEQ ID NO: 13930 - DNA, 20 bp, Artificial
  CRISPR gRNA sequence
ttttcagctgaaaataattt

SEQ ID NO: 13931 - DNA, 20 bp, Artificial
  CRISPR gRNA sequence
tttcagctgaaaataattta

SEQ ID NO: 13932 - DNA, 20 bp, Artificial
  CRISPR gRNA sequence
agctgaaaataatttaaggc

SEQ ID NO: 13933 - DNA, 20 bp, Artificial
  CRISPR gRNA sequence
gaaaataatttaaggccaga

SEQ ID NO: 13934 - DNA, 20 bp, Artificial
  CRISPR gRNA sequence
aaaataatttaaggccagaa

SEQ ID NO: 13935 - DNA, 20 bp, Artificial
  CRISPR gRNA sequence
aaataatttaaggccagaaa

SEQ ID NO: 13936 - DNA, 20 bp, Artificial
  CRISPR gRNA sequence
ttaaggccagaaagggccct

SEQ ID NO: 13937 - DNA, 20 bp, Artificial
  CRISPR gRNA sequence
gggccctcagttattgtttt

SEQ ID NO: 13938 - DNA, 20 bp, Artificial
  CRISPR gRNA sequence
tttcagacatttcccctttt

SEQ ID NO: 13939 - DNA, 20 bp, Artificial
  CRISPR gRNA sequence
ttcagcatcatttttacctc

SEQ ID NO: 13940 - DNA, 20 bp, Artificial
  CRISPR gRNA sequence
tttttacctctggacaaatt

SEQ ID NO: 13941 - DNA, 20 bp, Artificial
  CRISPR gRNA sequence
accttgtctctgttcaaaac

SEQ ID NO: 13942 - DNA, 20 bp, Artificial
  CRISPR gRNA sequence
cttgtctctgttcaaaacaa

SEQ ID NO: 13943 - DNA, 20 bp, Artificial
  CRISPR gRNA sequence
ctgttcaaaacaagagacac

SEQ ID NO: 13944 - DNA, 20 bp, Artificial
  CRISPR gRNA sequence
aagagacactggcttttttc

SEQ ID NO: 13945 - DNA, 20 bp, Artificial
  CRISPR gRNA sequence
agagacactggcttttttct

SEQ ID NO: 13946 - DNA, 20 bp, Artificial
  CRISPR gRNA sequence
gagacactggcttttttctg

SEQ ID NO: 13947 - DNA, 20 bp, Artificial
  CRISPR gRNA sequence
actggcttttttctggggca

SEQ ID NO: 13948 - DNA, 20 bp, Artificial
  CRISPR gRNA sequence
ctggcttttttctggggcac

SEQ ID NO: 13949 - DNA, 20 bp, Artificial
  CRISPR gRNA sequence
tggcttttttctggggcaca

SEQ ID NO: 13950 - DNA, 20 bp, Artificial
  CRISPR gRNA sequence
ggcttttttctggggcacag

SEQ ID NO: 13951 - DNA, 20 bp, Artificial
  CRISPR gRNA sequence
cttttttctggggcacaggg

SEQ ID NO: 13952 - DNA, 20 bp, Artificial
  CRISPR gRNA sequence
ttttctggggcacaggggag

SEQ ID NO: 13953 - DNA, 20 bp, Artificial
  CRISPR gRNA sequence
gggcacaggggagcagtgat

SEQ ID NO: 13954 - DNA, 20 bp, Artificial
  CRISPR gRNA sequence
ggcacaggggagcagtgatc

SEQ ID NO: 13955 - DNA, 20 bp, Artificial
  CRISPR gRNA sequence
gcacaggggagcagtgatca

SEQ ID NO: 13956 - DNA, 20 bp, Artificial
  CRISPR gRNA sequence
acaggggagcagtgatcagg

SEQ ID NO: 13957 - DNA, 20 bp, Artificial
  CRISPR gRNA sequence
aggggagcagtgatcaggga

SEQ ID NO: 13958 - DNA, 20 bp, Artificial
  CRISPR gRNA sequence
cagtgatcagggagagctga

SEQ ID NO: 13959 - DNA, 20 bp, Artificial
  CRISPR gRNA sequence
cagggagagctgatagcttg

SEQ ID NO: 13960 - DNA, 20 bp, Artificial
  CRISPR gRNA sequence
agggagagctgatagcttgt

SEQ ID NO: 13961 - DNA, 20 bp, Artificial
  CRISPR gRNA sequence
gctgatagcttgtgggtgac

SEQ ID NO: 13962 - DNA, 20 bp, Artificial
  CRISPR gRNA sequence
atagcttgtgggtgaccagc

SEQ ID NO: 13963 - DNA, 20 bp, Artificial
  CRISPR gRNA sequence
tagcttgtgggtgaccagct

SEQ ID NO: 13964 - DNA, 20 bp, Artificial
  CRISPR gRNA sequence
agcttgtgggtgaccagctg

SEQ ID NO: 13965 - DNA, 20 bp, Artificial
  CRISPR gRNA sequence
gcttgtgggtgaccagctgg

SEQ ID NO: 13966 - DNA, 20 bp, Artificial
  CRISPR gRNA sequence
ggtgaccagctgggggacca

SEQ ID NO: 13967 - DNA, 20 bp, Artificial
  CRISPR gRNA sequence
gtgaccagctgggggaccac

SEQ ID NO: 13968 - DNA, 20 bp, Artificial
  CRISPR gRNA sequence
ccagctgggggaccacgggc

SEQ ID NO: 13969 - DNA, 20 bp, Artificial
  CRISPR gRNA sequence
ggcaagtcacttaacctcac

SEQ ID NO: 13970 - DNA, 20 bp, Artificial
  CRISPR gRNA sequence
gcaagtcacttaacctcacc

SEQ ID NO: 13971 - DNA, 20 bp, Artificial
  CRISPR gRNA sequence
ccgtctcctcatctgtaaaa

SEQ ID NO: 13972 - DNA, 20 bp, Artificial
  CRISPR gRNA sequence
cgtctcctcatctgtaaaat

SEQ ID NO: 13973 - DNA, 20 bp, Artificial
  CRISPR gRNA sequence
gtctcctcatctgtaaaatg

SEQ ID NO: 13974 - DNA, 20 bp, Artificial
  CRISPR gRNA sequence
tcctcatctgtaaaatgggg

SEQ ID NO: 13975 - DNA, 20 bp, Artificial
  CRISPR gRNA sequence
tgatgactgtctgtcttcca

SEQ ID NO: 13976 - DNA, 20 bp, Artificial
  CRISPR gRNA sequence
tgactgtctgtcttccacag

SEQ ID NO: 13977 - DNA, 20 bp, Artificial
  CRISPR gRNA sequence
tgtcttccacagtagctctt

SEQ ID NO: 13978 - DNA, 20 bp, Artificial
  CRISPR gRNA sequence
cagtagctcttgagattaat

SEQ ID NO: 13979 - DNA, 20 bp, Artificial
  CRISPR gRNA sequence
tataaaatgcactgaattat

SEQ ID NO: 13980 - DNA, 20 bp, Artificial
  CRISPR gRNA sequence
aaatgcactgaattataagc

SEQ ID NO: 13981 - DNA, 20 bp, Artificial
  CRISPR gRNA sequence
aatgcactgaattataagct

SEQ ID NO: 13982 - DNA, 20 bp, Artificial
  CRISPR gRNA sequence
actgaattataagctgggca

SEQ ID NO: 13983 - DNA, 20 bp, Artificial
  CRISPR gRNA sequence
gaattataagctgggcatgg

SEQ ID NO: 13984 - DNA, 20 bp, Artificial
  CRISPR gRNA sequence
gtggcttacacctgtaatcc

SEQ ID NO: 13985 - DNA, 20 bp, Artificial
  CRISPR gRNA sequence
cacctgtaatcccagcactt

SEQ ID NO: 13986 - DNA, 20 bp, Artificial
  CRISPR gRNA sequence
acctgtaatcccagcacttt

SEQ ID NO: 13987 - DNA, 20 bp, Artificial
  CRISPR gRNA sequence
ctgtaatcccagcactttgg

SEQ ID NO: 13988 - DNA, 20 bp, Artificial
  CRISPR gRNA sequence
tgtaatcccagcactttggg

SEQ ID NO: 13989 - DNA, 20 bp, Artificial
  CRISPR gRNA sequence
tcccagcactttgggaggct

SEQ ID NO: 13990 - DNA, 20 bp, Artificial
  CRISPR gRNA sequence
cccagcactttgggaggctg

SEQ ID NO: 13991 - DNA, 20 bp, Artificial
  CRISPR gRNA sequence
agcactttgggaggctgagg

SEQ ID NO: 13992 - DNA, 20 bp, Artificial
  CRISPR gRNA sequence
gcactttgggaggctgaggt

SEQ ID NO: 13993 - DNA, 20 bp, Artificial
  CRISPR gRNA sequence
actttgggaggctgaggtgg

SEQ ID NO: 13994 - DNA, 20 bp, Artificial
  CRISPR gRNA sequence
ctttgggaggctgaggtggg

SEQ ID NO: 13995 - DNA, 20 bp, Artificial
  CRISPR gRNA sequence
ctgaggtgggaggaacatct

SEQ ID NO: 13996 - DNA, 20 bp, Artificial
  CRISPR gRNA sequence
tgaggtgggaggaacatctg

SEQ ID NO: 13997 - DNA, 20 bp, Artificial
  CRISPR gRNA sequence
gtgggaggaacatctgaggc

SEQ ID NO: 13998 - DNA, 20 bp, Artificial
  CRISPR gRNA sequence
tgggaggaacatctgaggcc

SEQ ID NO: 13999 - DNA, 20 bp, Artificial
  CRISPR gRNA sequence
ggaggaacatctgaggccag

SEQ ID NO: 14000 - DNA, 20 bp, Artificial
  CRISPR gRNA sequence
acatctgaggccaggagttc

SEQ ID NO: 14001 - DNA, 20 bp, Artificial
  CRISPR gRNA sequence
tgaggccaggagttcaagac

SEQ ID NO: 14002 - DNA, 20 bp, Artificial
  CRISPR gRNA sequence
ccaggagttcaagaccagcc

SEQ ID NO: 14003 - DNA, 20 bp, Artificial
  CRISPR gRNA sequence
caagaccagcctggccaaca

SEQ ID NO: 14004 - DNA, 20 bp, Artificial
  CRISPR gRNA sequence
cagcctggccaacatggtta

SEQ ID NO: 14005 - DNA, 20 bp, Artificial
  CRISPR gRNA sequence
tctactaaaaatacaaaaat

SEQ ID NO: 14006 - DNA, 20 bp, Artificial
  CRISPR gRNA sequence
ctaaaaatacaaaaattagc

SEQ ID NO: 14007 - DNA, 20 bp, Artificial
  CRISPR gRNA sequence
taaaaatacaaaaattagcc

SEQ ID NO: 14008 - DNA, 20 bp, Artificial
  CRISPR gRNA sequence
atacaaaaattagccaggtg

SEQ ID NO: 14009 - DNA, 20 bp, Artificial
  CRISPR gRNA sequence
caaaaattagccaggtgtag

SEQ ID NO: 14010 - DNA, 20 bp, Artificial
  CRISPR gRNA sequence
gtggtgtacacctgtaatcc

SEQ ID NO: 14011 - DNA, 20 bp, Artificial
  CRISPR gRNA sequence
cacctgtaatcccagctact

SEQ ID NO: 14012 - DNA, 20 bp, Artificial
  CRISPR gRNA sequence
acctgtaatcccagctactc

SEQ ID NO: 14013 - DNA, 20 bp, Artificial
  CRISPR gRNA sequence
ctgtaatcccagctactcgg

SEQ ID NO: 14014 - DNA, 20 bp, Artificial
  CRISPR gRNA sequence
tgtaatcccagctactcggg

SEQ ID NO: 14015 - DNA, 20 bp, Artificial
  CRISPR gRNA sequence
tcccagctactcgggaggct

SEQ ID NO: 14016 - DNA, 20 bp, Artificial
  CRISPR gRNA sequence
cccagctactcgggaggctg

SEQ ID NO: 14017 - DNA, 20 bp, Artificial
  CRISPR gRNA sequence
agctactcgggaggctgagg

SEQ ID NO: 14018 - DNA, 20 bp, Artificial
  CRISPR gRNA sequence
gctactcgggaggctgaggc

SEQ ID NO: 14019 - DNA, 20 bp, Artificial
  CRISPR gRNA sequence
gcaggaaaattgcttgaacc

SEQ ID NO: 14020 - DNA, 20 bp, Artificial
  CRISPR gRNA sequence
aggaaaattgcttgaaccga

SEQ ID NO: 14021 - DNA, 20 bp, Artificial
  CRISPR gRNA sequence
ggaaaattgcttgaaccgag

SEQ ID NO: 14022 - DNA, 20 bp, Artificial
  CRISPR gRNA sequence
aaattgcttgaaccgagagg

SEQ ID NO: 14023 - DNA, 20 bp, Artificial
  CRISPR gRNA sequence
attgcttgaaccgagaggtg

SEQ ID NO: 14024 - DNA, 20 bp, Artificial
  CRISPR gRNA sequence
gaaccgagaggtggagattg

SEQ ID NO: 14025 - DNA, 20 bp, Artificial
  CRISPR gRNA sequence
cgagaggtggagattgcagt

SEQ ID NO: 14026 - DNA, 20 bp, Artificial
  CRISPR gRNA sequence
ggtggagattgcagtgagcc

SEQ ID NO: 14027 - DNA, 20 bp, Artificial
  CRISPR gRNA sequence
aagatcataccactgcattc

SEQ ID NO: 14028 - DNA, 20 bp, Artificial
  CRISPR gRNA sequence
cataccactgcattctagcc

SEQ ID NO: 14029 - DNA, 20 bp, Artificial
  CRISPR gRNA sequence
ataccactgcattctagcct

SEQ ID NO: 14030 - DNA, 20 bp, Artificial
  CRISPR gRNA sequence
ctgcattctagcctgggtga

SEQ ID NO: 14031 - DNA, 20 bp, Artificial
  CRISPR gRNA sequence
gcattctagcctgggtgaca

SEQ ID NO: 14032 - DNA, 20 bp, Artificial
  CRISPR gRNA sequence
tctagcctgggtgacagagc

SEQ ID NO: 14033 - DNA, 20 bp, Artificial
  CRISPR gRNA sequence
accccatctccaaaaaaaaa

SEQ ID NO: 14034 - DNA, 20 bp, Artificial
  CRISPR gRNA sequence
aaacagcaccgaatatacca

SEQ ID NO: 14035 - DNA, 20 bp, Artificial
  CRISPR gRNA sequence
aacagcaccgaatataccac

SEQ ID NO: 14036 - DNA, 20 bp, Artificial
  CRISPR gRNA sequence
aacaactccttcctaatcat

SEQ ID NO: 14037 - DNA, 20 bp, Artificial
  CRISPR gRNA sequence
ttcctaatcattagatgatc

SEQ ID NO: 14038 - DNA, 20 bp, Artificial
  CRISPR gRNA sequence
agatgatctagacccctacc

SEQ ID NO: 14039 - DNA, 20 bp, Artificial
  CRISPR gRNA sequence
gatgatctagacccctacca

SEQ ID NO: 14040 - DNA, 20 bp, Artificial
  CRISPR gRNA sequence
ccaaggaacaaacattcatt

SEQ ID NO: 14041 - DNA, 20 bp, Artificial
  CRISPR gRNA sequence
cattcatttagctttttctg

SEQ ID NO: 14042 - DNA, 20 bp, Artificial
  CRISPR gRNA sequence
tcatttagctttttctgtgg

SEQ ID NO: 14043 - DNA, 20 bp, Artificial
  CRISPR gRNA sequence
catttagctttttctgtgga

SEQ ID NO: 14044 - DNA, 20 bp, Artificial
  CRISPR gRNA sequence
tttagctttttctgtggaag

SEQ ID NO: 14045 - DNA, 20 bp, Artificial
  CRISPR gRNA sequence
ctttttctgtggaaggagct

SEQ ID NO: 14046 - DNA, 20 bp, Artificial
  CRISPR gRNA sequence
tttttctgtggaaggagctt

SEQ ID NO: 14047 - DNA, 20 bp, Artificial
  CRISPR gRNA sequence
ttttctgtggaaggagctta

SEQ ID NO: 14048 - DNA, 20 bp, Artificial
  CRISPR gRNA sequence
ctgtggaaggagcttagggc

SEQ ID NO: 14049 - DNA, 20 bp, Artificial
  CRISPR gRNA sequence
tgtggaaggagcttagggcc

SEQ ID NO: 14050 - DNA, 20 bp, Artificial
  CRISPR gRNA sequence
tgacctgacctttatgactt

SEQ ID NO: 14051 - DNA, 20 bp, Artificial
  CRISPR gRNA sequence
gactttggataaacaattta

SEQ ID NO: 14052 - DNA, 20 bp, Artificial
  CRISPR gRNA sequence
aatttaaagtctcttgttct

SEQ ID NO: 14053 - DNA, 20 bp, Artificial
  CRISPR gRNA sequence
cagcattgccatttgtacaa

SEQ ID NO: 14054 - DNA, 20 bp, Artificial
  CRISPR gRNA sequence
agcattgccatttgtacaat

SEQ ID NO: 14055 - DNA, 20 bp, Artificial
  CRISPR gRNA sequence
gcattgccatttgtacaatg

SEQ ID NO: 14056 - DNA, 20 bp, Artificial
  CRISPR gRNA sequence
attgccatttgtacaatggg

SEQ ID NO: 14057 - DNA, 20 bp, Artificial
  CRISPR gRNA sequence
ggagatgatgacaatgcctg

SEQ ID NO: 14058 - DNA, 20 bp, Artificial
  CRISPR gRNA sequence
agatgatgacaatgcctgta

SEQ ID NO: 14059 - DNA, 20 bp, Artificial
  CRISPR gRNA sequence
gatgatgacaatgcctgtag

SEQ ID NO: 14060 - DNA, 20 bp, Artificial
  CRISPR gRNA sequence
tgatgacaatgcctgtagag

SEQ ID NO: 14061 - DNA, 20 bp, Artificial
  CRISPR gRNA sequence
gatgacaatgcctgtagagg

SEQ ID NO: 14062 - DNA, 20 bp, Artificial
  CRISPR gRNA sequence
atgacaatgcctgtagagga

SEQ ID NO: 14063 - DNA, 20 bp, Artificial
  CRISPR gRNA sequence
acaatgcctgtagaggaggg

SEQ ID NO: 14064 - DNA, 20 bp, Artificial
  CRISPR gRNA sequence
cctgtagaggagggtggcct

SEQ ID NO: 14065 - DNA, 20 bp, Artificial
  CRISPR gRNA sequence
gagggtggcctgagataatt

SEQ ID NO: 14066 - DNA, 20 bp, Artificial
  CRISPR gRNA sequence
gtggcctgagataattgaga

SEQ ID NO: 14067 - DNA, 20 bp, Artificial
  CRISPR gRNA sequence
gcctgagataattgagatgg

SEQ ID NO: 14068 - DNA, 20 bp, Artificial
  CRISPR gRNA sequence
cctgagataattgagatgga

SEQ ID NO: 14069 - DNA, 20 bp, Artificial
  CRISPR gRNA sequence
agataattgagatggaaggt

SEQ ID NO: 14070 - DNA, 20 bp, Artificial
  CRISPR gRNA sequence
aaggtgagctgcaaatttaa

SEQ ID NO: 14071 - DNA, 20 bp, Artificial
  CRISPR gRNA sequence
gcaaatttaaaagcctgttc

SEQ ID NO: 14072 - DNA, 20 bp, Artificial
  CRISPR gRNA sequence
atttaaaagcctgttctggc

SEQ ID NO: 14073 - DNA, 20 bp, Artificial
  CRISPR gRNA sequence
tttaaaagcctgttctggcc

SEQ ID NO: 14074 - DNA, 20 bp, Artificial
  CRISPR gRNA sequence
aagcctgttctggccaggtg

SEQ ID NO: 14075 - DNA, 20 bp, Artificial
  CRISPR gRNA sequence
agcctgttctggccaggtgc

SEQ ID NO: 14076 - DNA, 20 bp, Artificial
  CRISPR gRNA sequence
cctgttctggccaggtgcgg

SEQ ID NO: 14077 - DNA, 20 bp, Artificial
  CRISPR gRNA sequence
ggagctcgcacctgtaatcc

SEQ ID NO: 14078 - DNA, 20 bp, Artificial
  CRISPR gRNA sequence
cacctgtaatcctagcactt

SEQ ID NO: 14079 - DNA, 20 bp, Artificial
  CRISPR gRNA sequence
acctgtaatcctagcacttt

SEQ ID NO: 14080 - DNA, 20 bp, Artificial
  CRISPR gRNA sequence
ctgtaatcctagcactttgg

SEQ ID NO: 14081 - DNA, 20 bp, Artificial
  CRISPR gRNA sequence
tgtaatcctagcactttggg

SEQ ID NO: 14082 - DNA, 20 bp, Artificial
  CRISPR gRNA sequence
tcctagcactttgggaggct

SEQ ID NO: 14083 - DNA, 20 bp, Artificial
  CRISPR gRNA sequence
cctagcactttgggaggctg

SEQ ID NO: 14084 - DNA, 20 bp, Artificial
  CRISPR gRNA sequence
agcactttgggaggctgagg

SEQ ID NO: 14085 - DNA, 20 bp, Artificial
  CRISPR gRNA sequence
gcactttgggaggctgaggt

SEQ ID NO: 14086 - DNA, 20 bp, Artificial
  CRISPR gRNA sequence
actttgggaggctgaggtgg

SEQ ID NO: 14087 - DNA, 20 bp, Artificial
  CRISPR gRNA sequence
ctttgggaggctgaggtggg

SEQ ID NO: 14088 - DNA, 20 bp, Artificial
  CRISPR gRNA sequence
ctgaggtgggaggattgctt

SEQ ID NO: 14089 - DNA, 20 bp, Artificial
  CRISPR gRNA sequence
gtgggaggattgcttgagcc

SEQ ID NO: 14090 - DNA, 20 bp, Artificial
  CRISPR gRNA sequence
tgggaggattgcttgagccc

SEQ ID NO: 14091 - DNA, 20 bp, Artificial
  CRISPR gRNA sequence
ggaggattgcttgagcccag

SEQ ID NO: 14092 - DNA, 20 bp, Artificial
  CRISPR gRNA sequence
ttgcttgagcccaggagctc

SEQ ID NO: 14093 - DNA, 20 bp, Artificial
  CRISPR gRNA sequence
tgagcccaggagctcgagac

SEQ ID NO: 14094 - DNA, 20 bp, Artificial
  CRISPR gRNA sequence
ccaggagctcgagaccagac

SEQ ID NO: 14095 - DNA, 20 bp, Artificial
  CRISPR gRNA sequence
caggagctcgagaccagact

SEQ ID NO: 14096 - DNA, 20 bp, Artificial
  CRISPR gRNA sequence
cgagaccagactgggcaaca

SEQ ID NO: 14097 - DNA, 20 bp, Artificial
  CRISPR gRNA sequence
tctacaaaaaatacaaaaat

SEQ ID NO: 14098 - DNA, 20 bp, Artificial
  CRISPR gRNA sequence
caaaaaatacaaaaattagt

SEQ ID NO: 14099 - DNA, 20 bp, Artificial
  CRISPR gRNA sequence
aaaaaatacaaaaattagtc

SEQ ID NO: 14100 - DNA, 20 bp, Artificial
  CRISPR gRNA sequence
aaatacaaaaattagtcagg

SEQ ID NO: 14101 - DNA, 20 bp, Artificial
  CRISPR gRNA sequence
aatacaaaaattagtcaggt

SEQ ID NO: 14102 - DNA, 20 bp, Artificial
  CRISPR gRNA sequence
atacaaaaattagtcaggtg

SEQ ID NO: 14103 - DNA, 20 bp, Artificial
  CRISPR gRNA sequence
agtcaggtggggcatgcctg

SEQ ID NO: 14104 - DNA, 20 bp, Artificial
  CRISPR gRNA sequence
gtggggcatgcctgtagtcc

SEQ ID NO: 14105 - DNA, 20 bp, Artificial
  CRISPR gRNA sequence
atgcctgtagtcccagctac

SEQ ID NO: 14106 - DNA, 20 bp, Artificial
  CRISPR gRNA sequence
tgcctgtagtcccagctact

SEQ ID NO: 14107 - DNA, 20 bp, Artificial
  CRISPR gRNA sequence
gcctgtagtcccagctacta

SEQ ID NO: 14108 - DNA, 20 bp, Artificial
  CRISPR gRNA sequence
ctgtagtcccagctactagg

SEQ ID NO: 14109 - DNA, 20 bp, Artificial
  CRISPR gRNA sequence
tgtagtcccagctactaggg

SEQ ID NO: 14110 - DNA, 20 bp, Artificial
  CRISPR gRNA sequence
tcccagctactagggaggct

SEQ ID NO: 14111 - DNA, 20 bp, Artificial
  CRISPR gRNA sequence
cccagctactagggaggctg

SEQ ID NO: 14112 - DNA, 20 bp, Artificial
  CRISPR gRNA sequence
agctactagggaggctgagg

SEQ ID NO: 14113 - DNA, 20 bp, Artificial
  CRISPR gRNA sequence
gctactagggaggctgaggt

SEQ ID NO: 14114 - DNA, 20 bp, Artificial
  CRISPR gRNA sequence
tactagggaggctgaggtgg

SEQ ID NO: 14115 - DNA, 20 bp, Artificial
  CRISPR gRNA sequence
actagggaggctgaggtggg

SEQ ID NO: 14116 - DNA, 20 bp, Artificial
  CRISPR gRNA sequence
ctgaggtgggaggatcactt

SEQ ID NO: 14117 - DNA, 20 bp, Artificial
  CRISPR gRNA sequence
gtgggaggatcacttgagcc

SEQ ID NO: 14118 - DNA, 20 bp, Artificial
  CRISPR gRNA sequence
tgggaggatcacttgagcct

SEQ ID NO: 14119 - DNA, 20 bp, Artificial
  CRISPR gRNA sequence
gggaggatcacttgagccta

SEQ ID NO: 14120 - DNA, 20 bp, Artificial
  CRISPR gRNA sequence
gaggatcacttgagcctagg

SEQ ID NO: 14121 - DNA, 20 bp, Artificial
  CRISPR gRNA sequence
aggatcacttgagcctaggg

SEQ ID NO: 14122 - DNA, 20 bp, Artificial
  CRISPR gRNA sequence
cacttgagcctagggaggtt

SEQ ID NO: 14123 - DNA, 20 bp, Artificial
  CRISPR gRNA sequence
acttgagcctagggaggttg

SEQ ID NO: 14124 - DNA, 20 bp, Artificial
  CRISPR gRNA sequence
gcctagggaggttgaggctg

SEQ ID NO: 14125 - DNA, 20 bp, Artificial
  CRISPR gRNA sequence
agggaggttgaggctgtggt

SEQ ID NO: 14126 - DNA, 20 bp, Artificial
  CRISPR gRNA sequence
gtgattgtgccactgaactc

SEQ ID NO: 14127 - DNA, 20 bp, Artificial
  CRISPR gRNA sequence
gtgccactgaactccagcct

SEQ ID NO: 14128 - DNA, 20 bp, Artificial
  CRISPR gRNA sequence
tgccactgaactccagcctg

SEQ ID NO: 14129 - DNA, 20 bp, Artificial
  CRISPR gRNA sequence
gccactgaactccagcctga

SEQ ID NO: 14130 - DNA, 20 bp, Artificial
  CRISPR gRNA sequence
ctgaactccagcctgaggga

SEQ ID NO: 14131 - DNA, 20 bp, Artificial
  CRISPR gRNA sequence
gaactccagcctgagggaca

SEQ ID NO: 14132 - DNA, 20 bp, Artificial
  CRISPR gRNA sequence
tccagcctgagggacagagt

SEQ ID NO: 14133 - DNA, 20 bp, Artificial
  CRISPR gRNA sequence
acagagtaagactctgcctc

SEQ ID NO: 14134 - DNA, 20 bp, Artificial
  CRISPR gRNA sequence
agtaagactctgcctcaaga

SEQ ID NO: 14135 - DNA, 20 bp, Artificial
  CRISPR gRNA sequence
gactctgcctcaagaaagaa

SEQ ID NO: 14136 - DNA, 20 bp, Artificial
  CRISPR gRNA sequence
tgcctcaagaaagaaaagaa

SEQ ID NO: 14137 - DNA, 20 bp, Artificial
  CRISPR gRNA sequence
gcctcaagaaagaaaagaaa

SEQ ID NO: 14138 - DNA, 20 bp, Artificial
  CRISPR gRNA sequence
caagaaagaaaagaaaagga

SEQ ID NO: 14139 - DNA, 20 bp, Artificial
  CRISPR gRNA sequence
aagaaaagaaaaggaaagaa

SEQ ID NO: 14140 - DNA, 20 bp, Artificial
  CRISPR gRNA sequence
agaaaagaaaaggaaagaaa

SEQ ID NO: 14141 - DNA, 20 bp, Artificial
  CRISPR gRNA sequence
aagaaaaggaaagaaaagga

SEQ ID NO: 14142 - DNA, 20 bp, Artificial
  CRISPR gRNA sequence
agaaaaggaaagaaaaggaa

SEQ ID NO: 14143 - DNA, 20 bp, Artificial
  CRISPR gRNA sequence
ggaaagaaaaggaaaggaaa

SEQ ID NO: 14144 - DNA, 20 bp, Artificial
  CRISPR gRNA sequence
aagaaaaggaaaggaaaaag

SEQ ID NO: 14145 - DNA, 20 bp, Artificial
  CRISPR gRNA sequence
agaaaaggaaaggaaaaaga

SEQ ID NO: 14146 - DNA, 20 bp, Artificial
  CRISPR gRNA sequence
aaaggaaaggaaaaagaagg

SEQ ID NO: 14147 - DNA, 20 bp, Artificial
  CRISPR gRNA sequence
aaggaaaggaaaaagaagga

SEQ ID NO: 14148 - DNA, 20 bp, Artificial
  CRISPR gRNA sequence
gaaaggaaaaagaaggaagg

SEQ ID NO: 14149 - DNA, 20 bp, Artificial
  CRISPR gRNA sequence
aaggaaaaagaaggaaggaa

SEQ ID NO: 14150 - DNA, 20 bp, Artificial
  CRISPR gRNA sequence
gaaaaagaaggaaggaagag

SEQ ID NO: 14151 - DNA, 20 bp, Artificial
  CRISPR gRNA sequence
aaaaagaaggaaggaagaga

SEQ ID NO: 14152 - DNA, 20 bp, Artificial
  CRISPR gRNA sequence
aagaaggaaggaagagaagg

SEQ ID NO: 14153 - DNA, 20 bp, Artificial
  CRISPR gRNA sequence
agaaggaaggaagagaagga

SEQ ID NO: 14154 - DNA, 20 bp, Artificial
  CRISPR gRNA sequence
gaaggaaggaagagaaggaa

SEQ ID NO: 14155 - DNA, 20 bp, Artificial
  CRISPR gRNA sequence
aggaaggaagagaaggaagg

SEQ ID NO: 14156 - DNA, 20 bp, Artificial
  CRISPR gRNA sequence
ggaaggaagagaaggaaggg

SEQ ID NO: 14157 - DNA, 20 bp, Artificial
  CRISPR gRNA sequence
gaaggaagagaaggaaggga

SEQ ID NO: 14158 - DNA, 20 bp, Artificial
  CRISPR gRNA sequence
ggaagagaaggaagggaggg

SEQ ID NO: 14159 - DNA, 20 bp, Artificial
  CRISPR gRNA sequence
gaagagaaggaagggaggga

SEQ ID NO: 14160 - DNA, 20 bp, Artificial
  CRISPR gRNA sequence
agaaggaagggagggaagga

SEQ ID NO: 14161 - DNA, 20 bp, Artificial
  CRISPR gRNA sequence
aaggaagggagggaaggaaa

SEQ ID NO: 14162 - DNA, 20 bp, Artificial
  CRISPR gRNA sequence
aagggagggaaggaaagaga

SEQ ID NO: 14163 - DNA, 20 bp, Artificial
  CRISPR gRNA sequence
gagggaaggaaagagaaaga

SEQ ID NO: 14164 - DNA, 20 bp, Artificial
  CRISPR gRNA sequence
gggaaggaaagagaaagaaa

SEQ ID NO: 14165 - DNA, 20 bp, Artificial
  CRISPR gRNA sequence
ggaaagagaaagaaagagaa

SEQ ID NO: 14166 - DNA, 20 bp, Artificial
  CRISPR gRNA sequence
agagaaagaaagagaatgga

SEQ ID NO: 14167 - DNA, 20 bp, Artificial
  CRISPR gRNA sequence
aaagaaagagaatggaaaga

SEQ ID NO: 14168 - DNA, 20 bp, Artificial
  CRISPR gRNA sequence
aaagagaatggaaagaaaga

SEQ ID NO: 14169 - DNA, 20 bp, Artificial
  CRISPR gRNA sequence
agagaatggaaagaaagaaa

SEQ ID NO: 14170 - DNA, 20 bp, Artificial
  CRISPR gRNA sequence
aatggaaagaaagaaagaga

SEQ ID NO: 14171 - DNA, 20 bp, Artificial
  CRISPR gRNA sequence
atggaaagaaagaaagagaa

SEQ ID NO: 14172 - DNA, 20 bp, Artificial
  CRISPR gRNA sequence
ggaaagaaagaaagagaaag

SEQ ID NO: 14173 - DNA, 20 bp, Artificial
  CRISPR gRNA sequence
aaagaaagaaagagaaagga

SEQ ID NO: 14174 - DNA, 20 bp, Artificial
  CRISPR gRNA sequence
aaagaaagagaaaggagaga

SEQ ID NO: 14175 - DNA, 20 bp, Artificial
  CRISPR gRNA sequence
aagaaagagaaaggagagaa

SEQ ID NO: 14176 - DNA, 20 bp, Artificial
  CRISPR gRNA sequence
aagagaaaggagagaaagga

SEQ ID NO: 14177 - DNA, 20 bp, Artificial
  CRISPR gRNA sequence
gaaaggagagaaaggaaaga

SEQ ID NO: 14178 - DNA, 20 bp, Artificial
  CRISPR gRNA sequence
gagagaaaggaaagaaagaa

SEQ ID NO: 14179 - DNA, 20 bp, Artificial
  CRISPR gRNA sequence
agaaaggaaagaaagaaaag

SEQ ID NO: 14180 - DNA, 20 bp, Artificial
  CRISPR gRNA sequence
gaaaggaaagaaagaaaaga

SEQ ID NO: 14181 - DNA, 20 bp, Artificial
  CRISPR gRNA sequence
ggaaagaaagaaaagaagga

SEQ ID NO: 14182 - DNA, 20 bp, Artificial
  CRISPR gRNA sequence
agaaagaaaagaaggaaaga

SEQ ID NO: 14183 - DNA, 20 bp, Artificial
  CRISPR gRNA sequence
agaaaagaaggaaagaaaga

SEQ ID NO: 14184 - DNA, 20 bp, Artificial
  CRISPR gRNA sequence
aagaaggaaagaaagaaaga

SEQ ID NO: 14185 - DNA, 20 bp, Artificial
  CRISPR gRNA sequence
gaaggaaagaaagaaagaaa

SEQ ID NO: 14186 - DNA, 20 bp, Artificial
  CRISPR gRNA sequence
aggaaagaaagaaagaaaga

SEQ ID NO: 14187 - DNA, 20 bp, Artificial
  CRISPR gRNA sequence
gaaagaaagaaagaaagaga

SEQ ID NO: 14188 - DNA, 20 bp, Artificial
  CRISPR gRNA sequence
gaaagaaagaaagagagaga

SEQ ID NO: 14189 - DNA, 20 bp, Artificial
  CRISPR gRNA sequence
aaagaaagaaagagagagat

SEQ ID NO: 14190 - DNA, 20 bp, Artificial
  CRISPR gRNA sequence
aagaaagaaagagagagata

SEQ ID NO: 14191 - DNA, 20 bp, Artificial
  CRISPR gRNA sequence
gaaagaaagagagagatagg

SEQ ID NO: 14192 - DNA, 20 bp, Artificial
  CRISPR gRNA sequence
aaagaaagagagagataggg

SEQ ID NO: 14193 - DNA, 20 bp, Artificial
  CRISPR gRNA sequence
aagaaagagagagataggga

SEQ ID NO: 14194 - DNA, 20 bp, Artificial
  CRISPR gRNA sequence
gaaagagagagatagggagg

SEQ ID NO: 14195 - DNA, 20 bp, Artificial
  CRISPR gRNA sequence
aaagagagagatagggaggg

SEQ ID NO: 14196 - DNA, 20 bp, Artificial
  CRISPR gRNA sequence
gagagagatagggagggagg

SEQ ID NO: 14197 - DNA, 20 bp, Artificial
  CRISPR gRNA sequence
agagagatagggagggagga

SEQ ID NO: 14198 - DNA, 20 bp, Artificial
  CRISPR gRNA sequence
gagatagggagggaggaagg

SEQ ID NO: 14199 - DNA, 20 bp, Artificial
  CRISPR gRNA sequence
agatagggagggaggaagga

SEQ ID NO: 14200 - DNA, 20 bp, Artificial
  CRISPR gRNA sequence
gatagggagggaggaaggaa

SEQ ID NO: 14201 - DNA, 20 bp, Artificial
  CRISPR gRNA sequence
tagggagggaggaaggaagg

SEQ ID NO: 14202 - DNA, 20 bp, Artificial
  CRISPR gRNA sequence
gggagggaggaaggaaggga

SEQ ID NO: 14203 - DNA, 20 bp, Artificial
  CRISPR gRNA sequence
gagggaggaaggaagggaga

SEQ ID NO: 14204 - DNA, 20 bp, Artificial
  CRISPR gRNA sequence
gggaggaaggaagggagaga

SEQ ID NO: 14205 - DNA, 20 bp, Artificial
  CRISPR gRNA sequence
gaggaaggaagggagagaga

SEQ ID NO: 14206 - DNA, 20 bp, Artificial
  CRISPR gRNA sequence
ggaaggaagggagagagaga

SEQ ID NO: 14207 - DNA, 20 bp, Artificial
  CRISPR gRNA sequence
ggaagggagagagagagaga

SEQ ID NO: 14208 - DNA, 20 bp, Artificial
  CRISPR gRNA sequence
gggagagagagagagaaaga

SEQ ID NO: 14209 - DNA, 20 bp, Artificial
  CRISPR gRNA sequence
gagagagagagaaagaaaga

SEQ ID NO: 14210 - DNA, 20 bp, Artificial
  CRISPR gRNA sequence
gagagaaagaaagaaagaaa

SEQ ID NO: 14211 - DNA, 20 bp, Artificial
  CRISPR gRNA sequence
gagaaagaaagaaagaaaca

SEQ ID NO: 14212 - DNA, 20 bp, Artificial
  CRISPR gRNA sequence
gaaagaaagaaagaaacaga

SEQ ID NO: 14213 - DNA, 20 bp, Artificial
  CRISPR gRNA sequence
gaaagaaagaaacagagaga

SEQ ID NO: 14214 - DNA, 20 bp, Artificial
  CRISPR gRNA sequence
aagaaacagagagaaagaaa

SEQ ID NO: 14215 - DNA, 20 bp, Artificial
  CRISPR gRNA sequence
aaacagagagaaagaaaaag

SEQ ID NO: 14216 - DNA, 20 bp, Artificial
  CRISPR gRNA sequence
gagagaaagaaaaagaagaa

SEQ ID NO: 14217 - DNA, 20 bp, Artificial
  CRISPR gRNA sequence
agagaaagaaaaagaagaaa

SEQ ID NO: 14218 - DNA, 20 bp, Artificial
  CRISPR gRNA sequence
gagaaagaaaaagaagaaaa

SEQ ID NO: 14219 - DNA, 20 bp, Artificial
  CRISPR gRNA sequence
agaaagaaaaagaagaaaag

SEQ ID NO: 14220 - DNA, 20 bp, Artificial
  CRISPR gRNA sequence
gaaagaaaaagaagaaaagg

SEQ ID NO: 14221 - DNA, 20 bp, Artificial
  CRISPR gRNA sequence
agaaaaagaagaaaaggggg

SEQ ID NO: 14222 - DNA, 20 bp, Artificial
  CRISPR gRNA sequence
aaaagaagaaaagggggaag

SEQ ID NO: 14223 - DNA, 20 bp, Artificial
  CRISPR gRNA sequence
aaagaagaaaagggggaaga

SEQ ID NO: 14224 - DNA, 20 bp, Artificial
  CRISPR gRNA sequence
aagaagaaaagggggaagaa

SEQ ID NO: 14225 - DNA, 20 bp, Artificial
  CRISPR gRNA sequence
gaagaaaagggggaagaagg

SEQ ID NO: 14226 - DNA, 20 bp, Artificial
  CRISPR gRNA sequence
aagaaaagggggaagaaggg

SEQ ID NO: 14227 - DNA, 20 bp, Artificial
  CRISPR gRNA sequence
agaaaagggggaagaaggga

SEQ ID NO: 14228 - DNA, 20 bp, Artificial
  CRISPR gRNA sequence
aaaagggggaagaagggagg

SEQ ID NO: 14229 - DNA, 20 bp, Artificial
  CRISPR gRNA sequence
aaagggggaagaagggaggg

SEQ ID NO: 14230 - DNA, 20 bp, Artificial
  CRISPR gRNA sequence
aagggggaagaagggaggga

SEQ ID NO: 14231 - DNA, 20 bp, Artificial
  CRISPR gRNA sequence
ggggaagaagggagggaggg

SEQ ID NO: 14232 - DNA, 20 bp, Artificial
  CRISPR gRNA sequence
gggaagaagggagggaggga

SEQ ID NO: 14233 - DNA, 20 bp, Artificial
  CRISPR gRNA sequence
aagaagggagggagggaagg

SEQ ID NO: 14234 - DNA, 20 bp, Artificial
  CRISPR gRNA sequence
agaagggagggagggaagga

SEQ ID NO: 14235 - DNA, 20 bp, Artificial
  CRISPR gRNA sequence
agggagggagggaaggaagg

SEQ ID NO: 14236 - DNA, 20 bp, Artificial
  CRISPR gRNA sequence
gggagggagggaaggaagga

SEQ ID NO: 14237 - DNA, 20 bp, Artificial
  CRISPR gRNA sequence
gagggagggaaggaaggaag

SEQ ID NO: 14238 - DNA, 20 bp, Artificial
  CRISPR gRNA sequence
agggagggaaggaaggaagg

SEQ ID NO: 14239 - DNA, 20 bp, Artificial
  CRISPR gRNA sequence
gggagggaaggaaggaagga

SEQ ID NO: 14240 - DNA, 20 bp, Artificial
  CRISPR gRNA sequence
gagggaaggaaggaaggagg

SEQ ID NO: 14241 - DNA, 20 bp, Artificial
  CRISPR gRNA sequence
agggaaggaaggaaggaggg

SEQ ID NO: 14242 - DNA, 20 bp, Artificial
  CRISPR gRNA sequence
gggaaggaaggaaggaggga

SEQ ID NO: 14243 - DNA, 20 bp, Artificial
  CRISPR gRNA sequence
gaaggaaggaaggagggagg

SEQ ID NO: 14244 - DNA, 20 bp, Artificial
  CRISPR gRNA sequence
aaggaaggaaggagggaggg

SEQ ID NO: 14245 - DNA, 20 bp, Artificial
  CRISPR gRNA sequence
aggaaggaaggagggaggga

SEQ ID NO: 14246 - DNA, 20 bp, Artificial
  CRISPR gRNA sequence
aaggaaggagggagggaggg

SEQ ID NO: 14247 - DNA, 20 bp, Artificial
  CRISPR gRNA sequence
aggaaggagggagggaggga

SEQ ID NO: 14248 - DNA, 20 bp, Artificial
  CRISPR gRNA sequence
aggagggagggagggaagga

SEQ ID NO: 14249 - DNA, 20 bp, Artificial
  CRISPR gRNA sequence
ggagggagggaaggaaagaa

SEQ ID NO: 14250 - DNA, 20 bp, Artificial
  CRISPR gRNA sequence
gagggagggaaggaaagaaa

SEQ ID NO: 14251 - DNA, 20 bp, Artificial
  CRISPR gRNA sequence
ggagggaaggaaagaaaagg

SEQ ID NO: 14252 - DNA, 20 bp, Artificial
  CRISPR gRNA sequence
gagggaaggaaagaaaagga

SEQ ID NO: 14253 - DNA, 20 bp, Artificial
  CRISPR gRNA sequence
agggaaggaaagaaaaggaa

SEQ ID NO: 14254 - DNA, 20 bp, Artificial
  CRISPR gRNA sequence
aaggaaagaaaaggaaggga

SEQ ID NO: 14255 - DNA, 20 bp, Artificial
  CRISPR gRNA sequence
aggaaagaaaaggaagggaa

SEQ ID NO: 14256 - DNA, 20 bp, Artificial
  CRISPR gRNA sequence
aagaaaaggaagggaaagga

SEQ ID NO: 14257 - DNA, 20 bp, Artificial
  CRISPR gRNA sequence
aaaggaagggaaaggaaaga

SEQ ID NO: 14258 - DNA, 20 bp, Artificial
  CRISPR gRNA sequence
aggaagggaaaggaaagaaa

SEQ ID NO: 14259 - DNA, 20 bp, Artificial
  CRISPR gRNA sequence
ggaagggaaaggaaagaaag

SEQ ID NO: 14260 - DNA, 20 bp, Artificial
  CRISPR gRNA sequence
gggaaaggaaagaaagagga

SEQ ID NO: 14261 - DNA, 20 bp, Artificial
  CRISPR gRNA sequence
aaggaaagaaagaggaaaga

SEQ ID NO: 14262 - DNA, 20 bp, Artificial
  CRISPR gRNA sequence
ggaaagaaagaggaaagaaa

SEQ ID NO: 14263 - DNA, 20 bp, Artificial
  CRISPR gRNA sequence
aaagaaagaggaaagaaaga

SEQ ID NO: 14264 - DNA, 20 bp, Artificial
  CRISPR gRNA sequence
aaagaggaaagaaagagaga

SEQ ID NO: 14265 - DNA, 20 bp, Artificial
  CRISPR gRNA sequence
aggaaagaaagagagaaaga

SEQ ID NO: 14266 - DNA, 20 bp, Artificial
  CRISPR gRNA sequence
aagaaagagagaaagaaaga

SEQ ID NO: 14267 - DNA, 20 bp, Artificial
  CRISPR gRNA sequence
aaagagagaaagaaagaaag

SEQ ID NO: 14268 - DNA, 20 bp, Artificial
  CRISPR gRNA sequence
agagaaagaaagaaagaaga

SEQ ID NO: 14269 - DNA, 20 bp, Artificial
  CRISPR gRNA sequence
aaagaaagaaagaagaaaga

SEQ ID NO: 14270 - DNA, 20 bp, Artificial
  CRISPR gRNA sequence
agaaagaagaaagaaagaaa

SEQ ID NO: 14271 - DNA, 20 bp, Artificial
  CRISPR gRNA sequence
agaagaaagaaagaaaaaga

SEQ ID NO: 14272 - DNA, 20 bp, Artificial
  CRISPR gRNA sequence
aagaaagaaagaaaaagaaa

SEQ ID NO: 14273 - DNA, 20 bp, Artificial
  CRISPR gRNA sequence
gaaagaaagaaaaagaaaga

SEQ ID NO: 14274 - DNA, 20 bp, Artificial
  CRISPR gRNA sequence
agaaagaaaaagaaagagag

SEQ ID NO: 14275 - DNA, 20 bp, Artificial
  CRISPR gRNA sequence
agaaaaagaaagagagaaga

SEQ ID NO: 14276 - DNA, 20 bp, Artificial
  CRISPR gRNA sequence
gaaaaagaaagagagaagaa

SEQ ID NO: 14277 - DNA, 20 bp, Artificial
  CRISPR gRNA sequence
aagaaagagagaagaaagga

SEQ ID NO: 14278 - DNA, 20 bp, Artificial
  CRISPR gRNA sequence
aagagagaagaaaggaaaga

SEQ ID NO: 14279 - DNA, 20 bp, Artificial
  CRISPR gRNA sequence
gagaagaaaggaaagaaaga

SEQ ID NO: 14280 - DNA, 20 bp, Artificial
  CRISPR gRNA sequence
gaaaggaaagaaagaaagaa

SEQ ID NO: 14281 - DNA, 20 bp, Artificial
  CRISPR gRNA sequence
aaagaaaagctatattctga

SEQ ID NO: 14282 - DNA, 20 bp, Artificial
  CRISPR gRNA sequence
taataattattgtgctttct

SEQ ID NO: 14283 - DNA, 20 bp, Artificial
  CRISPR gRNA sequence
aataattattgtgctttctt

SEQ ID NO: 14284 - DNA, 20 bp, Artificial
  CRISPR gRNA sequence
ataattattgtgctttcttg

SEQ ID NO: 14285 - DNA, 20 bp, Artificial
  CRISPR gRNA sequence
gctttcttggggcccatgta

SEQ ID NO: 14286 - DNA, 20 bp, Artificial
  CRISPR gRNA sequence
ttcttggggcccatgtatgg

SEQ ID NO: 14287 - DNA, 20 bp, Artificial
  CRISPR gRNA sequence
tcttggggcccatgtatggt

SEQ ID NO: 14288 - DNA, 20 bp, Artificial
  CRISPR gRNA sequence
tatggtgggctgcccctcct

SEQ ID NO: 14289 - DNA, 20 bp, Artificial
  CRISPR gRNA sequence
gctgcccctcctcagtgacc

SEQ ID NO: 14290 - DNA, 20 bp, Artificial
  CRISPR gRNA sequence
ctcagtgacccagacacaac

SEQ ID NO: 14291 - DNA, 20 bp, Artificial
  CRISPR gRNA sequence
ccagacacaactggactccc

SEQ ID NO: 14292 - DNA, 20 bp, Artificial
  CRISPR gRNA sequence
agacacaactggactcccta

SEQ ID NO: 14293 - DNA, 20 bp, Artificial
  CRISPR gRNA sequence
ggactccctagagccttgcc

SEQ ID NO: 14294 - DNA, 20 bp, Artificial
  CRISPR gRNA sequence
gactccctagagccttgcct

SEQ ID NO: 14295 - DNA, 20 bp, Artificial
  CRISPR gRNA sequence
ggtctccatttctgtcaccc

SEQ ID NO: 14296 - DNA, 20 bp, Artificial
  CRISPR gRNA sequence
gtcaccccagcaacactgcc

SEQ ID NO: 14297 - DNA, 20 bp, Artificial
  CRISPR gRNA sequence
tcaccccagcaacactgcct

SEQ ID NO: 14298 - DNA, 20 bp, Artificial
  CRISPR gRNA sequence
caccccagcaacactgccta

SEQ ID NO: 14299 - DNA, 20 bp, Artificial
  CRISPR gRNA sequence
cagcaacactgcctagggtg

SEQ ID NO: 14300 - DNA, 20 bp, Artificial
  CRISPR gRNA sequence
actgcctagggtgtggcccc

SEQ ID NO: 14301 - DNA, 20 bp, Artificial
  CRISPR gRNA sequence
tagggtgtggcccccagccc

SEQ ID NO: 14302 - DNA, 20 bp, Artificial
  CRISPR gRNA sequence
cccccagccctggccacaca

SEQ ID NO: 14303 - DNA, 20 bp, Artificial
  CRISPR gRNA sequence
cccagccctggccacacata

SEQ ID NO: 14304 - DNA, 20 bp, Artificial
  CRISPR gRNA sequence
catagagcaaccaactgtcc

SEQ ID NO: 14305 - DNA, 20 bp, Artificial
  CRISPR gRNA sequence
accaactgtcccagtttgcc

SEQ ID NO: 14306 - DNA, 20 bp, Artificial
  CRISPR gRNA sequence
ccaactgtcccagtttgcct

SEQ ID NO: 14307 - DNA, 20 bp, Artificial
  CRISPR gRNA sequence
gtcccagtttgcctgggact

SEQ ID NO: 14308 - DNA, 20 bp, Artificial
  CRISPR gRNA sequence
tcccagtttgcctgggacta

SEQ ID NO: 14309 - DNA, 20 bp, Artificial
  CRISPR gRNA sequence
cccagtttgcctgggactaa

SEQ ID NO: 14310 - DNA, 20 bp, Artificial
  CRISPR gRNA sequence
ccagtttgcctgggactaag

SEQ ID NO: 14311 - DNA, 20 bp, Artificial
  CRISPR gRNA sequence
cctgggactaaggggcttct

SEQ ID NO: 14312 - DNA, 20 bp, Artificial
  CRISPR gRNA sequence
ctgggactaaggggcttctt

SEQ ID NO: 14313 - DNA, 20 bp, Artificial
  CRISPR gRNA sequence
taaggggcttcttgggatgc

SEQ ID NO: 14314 - DNA, 20 bp, Artificial
  CRISPR gRNA sequence
ttcttgggatgcaagacttt

SEQ ID NO: 14315 - DNA, 20 bp, Artificial
  CRISPR gRNA sequence
aagactttcagttttcaaac

SEQ ID NO: 14316 - DNA, 20 bp, Artificial
  CRISPR gRNA sequence
agactttcagttttcaaacc

SEQ ID NO: 14317 - DNA, 20 bp, Artificial
  CRISPR gRNA sequence
tttcagttttcaaaccagga

SEQ ID NO: 14318 - DNA, 20 bp, Artificial
  CRISPR gRNA sequence
ttttcaaaccaggatagtcc

SEQ ID NO: 14319 - DNA, 20 bp, Artificial
  CRISPR gRNA sequence
tttcaaaccaggatagtccc

SEQ ID NO: 14320 - DNA, 20 bp, Artificial
  CRISPR gRNA sequence
aaaccaggatagtcccaggc

SEQ ID NO: 14321 - DNA, 20 bp, Artificial
  CRISPR gRNA sequence
ccaggatagtcccaggcaag

SEQ ID NO: 14322 - DNA, 20 bp, Artificial
  CRISPR gRNA sequence
caggatagtcccaggcaagt

SEQ ID NO: 14323 - DNA, 20 bp, Artificial
  CRISPR gRNA sequence
aggatagtcccaggcaagta

SEQ ID NO: 14324 - DNA, 20 bp, Artificial
  CRISPR gRNA sequence
gtagggttgctttttcatcc

SEQ ID NO: 14325 - DNA, 20 bp, Artificial
  CRISPR gRNA sequence
tcatcctagctgcacatcaa

SEQ ID NO: 14326 - DNA, 20 bp, Artificial
  CRISPR gRNA sequence
agctgcacatcaaaagctcc

SEQ ID NO: 14327 - DNA, 20 bp, Artificial
  CRISPR gRNA sequence
gctgcacatcaaaagctcct

SEQ ID NO: 14328 - DNA, 20 bp, Artificial
  CRISPR gRNA sequence
agctcctgggaatttcaaaa

SEQ ID NO: 14329 - DNA, 20 bp, Artificial
  CRISPR gRNA sequence
gctcctgggaatttcaaaat

SEQ ID NO: 14330 - DNA, 20 bp, Artificial
  CRISPR gRNA sequence
ctcctgggaatttcaaaatg

SEQ ID NO: 14331 - DNA, 20 bp, Artificial
  CRISPR gRNA sequence
tcctgggaatttcaaaatgg

SEQ ID NO: 14332 - DNA, 20 bp, Artificial
  CRISPR gRNA sequence
gggaatttcaaaatggggga

SEQ ID NO: 14333 - DNA, 20 bp, Artificial
  CRISPR gRNA sequence
aatgggggaaagattctccc

SEQ ID NO: 14334 - DNA, 20 bp, Artificial
  CRISPR gRNA sequence
atgggggaaagattctccct

SEQ ID NO: 14335 - DNA, 20 bp, Artificial
  CRISPR gRNA sequence
tgggggaaagattctccctg

SEQ ID NO: 14336 - DNA, 20 bp, Artificial
  CRISPR gRNA sequence
ggggaaagattctccctggg

SEQ ID NO: 14337 - DNA, 20 bp, Artificial
  CRISPR gRNA sequence
gggaaagattctccctgggg

SEQ ID NO: 14338 - DNA, 20 bp, Artificial
  CRISPR gRNA sequence
tccctggggaggccatccct

SEQ ID NO: 14339 - DNA, 20 bp, Artificial
  CRISPR gRNA sequence
gggaggccatcccttggctg

SEQ ID NO: 14340 - DNA, 20 bp, Artificial
  CRISPR gRNA sequence
aggccatcccttggctgtgg

SEQ ID NO: 14341 - DNA, 20 bp, Artificial
  CRISPR gRNA sequence
ccttggctgtggaagtaaac

SEQ ID NO: 14342 - DNA, 20 bp, Artificial
  CRISPR gRNA sequence
gctgtggaagtaaacaagct

SEQ ID NO: 14343 - DNA, 20 bp, Artificial
  CRISPR gRNA sequence
ctgtggaagtaaacaagctc

SEQ ID NO: 14344 - DNA, 20 bp, Artificial
  CRISPR gRNA sequence
aagtaaacaagctcaggcac

SEQ ID NO: 14345 - DNA, 20 bp, Artificial
  CRISPR gRNA sequence
agtaaacaagctcaggcaca

SEQ ID NO: 14346 - DNA, 20 bp, Artificial
  CRISPR gRNA sequence
gtaaacaagctcaggcacaa

SEQ ID NO: 14347 - DNA, 20 bp, Artificial
  CRISPR gRNA sequence
caggcacaagggacgttgtg

SEQ ID NO: 14348 - DNA, 20 bp, Artificial
  CRISPR gRNA sequence
aagggacgttgtgcagttcc

SEQ ID NO: 14349 - DNA, 20 bp, Artificial
  CRISPR gRNA sequence
cgttgtgcagttcctggcca

SEQ ID NO: 14350 - DNA, 20 bp, Artificial
  CRISPR gRNA sequence
gttgtgcagttcctggccac

SEQ ID NO: 14351 - DNA, 20 bp, Artificial
  CRISPR gRNA sequence
tgtgcagttcctggccacag

SEQ ID NO: 14352 - DNA, 20 bp, Artificial
  CRISPR gRNA sequence
gtgcagttcctggccacagg

SEQ ID NO: 14353 - DNA, 20 bp, Artificial
  CRISPR gRNA sequence
tgcagttcctggccacagga

SEQ ID NO: 14354 - DNA, 20 bp, Artificial
  CRISPR gRNA sequence
ttcctggccacaggagggaa

SEQ ID NO: 14355 - DNA, 20 bp, Artificial
  CRISPR gRNA sequence
tcctggccacaggagggaaa

SEQ ID NO: 14356 - DNA, 20 bp, Artificial
  CRISPR gRNA sequence
caggagggaaaaggactcca

SEQ ID NO: 14357 - DNA, 20 bp, Artificial
  CRISPR gRNA sequence
ggaaaaggactccatagtca

SEQ ID NO: 14358 - DNA, 20 bp, Artificial
  CRISPR gRNA sequence
aaaggactccatagtcatag

SEQ ID NO: 14359 - DNA, 20 bp, Artificial
  CRISPR gRNA sequence
gtcatagtggcatcctccta

SEQ ID NO: 14360 - DNA, 20 bp, Artificial
  CRISPR gRNA sequence
atagtggcatcctcctatgg

SEQ ID NO: 14361 - DNA, 20 bp, Artificial
  CRISPR gRNA sequence
tagtggcatcctcctatgga

SEQ ID NO: 14362 - DNA, 20 bp, Artificial
  CRISPR gRNA sequence
ggcatcctcctatggaaggt

SEQ ID NO: 14363 - DNA, 20 bp, Artificial
  CRISPR gRNA sequence
gcatcctcctatggaaggtt

SEQ ID NO: 14364 - DNA, 20 bp, Artificial
  CRISPR gRNA sequence
catcctcctatggaaggttg

SEQ ID NO: 14365 - DNA, 20 bp, Artificial
  CRISPR gRNA sequence
atggaaggttggggacacat

SEQ ID NO: 14366 - DNA, 20 bp, Artificial
  CRISPR gRNA sequence
tggaaggttggggacacatt

SEQ ID NO: 14367 - DNA, 20 bp, Artificial
  CRISPR gRNA sequence
attgggccttttctgatccc

SEQ ID NO: 14368 - DNA, 20 bp, Artificial
  CRISPR gRNA sequence
cctggcgaaattacaattcc

SEQ ID NO: 14369 - DNA, 20 bp, Artificial
  CRISPR gRNA sequence
gcgaaattacaattcctgga

SEQ ID NO: 14370 - DNA, 20 bp, Artificial
  CRISPR gRNA sequence
cttactcccctctccccact

SEQ ID NO: 14371 - DNA, 20 bp, Artificial
  CRISPR gRNA sequence
ctcattccttatcctcactg

SEQ ID NO: 14372 - DNA, 20 bp, Artificial
  CRISPR gRNA sequence
ccttatcctcactgaagctt

SEQ ID NO: 14373 - DNA, 20 bp, Artificial
  CRISPR gRNA sequence
tcctcactgaagcttcagtg

SEQ ID NO: 14374 - DNA, 20 bp, Artificial
  CRISPR gRNA sequence
agtgcagatatcacctcctc

SEQ ID NO: 14375 - DNA, 20 bp, Artificial
  CRISPR gRNA sequence
gtgcagatatcacctcctcc

SEQ ID NO: 14376 - DNA, 20 bp, Artificial
  CRISPR gRNA sequence
cagatatcacctcctccagg

SEQ ID NO: 14377 - DNA, 20 bp, Artificial
  CRISPR gRNA sequence
gaagtccccctgacctcctc

SEQ ID NO: 14378 - DNA, 20 bp, Artificial
  CRISPR gRNA sequence
agtccccctgacctcctcca

SEQ ID NO: 14379 - DNA, 20 bp, Artificial
  CRISPR gRNA sequence
gtccccctgacctcctccag

SEQ ID NO: 14380 - DNA, 20 bp, Artificial
  CRISPR gRNA sequence
tccccctgacctcctccaga

SEQ ID NO: 14381 - DNA, 20 bp, Artificial
  CRISPR gRNA sequence
ccccctgacctcctccagag

SEQ ID NO: 14382 - DNA, 20 bp, Artificial
  CRISPR gRNA sequence
ccctgacctcctccagaggg

SEQ ID NO: 14383 - DNA, 20 bp, Artificial
  CRISPR gRNA sequence
tcctccagaggggagttgat

SEQ ID NO: 14384 - DNA, 20 bp, Artificial
  CRISPR gRNA sequence
aggggagttgattagactgt

SEQ ID NO: 14385 - DNA, 20 bp, Artificial
  CRISPR gRNA sequence
tgattagactgtcagctcat

SEQ ID NO: 14386 - DNA, 20 bp, Artificial
  CRISPR gRNA sequence
gattagactgtcagctcatg

SEQ ID NO: 14387 - DNA, 20 bp, Artificial
  CRISPR gRNA sequence
agactgtcagctcatgagga

SEQ ID NO: 14388 - DNA, 20 bp, Artificial
  CRISPR gRNA sequence
ctgtcagctcatgaggacag

SEQ ID NO: 14389 - DNA, 20 bp, Artificial
  CRISPR gRNA sequence
gctcatgaggacagcagcct

SEQ ID NO: 14390 - DNA, 20 bp, Artificial
  CRISPR gRNA sequence
gacagcagcctcagtcattc

SEQ ID NO: 14391 - DNA, 20 bp, Artificial
  CRISPR gRNA sequence
gctcaatacctctgttgaat

SEQ ID NO: 14392 - DNA, 20 bp, Artificial
  CRISPR gRNA sequence
tacctctgttgaatgagtga

SEQ ID NO: 14393 - DNA, 20 bp, Artificial
  CRISPR gRNA sequence
acctctgttgaatgagtgat

SEQ ID NO: 14394 - DNA, 20 bp, Artificial
  CRISPR gRNA sequence
atgggaatgaccatgttaac

SEQ ID NO: 14395 - DNA, 20 bp, Artificial
  CRISPR gRNA sequence
tgaccatgttaaccagcaaa

SEQ ID NO: 14396 - DNA, 20 bp, Artificial
  CRISPR gRNA sequence
gaccatgttaaccagcaaac

SEQ ID NO: 14397 - DNA, 20 bp, Artificial
  CRISPR gRNA sequence
taaccagcaaacgggtccat

SEQ ID NO: 14398 - DNA, 20 bp, Artificial
  CRISPR gRNA sequence
ggtccattagcttcaaatct

SEQ ID NO: 14399 - DNA, 20 bp, Artificial
  CRISPR gRNA sequence
gcttcaaatctgagaacctc

SEQ ID NO: 14400 - DNA, 20 bp, Artificial
  CRISPR gRNA sequence
cctccagcatttgcccacac

SEQ ID NO: 14401 - DNA, 20 bp, Artificial
  CRISPR gRNA sequence
tgcccacactggtcactttc

SEQ ID NO: 14402 - DNA, 20 bp, Artificial
  CRISPR gRNA sequence
actggtcactttccagctgc

SEQ ID NO: 14403 - DNA, 20 bp, Artificial
  CRISPR gRNA sequence
ggtcactttccagctgctgg

SEQ ID NO: 14404 - DNA, 20 bp, Artificial
  CRISPR gRNA sequence
gctgctggaagctatttcca

SEQ ID NO: 14405 - DNA, 20 bp, Artificial
  CRISPR gRNA sequence
gctggaagctatttccaaag

SEQ ID NO: 14406 - DNA, 20 bp, Artificial
  CRISPR gRNA sequence
ggaagctatttccaaagtgg

SEQ ID NO: 14407 - DNA, 20 bp, Artificial
  CRISPR gRNA sequence
gaagctatttccaaagtggt

SEQ ID NO: 14408 - DNA, 20 bp, Artificial
  CRISPR gRNA sequence
ctatttccaaagtggtgggc

SEQ ID NO: 14409 - DNA, 20 bp, Artificial
  CRISPR gRNA sequence
atttccaaagtggtgggcaa

SEQ ID NO: 14410 - DNA, 20 bp, Artificial
  CRISPR gRNA sequence
tttccaaagtggtgggcaag

SEQ ID NO: 14411 - DNA, 20 bp, Artificial
  CRISPR gRNA sequence
ttccaaagtggtgggcaaga

SEQ ID NO: 14412 - DNA, 20 bp, Artificial
  CRISPR gRNA sequence
aaagtggtgggcaagagggt

SEQ ID NO: 14413 - DNA, 20 bp, Artificial
  CRISPR gRNA sequence
caagagggtaagaatgattc

SEQ ID NO: 14414 - DNA, 20 bp, Artificial
  CRISPR gRNA sequence
agagggtaagaatgattctg

SEQ ID NO: 14415 - DNA, 20 bp, Artificial
  CRISPR gRNA sequence
tctggagatctatctccatt

SEQ ID NO: 14416 - DNA, 20 bp, Artificial
  CRISPR gRNA sequence
ctggagatctatctccattc

SEQ ID NO: 14417 - DNA, 20 bp, Artificial
  CRISPR gRNA sequence
gagatctatctccattcagg

SEQ ID NO: 14418 - DNA, 20 bp, Artificial
  CRISPR gRNA sequence
tatctccattcaggtggtac

SEQ ID NO: 14419 - DNA, 20 bp, Artificial
  CRISPR gRNA sequence
ccattcaggtggtacaagcc

SEQ ID NO: 14420 - DNA, 20 bp, Artificial
  CRISPR gRNA sequence
tacaagcccagctaatgctg

SEQ ID NO: 14421 - DNA, 20 bp, Artificial
  CRISPR gRNA sequence
acaagcccagctaatgctgc

SEQ ID NO: 14422 - DNA, 20 bp, Artificial
  CRISPR gRNA sequence
caagcccagctaatgctgca

SEQ ID NO: 14423 - DNA, 20 bp, Artificial
  CRISPR gRNA sequence
aagcccagctaatgctgcag

SEQ ID NO: 14424 - DNA, 20 bp, Artificial
  CRISPR gRNA sequence
gctgcaggggaaaccttgcg

SEQ ID NO: 14425 - DNA, 20 bp, Artificial
  CRISPR gRNA sequence
gaaaccttgcgcagacccac

SEQ ID NO: 14426 - DNA, 20 bp, Artificial
  CRISPR gRNA sequence
ccctttgcttacgcaaactc

SEQ ID NO: 14427 - DNA, 20 bp, Artificial
  CRISPR gRNA sequence
tacgcaaactccagtttctt

SEQ ID NO: 14428 - DNA, 20 bp, Artificial
  CRISPR gRNA sequence
acgcaaactccagtttcttt

SEQ ID NO: 14429 - DNA, 20 bp, Artificial
  CRISPR gRNA sequence
cagtttctttaggtcccgaa

SEQ ID NO: 14430 - DNA, 20 bp, Artificial
  CRISPR gRNA sequence
tttctttaggtcccgaacag

SEQ ID NO: 14431 - DNA, 20 bp, Artificial
  CRISPR gRNA sequence
ttctttaggtcccgaacagc

SEQ ID NO: 14432 - DNA, 20 bp, Artificial
  CRISPR gRNA sequence
tctttaggtcccgaacagca

SEQ ID NO: 14433 - DNA, 20 bp, Artificial
  CRISPR gRNA sequence
tttaggtcccgaacagcagg

SEQ ID NO: 14434 - DNA, 20 bp, Artificial
  CRISPR gRNA sequence
ccgaacagcagggagctccc

SEQ ID NO: 14435 - DNA, 20 bp, Artificial
  CRISPR gRNA sequence
gctccccagctgtgtcttcc

SEQ ID NO: 14436 - DNA, 20 bp, Artificial
  CRISPR gRNA sequence
ctccccagctgtgtcttccg

SEQ ID NO: 14437 - DNA, 20 bp, Artificial
  CRISPR gRNA sequence
ttccgaggaacttctcgtcc

SEQ ID NO: 14438 - DNA, 20 bp, Artificial
  CRISPR gRNA sequence
ccgaggaacttctcgtcctg

SEQ ID NO: 14439 - DNA, 20 bp, Artificial
  CRISPR gRNA sequence
gaggaacttctcgtcctgga

SEQ ID NO: 14440 - DNA, 20 bp, Artificial
  CRISPR gRNA sequence
acttctcgtcctggagagaa

SEQ ID NO: 14441 - DNA, 20 bp, Artificial
  CRISPR gRNA sequence
cttctcgtcctggagagaac

SEQ ID NO: 14442 - DNA, 20 bp, Artificial
  CRISPR gRNA sequence
ctggagagaacaggcaatgt

SEQ ID NO: 14443 - DNA, 20 bp, Artificial
  CRISPR gRNA sequence
tggagagaacaggcaatgtt

SEQ ID NO: 14444 - DNA, 20 bp, Artificial
  CRISPR gRNA sequence
ggagagaacaggcaatgtta

SEQ ID NO: 14445 - DNA, 20 bp, Artificial
  CRISPR gRNA sequence
gagagaacaggcaatgttag

SEQ ID NO: 14446 - DNA, 20 bp, Artificial
  CRISPR gRNA sequence
agagaacaggcaatgttagg

SEQ ID NO: 14447 - DNA, 20 bp, Artificial
  CRISPR gRNA sequence
agaacaggcaatgttagggg

SEQ ID NO: 14448 - DNA, 20 bp, Artificial
  CRISPR gRNA sequence
acaggcaatgttagggggag

SEQ ID NO: 14449 - DNA, 20 bp, Artificial
  CRISPR gRNA sequence
caggcaatgttagggggagc

SEQ ID NO: 14450 - DNA, 20 bp, Artificial
  CRISPR gRNA sequence
gagcaggcactgctgtcact

SEQ ID NO: 14451 - DNA, 20 bp, Artificial
  CRISPR gRNA sequence
tgtcactgagcccttaccca

SEQ ID NO: 14452 - DNA, 20 bp, Artificial
  CRISPR gRNA sequence
gtcactgagcccttacccat

SEQ ID NO: 14453 - DNA, 20 bp, Artificial
  CRISPR gRNA sequence
cttacccatgggtcccatga

SEQ ID NO: 14454 - DNA, 20 bp, Artificial
  CRISPR gRNA sequence
gggtcccatgatggctgccc

SEQ ID NO: 14455 - DNA, 20 bp, Artificial
  CRISPR gRNA sequence
ccccagtgccccaaattccc

SEQ ID NO: 14456 - DNA, 20 bp, Artificial
  CRISPR gRNA sequence
cccagtgccccaaattcccc

SEQ ID NO: 14457 - DNA, 20 bp, Artificial
  CRISPR gRNA sequence
ccagtgccccaaattcccca

SEQ ID NO: 14458 - DNA, 20 bp, Artificial
  CRISPR gRNA sequence
cagtgccccaaattccccag

SEQ ID NO: 14459 - DNA, 20 bp, Artificial
  CRISPR gRNA sequence
agtgccccaaattccccagg

SEQ ID NO: 14460 - DNA, 20 bp, Artificial
  CRISPR gRNA sequence
cccagggggattgctttcct

SEQ ID NO: 14461 - DNA, 20 bp, Artificial
  CRISPR gRNA sequence
ccagggggattgctttcctt

SEQ ID NO: 14462 - DNA, 20 bp, Artificial
  CRISPR gRNA sequence
cagggggattgctttccttg

SEQ ID NO: 14463 - DNA, 20 bp, Artificial
  CRISPR gRNA sequence
ttgtccccctcttaaaaaaa

SEQ ID NO: 14464 - DNA, 20 bp, Artificial
  CRISPR gRNA sequence
cttaaaaaaaaagatctgtc

SEQ ID NO: 14465 - DNA, 20 bp, Artificial
  CRISPR gRNA sequence
ttaaaaaaaaagatctgtct

SEQ ID NO: 14466 - DNA, 20 bp, Artificial
  CRISPR gRNA sequence
aaaaaagatctgtctgggtg

SEQ ID NO: 14467 - DNA, 20 bp, Artificial
  CRISPR gRNA sequence
ggtgcggtgcctcgtgactg

SEQ ID NO: 14468 - DNA, 20 bp, Artificial
  CRISPR gRNA sequence
gtgcctcgtgactgtagtcc

SEQ ID NO: 14469 - DNA, 20 bp, Artificial
  CRISPR gRNA sequence
tgactgtagtcccagcactt

SEQ ID NO: 14470 - DNA, 20 bp, Artificial
  CRISPR gRNA sequence
gactgtagtcccagcacttt

SEQ ID NO: 14471 - DNA, 20 bp, Artificial
  CRISPR gRNA sequence
ctgtagtcccagcactttgg

SEQ ID NO: 14472 - DNA, 20 bp, Artificial
  CRISPR gRNA sequence
tgtagtcccagcactttggg

SEQ ID NO: 14473 - DNA, 20 bp, Artificial
  CRISPR gRNA sequence
tcccagcactttgggaggct

SEQ ID NO: 14474 - DNA, 20 bp, Artificial
  CRISPR gRNA sequence
cccagcactttgggaggctg

SEQ ID NO: 14475 - DNA, 20 bp, Artificial
  CRISPR gRNA sequence
agcactttgggaggctgagg

SEQ ID NO: 14476 - DNA, 20 bp, Artificial
  CRISPR gRNA sequence
gcactttgggaggctgaggc

SEQ ID NO: 14477 - DNA, 20 bp, Artificial
  CRISPR gRNA sequence
actttgggaggctgaggcag

SEQ ID NO: 14478 - DNA, 20 bp, Artificial
  CRISPR gRNA sequence
ctttgggaggctgaggcagg

SEQ ID NO: 14479 - DNA, 20 bp, Artificial
  CRISPR gRNA sequence
ctgaggcaggaggattgctt

SEQ ID NO: 14480 - DNA, 20 bp, Artificial
  CRISPR gRNA sequence
tgaggcaggaggattgcttg

SEQ ID NO: 14481 - DNA, 20 bp, Artificial
  CRISPR gRNA sequence
gcaggaggattgcttgaggc

SEQ ID NO: 14482 - DNA, 20 bp, Artificial
  CRISPR gRNA sequence
caggaggattgcttgaggcc

SEQ ID NO: 14483 - DNA, 20 bp, Artificial
  CRISPR gRNA sequence
ggaggattgcttgaggccag

SEQ ID NO: 14484 - DNA, 20 bp, Artificial
  CRISPR gRNA sequence
ttgcttgaggccaggagttc

SEQ ID NO: 14485 - DNA, 20 bp, Artificial
  CRISPR gRNA sequence
tgaggccaggagttcaagac

SEQ ID NO: 14486 - DNA, 20 bp, Artificial
  CRISPR gRNA sequence
ccaggagttcaagaccagcc

SEQ ID NO: 14487 - DNA, 20 bp, Artificial
  CRISPR gRNA sequence
caggagttcaagaccagcct

SEQ ID NO: 14488 - DNA, 20 bp, Artificial
  CRISPR gRNA sequence
caagaccagcctgggcaaca

SEQ ID NO: 14489 - DNA, 20 bp, Artificial
  CRISPR gRNA sequence
accagcctgggcaacatagc

SEQ ID NO: 14490 - DNA, 20 bp, Artificial
  CRISPR gRNA sequence
caaaaacttaaaaaatcatc

SEQ ID NO: 14491 - DNA, 20 bp, Artificial
  CRISPR gRNA sequence
atgacgtgcacctataatcc

SEQ ID NO: 14492 - DNA, 20 bp, Artificial
  CRISPR gRNA sequence
cacctataatcccagctact

SEQ ID NO: 14493 - DNA, 20 bp, Artificial
  CRISPR gRNA sequence
acctataatcccagctactt

SEQ ID NO: 14494 - DNA, 20 bp, Artificial
  CRISPR gRNA sequence
ctataatcccagctacttgg

SEQ ID NO: 14495 - DNA, 20 bp, Artificial
  CRISPR gRNA sequence
tataatcccagctacttggg

SEQ ID NO: 14496 - DNA, 20 bp, Artificial
  CRISPR gRNA sequence
tcccagctacttgggaggct

SEQ ID NO: 14497 - DNA, 20 bp, Artificial
  CRISPR gRNA sequence
cccagctacttgggaggctg

SEQ ID NO: 14498 - DNA, 20 bp, Artificial
  CRISPR gRNA sequence
agctacttgggaggctgagg

SEQ ID NO: 14499 - DNA, 20 bp, Artificial
  CRISPR gRNA sequence
gctacttgggaggctgaggc

SEQ ID NO: 14500 - DNA, 20 bp, Artificial
  CRISPR gRNA sequence
tacttgggaggctgaggcag

SEQ ID NO: 14501 - DNA, 20 bp, Artificial
  CRISPR gRNA sequence
acttgggaggctgaggcagg

SEQ ID NO: 14502 - DNA, 20 bp, Artificial
  CRISPR gRNA sequence
ctgaggcaggaggatcgctt

SEQ ID NO: 14503 - DNA, 20 bp, Artificial
  CRISPR gRNA sequence
gcaggaggatcgcttgagct

SEQ ID NO: 14504 - DNA, 20 bp, Artificial
  CRISPR gRNA sequence
caggaggatcgcttgagctc

SEQ ID NO: 14505 - DNA, 20 bp, Artificial
  CRISPR gRNA sequence
ggaggatcgcttgagctcag

SEQ ID NO: 14506 - DNA, 20 bp, Artificial
  CRISPR gRNA sequence
gcttgagctcaggagttccg

SEQ ID NO: 14507 - DNA, 20 bp, Artificial
  CRISPR gRNA sequence
gctcaggagttccgaagcta

SEQ ID NO: 14508 - DNA, 20 bp, Artificial
  CRISPR gRNA sequence
aggagttccgaagctacagt

SEQ ID NO: 14509 - DNA, 20 bp, Artificial
  CRISPR gRNA sequence
atgatcgcactactgtattc

SEQ ID NO: 14510 - DNA, 20 bp, Artificial
  CRISPR gRNA sequence
cgcactactgtattctagcc

SEQ ID NO: 14511 - DNA, 20 bp, Artificial
  CRISPR gRNA sequence
actactgtattctagcctgg

SEQ ID NO: 14512 - DNA, 20 bp, Artificial
  CRISPR gRNA sequence
gtattctagcctggtagaca

SEQ ID NO: 14513 - DNA, 20 bp, Artificial
  CRISPR gRNA sequence
tctagcctggtagacacagc

SEQ ID NO: 14514 - DNA, 20 bp, Artificial
  CRISPR gRNA sequence
cacagcgagaccctgtcttt

SEQ ID NO: 14515 - DNA, 20 bp, Artificial
  CRISPR gRNA sequence
aataataaaaataaaaataa

SEQ ID NO: 14516 - DNA, 20 bp, Artificial
  CRISPR gRNA sequence
aaaataaaaataaaagatct

SEQ ID NO: 14517 - DNA, 20 bp, Artificial
  CRISPR gRNA sequence
aaataaaaataaaagatctc

SEQ ID NO: 14518 - DNA, 20 bp, Artificial
  CRISPR gRNA sequence
tctcaggactgtatctttca

SEQ ID NO: 14519 - DNA, 20 bp, Artificial
  CRISPR gRNA sequence
actgtatctttcatggaaat

SEQ ID NO: 14520 - DNA, 20 bp, Artificial
  CRISPR gRNA sequence
tctttcatggaaatgagcct

SEQ ID NO: 14521 - DNA, 20 bp, Artificial
  CRISPR gRNA sequence
catggaaatgagcctcagat

SEQ ID NO: 14522 - DNA, 20 bp, Artificial
  CRISPR gRNA sequence
atggaaatgagcctcagatt

SEQ ID NO: 14523 - DNA, 20 bp, Artificial
  CRISPR gRNA sequence
gcctcagattaggcacttac

SEQ ID NO: 14524 - DNA, 20 bp, Artificial
  CRISPR gRNA sequence
gcacttaccagtacctatcc

SEQ ID NO: 14525 - DNA, 20 bp, Artificial
  CRISPR gRNA sequence
ttaccagtacctatcccaga

SEQ ID NO: 14526 - DNA, 20 bp, Artificial
  CRISPR gRNA sequence
acctatcccagacagcactt

SEQ ID NO: 14527 - DNA, 20 bp, Artificial
  CRISPR gRNA sequence
ctatcccagacagcacttaa

SEQ ID NO: 14528 - DNA, 20 bp, Artificial
  CRISPR gRNA sequence
tatcccagacagcacttaag

SEQ ID NO: 14529 - DNA, 20 bp, Artificial
  CRISPR gRNA sequence
cgctcaaacaatgtgtgatg

SEQ ID NO: 14530 - DNA, 20 bp, Artificial
  CRISPR gRNA sequence
gctcaaacaatgtgtgatga

SEQ ID NO: 14531 - DNA, 20 bp, Artificial
  CRISPR gRNA sequence
tgtgatgaaggaatgaatga

SEQ ID NO: 14532 - DNA, 20 bp, Artificial
  CRISPR gRNA sequence
atgaaggaatgaatgaaaga

SEQ ID NO: 14533 - DNA, 20 bp, Artificial
  CRISPR gRNA sequence
agttaacttgttctgtaatc

SEQ ID NO: 14534 - DNA, 20 bp, Artificial
  CRISPR gRNA sequence
atcaagttttgtctgccttc

SEQ ID NO: 14535 - DNA, 20 bp, Artificial
  CRISPR gRNA sequence
tttgtctgccttctggacct

SEQ ID NO: 14536 - DNA, 20 bp, Artificial
  CRISPR gRNA sequence
agctctgccgtctataaatt

SEQ ID NO: 14537 - DNA, 20 bp, Artificial
  CRISPR gRNA sequence
gctctgccgtctataaattt

SEQ ID NO: 14538 - DNA, 20 bp, Artificial
  CRISPR gRNA sequence
cgtctataaatttgggacaa

SEQ ID NO: 14539 - DNA, 20 bp, Artificial
  CRISPR gRNA sequence
cagttgtcctaaatgcctca

SEQ ID NO: 14540 - DNA, 20 bp, Artificial
  CRISPR gRNA sequence
agttgtcctaaatgcctcaa

SEQ ID NO: 14541 - DNA, 20 bp, Artificial
  CRISPR gRNA sequence
gttgtcctaaatgcctcaaa

SEQ ID NO: 14542 - DNA, 20 bp, Artificial
  CRISPR gRNA sequence
gtcctaaatgcctcaaaggg

SEQ ID NO: 14543 - DNA, 20 bp, Artificial
  CRISPR gRNA sequence
ctaaatgcctcaaagggtgg

SEQ ID NO: 14544 - DNA, 20 bp, Artificial
  CRISPR gRNA sequence
aatgcctcaaagggtggcag

SEQ ID NO: 14545 - DNA, 20 bp, Artificial
  CRISPR gRNA sequence
atgcctcaaagggtggcagt

SEQ ID NO: 14546 - DNA, 20 bp, Artificial
  CRISPR gRNA sequence
gtaggtgtcacttctgttac

SEQ ID NO: 14547 - DNA, 20 bp, Artificial
  CRISPR gRNA sequence
taggtgtcacttctgttact

SEQ ID NO: 14548 - DNA, 20 bp, Artificial
  CRISPR gRNA sequence
acttctgttactaggtgcac

SEQ ID NO: 14549 - DNA, 20 bp, Artificial
  CRISPR gRNA sequence
cttctgttactaggtgcaca

SEQ ID NO: 14550 - DNA, 20 bp, Artificial
  CRISPR gRNA sequence
aaggcatccttgttaactcc

SEQ ID NO: 14551 - DNA, 20 bp, Artificial
  CRISPR gRNA sequence
gcatccttgttaactcctag

SEQ ID NO: 14552 - DNA, 20 bp, Artificial
  CRISPR gRNA sequence
catccttgttaactcctaga

SEQ ID NO: 14553 - DNA, 20 bp, Artificial
  CRISPR gRNA sequence
atccttgttaactcctagaa

SEQ ID NO: 14554 - DNA, 20 bp, Artificial
  CRISPR gRNA sequence
tccttgttaactcctagaag

SEQ ID NO: 14555 - DNA, 20 bp, Artificial
  CRISPR gRNA sequence
cttgttaactcctagaaggg

SEQ ID NO: 14556 - DNA, 20 bp, Artificial
  CRISPR gRNA sequence
tgttaactcctagaagggga

SEQ ID NO: 14557 - DNA, 20 bp, Artificial
  CRISPR gRNA sequence
gttaactcctagaaggggag

SEQ ID NO: 14558 - DNA, 20 bp, Artificial
  CRISPR gRNA sequence
agaaggggagaggttctcca

SEQ ID NO: 14559 - DNA, 20 bp, Artificial
  CRISPR gRNA sequence
ggagaggttctccatggctt

SEQ ID NO: 14560 - DNA, 20 bp, Artificial
  CRISPR gRNA sequence
ggttctccatggctttagct

SEQ ID NO: 14561 - DNA, 20 bp, Artificial
  CRISPR gRNA sequence
ccatggctttagctaagact

SEQ ID NO: 14562 - DNA, 20 bp, Artificial
  CRISPR gRNA sequence
catggctttagctaagactt

SEQ ID NO: 14563 - DNA, 20 bp, Artificial
  CRISPR gRNA sequence
gctaagacttgggcacatga

SEQ ID NO: 14564 - DNA, 20 bp, Artificial
  CRISPR gRNA sequence
aagacttgggcacatgatgg

SEQ ID NO: 14565 - DNA, 20 bp, Artificial
  CRISPR gRNA sequence
agacttgggcacatgatggc

SEQ ID NO: 14566 - DNA, 20 bp, Artificial
  CRISPR gRNA sequence
atgatggcaggttttgaatg

SEQ ID NO: 14567 - DNA, 20 bp, Artificial
  CRISPR gRNA sequence
ggcaggttttgaatgcagca

SEQ ID NO: 14568 - DNA, 20 bp, Artificial
  CRISPR gRNA sequence
tgcagcaaagttttcaattc

SEQ ID NO: 14569 - DNA, 20 bp, Artificial
  CRISPR gRNA sequence
cagcaaagttttcaattcta

SEQ ID NO: 14570 - DNA, 20 bp, Artificial
  CRISPR gRNA sequence
agcaaagttttcaattctag

SEQ ID NO: 14571 - DNA, 20 bp, Artificial
  CRISPR gRNA sequence
tcaattctagaggctccgcc

SEQ ID NO: 14572 - DNA, 20 bp, Artificial
  CRISPR gRNA sequence
caattctagaggctccgcct

SEQ ID NO: 14573 - DNA, 20 bp, Artificial
  CRISPR gRNA sequence
ttctagaggctccgcctggg

SEQ ID NO: 14574 - DNA, 20 bp, Artificial
  CRISPR gRNA sequence
agaggctccgcctgggcagc

SEQ ID NO: 14575 - DNA, 20 bp, Artificial
  CRISPR gRNA sequence
ctccgcctgggcagcgagtg

SEQ ID NO: 14576 - DNA, 20 bp, Artificial
  CRISPR gRNA sequence
gcctgggcagcgagtgcagt

SEQ ID NO: 14577 - DNA, 20 bp, Artificial
  CRISPR gRNA sequence
ctgggcagcgagtgcagtga

SEQ ID NO: 14578 - DNA, 20 bp, Artificial
  CRISPR gRNA sequence
gcgagtgcagtgagagactc

SEQ ID NO: 14579 - DNA, 20 bp, Artificial
  CRISPR gRNA sequence
gtgcagtgagagactctggt

SEQ ID NO: 14580 - DNA, 20 bp, Artificial
  CRISPR gRNA sequence
gactctggttagccattgcc

SEQ ID NO: 14581 - DNA, 20 bp, Artificial
  CRISPR gRNA sequence
ctggttagccattgcccaga

SEQ ID NO: 14582 - DNA, 20 bp, Artificial
  CRISPR gRNA sequence
ggttagccattgcccagaaa

SEQ ID NO: 14583 - DNA, 20 bp, Artificial
  CRISPR gRNA sequence
gttagccattgcccagaaag

SEQ ID NO: 14584 - DNA, 20 bp, Artificial
  CRISPR gRNA sequence
ttagccattgcccagaaaga

SEQ ID NO: 14585 - DNA, 20 bp, Artificial
  CRISPR gRNA sequence
cattgcccagaaagagggca

SEQ ID NO: 14586 - DNA, 20 bp, Artificial
  CRISPR gRNA sequence
attgcccagaaagagggcat

SEQ ID NO: 14587 - DNA, 20 bp, Artificial
  CRISPR gRNA sequence
ttgcccagaaagagggcatg

SEQ ID NO: 14588 - DNA, 20 bp, Artificial
  CRISPR gRNA sequence
aaagagggcatggggtgtcc

SEQ ID NO: 14589 - DNA, 20 bp, Artificial
  CRISPR gRNA sequence
agagggcatggggtgtccca

SEQ ID NO: 14590 - DNA, 20 bp, Artificial
  CRISPR gRNA sequence
gagggcatggggtgtcccag

SEQ ID NO: 14591 - DNA, 20 bp, Artificial
  CRISPR gRNA sequence
gcatggggtgtcccagagga

SEQ ID NO: 14592 - DNA, 20 bp, Artificial
  CRISPR gRNA sequence
catggggtgtcccagaggac

SEQ ID NO: 14593 - DNA, 20 bp, Artificial
  CRISPR gRNA sequence
atggggtgtcccagaggaca

SEQ ID NO: 14594 - DNA, 20 bp, Artificial
  CRISPR gRNA sequence
tggggtgtcccagaggacag

SEQ ID NO: 14595 - DNA, 20 bp, Artificial
  CRISPR gRNA sequence
ggggtgtcccagaggacagg

SEQ ID NO: 14596 - DNA, 20 bp, Artificial
  CRISPR gRNA sequence
tcccagaggacagggggcac

SEQ ID NO: 14597 - DNA, 20 bp, Artificial
  CRISPR gRNA sequence
gaaatgcccatgacaaactt

SEQ ID NO: 14598 - DNA, 20 bp, Artificial
  CRISPR gRNA sequence
gcccatgacaaacttgagaa

SEQ ID NO: 14599 - DNA, 20 bp, Artificial
  CRISPR gRNA sequence
cccatgacaaacttgagaat

SEQ ID NO: 14600 - DNA, 20 bp, Artificial
  CRISPR gRNA sequence
ctacatgtcctcaacctgca

SEQ ID NO: 14601 - DNA, 20 bp, Artificial
  CRISPR gRNA sequence
ccgcctctcctctcacctct

SEQ ID NO: 14602 - DNA, 20 bp, Artificial
  CRISPR gRNA sequence
tctcacctctgagtctgcac

SEQ ID NO: 14603 - DNA, 20 bp, Artificial
  CRISPR gRNA sequence
tgagtctgcacaagctttcc

SEQ ID NO: 14604 - DNA, 20 bp, Artificial
  CRISPR gRNA sequence
gagtctgcacaagctttccc

SEQ ID NO: 14605 - DNA, 20 bp, Artificial
  CRISPR gRNA sequence
cccaggtcttccacatcctt

SEQ ID NO: 14606 - DNA, 20 bp, Artificial
  CRISPR gRNA sequence
ccaggtcttccacatccttc

SEQ ID NO: 14607 - DNA, 20 bp, Artificial
  CRISPR gRNA sequence
caggtcttccacatccttca

SEQ ID NO: 14608 - DNA, 20 bp, Artificial
  CRISPR gRNA sequence
ttccacatccttcagggact

SEQ ID NO: 14609 - DNA, 20 bp, Artificial
  CRISPR gRNA sequence
cttcagggacttggctttga

SEQ ID NO: 14610 - DNA, 20 bp, Artificial
  CRISPR gRNA sequence
ttcagggacttggctttgaa

SEQ ID NO: 14611 - DNA, 20 bp, Artificial
  CRISPR gRNA sequence
cttggctttgaaaggctcga

SEQ ID NO: 14612 - DNA, 20 bp, Artificial
  CRISPR gRNA sequence
aacttctcctctgctgcctg

SEQ ID NO: 14613 - DNA, 20 bp, Artificial
  CRISPR gRNA sequence
ttctcctctgctgcctgaag

SEQ ID NO: 14614 - DNA, 20 bp, Artificial
  CRISPR gRNA sequence
ctctgctgcctgaagtagct

SEQ ID NO: 14615 - DNA, 20 bp, Artificial
  CRISPR gRNA sequence
ttggtctccccatgctgctg

SEQ ID NO: 14616 - DNA, 20 bp, Artificial
  CRISPR gRNA sequence
tggtctccccatgctgctgc

SEQ ID NO: 14617 - DNA, 20 bp, Artificial
  CRISPR gRNA sequence
ggtctccccatgctgctgca

SEQ ID NO: 14618 - DNA, 20 bp, Artificial
  CRISPR gRNA sequence
tgctgctgcagggactccca

SEQ ID NO: 14619 - DNA, 20 bp, Artificial
  CRISPR gRNA sequence
acagcgccaccgtgtcgctc

SEQ ID NO: 14620 - DNA, 20 bp, Artificial
  CRISPR gRNA sequence
cagcgccaccgtgtcgctca

SEQ ID NO: 14621 - DNA, 20 bp, Artificial
  CRISPR gRNA sequence
cgccaccgtgtcgctcaagg

SEQ ID NO: 14622 - DNA, 20 bp, Artificial
  CRISPR gRNA sequence
tgtcgctcaaggcagccctg

SEQ ID NO: 14623 - DNA, 20 bp, Artificial
  CRISPR gRNA sequence
tcgctcaaggcagccctgtg

SEQ ID NO: 14624 - DNA, 20 bp, Artificial
  CRISPR gRNA sequence
cgctcaaggcagccctgtgg

SEQ ID NO: 14625 - DNA, 20 bp, Artificial
  CRISPR gRNA sequence
gctcaaggcagccctgtgga

SEQ ID NO: 14626 - DNA, 20 bp, Artificial
  CRISPR gRNA sequence
tcaaggcagccctgtggagg

SEQ ID NO: 14627 - DNA, 20 bp, Artificial
  CRISPR gRNA sequence
caaggcagccctgtggaggg

SEQ ID NO: 14628 - DNA, 20 bp, Artificial
  CRISPR gRNA sequence
aaggcagccctgtggaggga

SEQ ID NO: 14629 - DNA, 20 bp, Artificial
  CRISPR gRNA sequence
gccctgtggagggagggcct

SEQ ID NO: 14630 - DNA, 20 bp, Artificial
  CRISPR gRNA sequence
tggagggagggcctcagacc

SEQ ID NO: 14631 - DNA, 20 bp, Artificial
  CRISPR gRNA sequence
ggagggagggcctcagaccc

SEQ ID NO: 14632 - DNA, 20 bp, Artificial
  CRISPR gRNA sequence
gagggcctcagacccaggca

SEQ ID NO: 14633 - DNA, 20 bp, Artificial
  CRISPR gRNA sequence
tcagacccaggcacggtgac

SEQ ID NO: 14634 - DNA, 20 bp, Artificial
  CRISPR gRNA sequence
cagacccaggcacggtgacc

SEQ ID NO: 14635 - DNA, 20 bp, Artificial
  CRISPR gRNA sequence
cccaggcacggtgaccaggc

SEQ ID NO: 14636 - DNA, 20 bp, Artificial
  CRISPR gRNA sequence
gtgaccaggctagaccttaa

SEQ ID NO: 14637 - DNA, 20 bp, Artificial
  CRISPR gRNA sequence
accaggctagaccttaatgg

SEQ ID NO: 14638 - DNA, 20 bp, Artificial
  CRISPR gRNA sequence
ccaggctagaccttaatgga

SEQ ID NO: 14639 - DNA, 20 bp, Artificial
  CRISPR gRNA sequence
caggctagaccttaatggaa

SEQ ID NO: 14640 - DNA, 20 bp, Artificial
  CRISPR gRNA sequence
gctagaccttaatggaaggg

SEQ ID NO: 14641 - DNA, 20 bp, Artificial
  CRISPR gRNA sequence
aatggaagggcagctccatg

SEQ ID NO: 14642 - DNA, 20 bp, Artificial
  CRISPR gRNA sequence
atggaagggcagctccatga

SEQ ID NO: 14643 - DNA, 20 bp, Artificial
  CRISPR gRNA sequence
tggaagggcagctccatgaa

SEQ ID NO: 14644 - DNA, 20 bp, Artificial
  CRISPR gRNA sequence
attaaaatactttctttcct

SEQ ID NO: 14645 - DNA, 20 bp, Artificial
  CRISPR gRNA sequence
agctcaacctctacctttcc

SEQ ID NO: 14646 - DNA, 20 bp, Artificial
  CRISPR gRNA sequence
caacctctacctttcccaga

SEQ ID NO: 14647 - DNA, 20 bp, Artificial
  CRISPR gRNA sequence
aaagccttccatgaccactc

SEQ ID NO: 14648 - DNA, 20 bp, Artificial
  CRISPR gRNA sequence
ctactttctcacaactcaca

SEQ ID NO: 14649 - DNA, 20 bp, Artificial
  CRISPR gRNA sequence
ctttctcacaactcacacag

SEQ ID NO: 14650 - DNA, 20 bp, Artificial
  CRISPR gRNA sequence
ttttctttccctttttgctt

SEQ ID NO: 14651 - DNA, 20 bp, Artificial
  CRISPR gRNA sequence
tccctttttgcttcggctac

SEQ ID NO: 14652 - DNA, 20 bp, Artificial
  CRISPR gRNA sequence
ccctttttgcttcggctacc

SEQ ID NO: 14653 - DNA, 20 bp, Artificial
  CRISPR gRNA sequence
tttttgcttcggctaccagg

SEQ ID NO: 14654 - DNA, 20 bp, Artificial
  CRISPR gRNA sequence
gaagctcactgctaaattat

SEQ ID NO: 14655 - DNA, 20 bp, Artificial
  CRISPR gRNA sequence
aaattattggcacaattatg

SEQ ID NO: 14656 - DNA, 20 bp, Artificial
  CRISPR gRNA sequence
aattattggcacaattatgt

SEQ ID NO: 14657 - DNA, 20 bp, Artificial
  CRISPR gRNA sequence
cacaattatgtaggacctta

SEQ ID NO: 14658 - DNA, 20 bp, Artificial
  CRISPR gRNA sequence
ttatgtaggaccttacagct

SEQ ID NO: 14659 - DNA, 20 bp, Artificial
  CRISPR gRNA sequence
tatgtaggaccttacagctt

SEQ ID NO: 14660 - DNA, 20 bp, Artificial
  CRISPR gRNA sequence
aggaccttacagcttgggta

SEQ ID NO: 14661 - DNA, 20 bp, Artificial
  CRISPR gRNA sequence
cagcttgggtaaagtatgtt

SEQ ID NO: 14662 - DNA, 20 bp, Artificial
  CRISPR gRNA sequence
agcttgggtaaagtatgttt

SEQ ID NO: 14663 - DNA, 20 bp, Artificial
  CRISPR gRNA sequence
gcttgggtaaagtatgttta

SEQ ID NO: 14664 - DNA, 20 bp, Artificial
  CRISPR gRNA sequence
cttgggtaaagtatgtttag

SEQ ID NO: 14665 - DNA, 20 bp, Artificial
  CRISPR gRNA sequence
ttgggtaaagtatgtttagg

SEQ ID NO: 14666 - DNA, 20 bp, Artificial
  CRISPR gRNA sequence
agtatgtttagggggaaata

SEQ ID NO: 14667 - DNA, 20 bp, Artificial
  CRISPR gRNA sequence
atgtttagggggaaatatgg

SEQ ID NO: 14668 - DNA, 20 bp, Artificial
  CRISPR gRNA sequence
gaaatatggaagcaatcctc

SEQ ID NO: 14669 - DNA, 20 bp, Artificial
  CRISPR gRNA sequence
gaagcaatcctctggcgatt

SEQ ID NO: 14670 - DNA, 20 bp, Artificial
  CRISPR gRNA sequence
gcgattaagctgaaatgctc

SEQ ID NO: 14671 - DNA, 20 bp, Artificial
  CRISPR gRNA sequence
attaagctgaaatgctcaag

SEQ ID NO: 14672 - DNA, 20 bp, Artificial
  CRISPR gRNA sequence
tgaaatgctcaagcagattg

SEQ ID NO: 14673 - DNA, 20 bp, Artificial
  CRISPR gRNA sequence
cgacttaatgaaaccaaatt

SEQ ID NO: 14674 - DNA, 20 bp, Artificial
  CRISPR gRNA sequence
gacttaatgaaaccaaatta

SEQ ID NO: 14675 - DNA, 20 bp, Artificial
  CRISPR gRNA sequence
tgaaaccaaattaaggaatt

SEQ ID NO: 14676 - DNA, 20 bp, Artificial
  CRISPR gRNA sequence
gaatttagccttcatcctga

SEQ ID NO: 14677 - DNA, 20 bp, Artificial
  CRISPR gRNA sequence
tttagccttcatcctgacag

SEQ ID NO: 14678 - DNA, 20 bp, Artificial
  CRISPR gRNA sequence
agccttcatcctgacagtgg

SEQ ID NO: 14679 - DNA, 20 bp, Artificial
  CRISPR gRNA sequence
ccttcatcctgacagtggtg

SEQ ID NO: 14680 - DNA, 20 bp, Artificial
  CRISPR gRNA sequence
acagtggtggagtgtccctg

SEQ ID NO: 14681 - DNA, 20 bp, Artificial
  CRISPR gRNA sequence
cagtggtggagtgtccctga

SEQ ID NO: 14682 - DNA, 20 bp, Artificial
  CRISPR gRNA sequence
gagtgtccctgaaggattgt

SEQ ID NO: 14683 - DNA, 20 bp, Artificial
  CRISPR gRNA sequence
tgtccctgaaggattgtaag

SEQ ID NO: 14684 - DNA, 20 bp, Artificial
  CRISPR gRNA sequence
gtccctgaaggattgtaagc

SEQ ID NO: 14685 - DNA, 20 bp, Artificial
  CRISPR gRNA sequence
tccctgaaggattgtaagca

SEQ ID NO: 14686 - DNA, 20 bp, Artificial
  CRISPR gRNA sequence
tgaaggattgtaagcaggga

SEQ ID NO: 14687 - DNA, 20 bp, Artificial
  CRISPR gRNA sequence
gaaggattgtaagcagggat

SEQ ID NO: 14688 - DNA, 20 bp, Artificial
  CRISPR gRNA sequence
aagcagggatgggatacaat

SEQ ID NO: 14689 - DNA, 20 bp, Artificial
  CRISPR gRNA sequence
gatgggatacaatcagattc

SEQ ID NO: 14690 - DNA, 20 bp, Artificial
  CRISPR gRNA sequence
tacaatcagattcaagttct

SEQ ID NO: 14691 - DNA, 20 bp, Artificial
  CRISPR gRNA sequence
aatcagattcaagttctgag

SEQ ID NO: 14692 - DNA, 20 bp, Artificial
  CRISPR gRNA sequence
gattcaagttctgagaagat

SEQ ID NO: 14693 - DNA, 20 bp, Artificial
  CRISPR gRNA sequence
aagttctgagaagattggtc

SEQ ID NO: 14694 - DNA, 20 bp, Artificial
  CRISPR gRNA sequence
tctggttgctgaatacaaaa

SEQ ID NO: 14695 - DNA, 20 bp, Artificial
  CRISPR gRNA sequence
tggttgctgaatacaaaatg

SEQ ID NO: 14696 - DNA, 20 bp, Artificial
  CRISPR gRNA sequence
ttgctgaatacaaaatggag

SEQ ID NO: 14697 - DNA, 20 bp, Artificial
  CRISPR gRNA sequence
ctgaatacaaaatggagtgg

SEQ ID NO: 14698 - DNA, 20 bp, Artificial
  CRISPR gRNA sequence
gaatacaaaatggagtggaa

SEQ ID NO: 14699 - DNA, 20 bp, Artificial
  CRISPR gRNA sequence
aatacaaaatggagtggaag

SEQ ID NO: 14700 - DNA, 20 bp, Artificial
  CRISPR gRNA sequence
tacaaaatggagtggaagag

SEQ ID NO: 14701 - DNA, 20 bp, Artificial
  CRISPR gRNA sequence
caaaatggagtggaagagga

SEQ ID NO: 14702 - DNA, 20 bp, Artificial
  CRISPR gRNA sequence
tggagtggaagaggagagaa

SEQ ID NO: 14703 - DNA, 20 bp, Artificial
  CRISPR gRNA sequence
gagtggaagaggagagaatg

SEQ ID NO: 14704 - DNA, 20 bp, Artificial
  CRISPR gRNA sequence
agtggaagaggagagaatgg

SEQ ID NO: 14705 - DNA, 20 bp, Artificial
  CRISPR gRNA sequence
ggaagaggagagaatggagg

SEQ ID NO: 14706 - DNA, 20 bp, Artificial
  CRISPR gRNA sequence
aagaggagagaatggaggca

SEQ ID NO: 14707 - DNA, 20 bp, Artificial
  CRISPR gRNA sequence
gaggagagaatggaggcaga

SEQ ID NO: 14708 - DNA, 20 bp, Artificial
  CRISPR gRNA sequence
agaatggaggcagagagtcc

SEQ ID NO: 14709 - DNA, 20 bp, Artificial
  CRISPR gRNA sequence
gaatggaggcagagagtcca

SEQ ID NO: 14710 - DNA, 20 bp, Artificial
  CRISPR gRNA sequence
aatggaggcagagagtccaa

SEQ ID NO: 14711 - DNA, 20 bp, Artificial
  CRISPR gRNA sequence
atggaggcagagagtccaag

SEQ ID NO: 14712 - DNA, 20 bp, Artificial
  CRISPR gRNA sequence
ggaggcagagagtccaaggg

SEQ ID NO: 14713 - DNA, 20 bp, Artificial
  CRISPR gRNA sequence
gaggcagagagtccaagggg

SEQ ID NO: 14714 - DNA, 20 bp, Artificial
  CRISPR gRNA sequence
gagagtccaaggggaggcca

SEQ ID NO: 14715 - DNA, 20 bp, Artificial
  CRISPR gRNA sequence
ggaggccatggctttactct

SEQ ID NO: 14716 - DNA, 20 bp, Artificial
  CRISPR gRNA sequence
catggctttactcttagcat

SEQ ID NO: 14717 - DNA, 20 bp, Artificial
  CRISPR gRNA sequence
ttactcttagcataagaaaa

SEQ ID NO: 14718 - DNA, 20 bp, Artificial
  CRISPR gRNA sequence
ctcttagcataagaaaacgg

SEQ ID NO: 14719 - DNA, 20 bp, Artificial
  CRISPR gRNA sequence
taagaaaacggtggcgtgct

SEQ ID NO: 14720 - DNA, 20 bp, Artificial
  CRISPR gRNA sequence
aagaaaacggtggcgtgctc

SEQ ID NO: 14721 - DNA, 20 bp, Artificial
  CRISPR gRNA sequence
agaaaacggtggcgtgctca

SEQ ID NO: 14722 - DNA, 20 bp, Artificial
  CRISPR gRNA sequence
gaaaacggtggcgtgctcag

SEQ ID NO: 14723 - DNA, 20 bp, Artificial
  CRISPR gRNA sequence
aaaacggtggcgtgctcagg

SEQ ID NO: 14724 - DNA, 20 bp, Artificial
  CRISPR gRNA sequence
acggtggcgtgctcaggggg

SEQ ID NO: 14725 - DNA, 20 bp, Artificial
  CRISPR gRNA sequence
tggcgtgctcagggggtgga

SEQ ID NO: 14726 - DNA, 20 bp, Artificial
  CRISPR gRNA sequence
ggaaagaataaaacaaattt

SEQ ID NO: 14727 - DNA, 20 bp, Artificial
  CRISPR gRNA sequence
gaataaaacaaatttgagcc

SEQ ID NO: 14728 - DNA, 20 bp, Artificial
  CRISPR gRNA sequence
aataaaacaaatttgagccc

SEQ ID NO: 14729 - DNA, 20 bp, Artificial
  CRISPR gRNA sequence
aaacaaatttgagcccaggt

SEQ ID NO: 14730 - DNA, 20 bp, Artificial
  CRISPR gRNA sequence
atttgagcccaggtcagtct

SEQ ID NO: 14731 - DNA, 20 bp, Artificial
  CRISPR gRNA sequence
cccaggtcagtctcagattc

SEQ ID NO: 14732 - DNA, 20 bp, Artificial
  CRISPR gRNA sequence
ctcagattctagacataccc

SEQ ID NO: 14733 - DNA, 20 bp, Artificial
  CRISPR gRNA sequence
tctagacataccccagtgac

SEQ ID NO: 14734 - DNA, 20 bp, Artificial
  CRISPR gRNA sequence
ataccccagtgactggcaca

SEQ ID NO: 14735 - DNA, 20 bp, Artificial
  CRISPR gRNA sequence
ccccagtgactggcacatgg

SEQ ID NO: 14736 - DNA, 20 bp, Artificial
  CRISPR gRNA sequence
cccagtgactggcacatggc

SEQ ID NO: 14737 - DNA, 20 bp, Artificial
  CRISPR gRNA sequence
gcgggccttcaaatattgac

SEQ ID NO: 14738 - DNA, 20 bp, Artificial
  CRISPR gRNA sequence
cgggccttcaaatattgact

SEQ ID NO: 14739 - DNA, 20 bp, Artificial
  CRISPR gRNA sequence
ggccttcaaatattgactgg

SEQ ID NO: 14740 - DNA, 20 bp, Artificial
  CRISPR gRNA sequence
attgcctctcacttgctgtg

SEQ ID NO: 14741 - DNA, 20 bp, Artificial
  CRISPR gRNA sequence
cctctcacttgctgtgtggc

SEQ ID NO: 14742 - DNA, 20 bp, Artificial
  CRISPR gRNA sequence
ctcacttgctgtgtggcaag

SEQ ID NO: 14743 - DNA, 20 bp, Artificial
  CRISPR gRNA sequence
gcaagtggctgcccctctct

SEQ ID NO: 14744 - DNA, 20 bp, Artificial
  CRISPR gRNA sequence
caacatcctcatcttaaaaa

SEQ ID NO: 14745 - DNA, 20 bp, Artificial
  CRISPR gRNA sequence
acatcctcatcttaaaaatg

SEQ ID NO: 14746 - DNA, 20 bp, Artificial
  CRISPR gRNA sequence
atcctcatcttaaaaatgga

SEQ ID NO: 14747 - DNA, 20 bp, Artificial
  CRISPR gRNA sequence
agaatccattctgccccacc

SEQ ID NO: 14748 - DNA, 20 bp, Artificial
  CRISPR gRNA sequence
ccggctgctctgcatactaa

SEQ ID NO: 14749 - DNA, 20 bp, Artificial
  CRISPR gRNA sequence
ggctgctctgcatactaaaa

SEQ ID NO: 14750 - DNA, 20 bp, Artificial
  CRISPR gRNA sequence
gcatactaaaagagacccca

SEQ ID NO: 14751 - DNA, 20 bp, Artificial
  CRISPR gRNA sequence
atactaaaagagaccccaca

SEQ ID NO: 14752 - DNA, 20 bp, Artificial
  CRISPR gRNA sequence
aaagagaccccacagagcac

SEQ ID NO: 14753 - DNA, 20 bp, Artificial
  CRISPR gRNA sequence
aagagaccccacagagcact

SEQ ID NO: 14754 - DNA, 20 bp, Artificial
  CRISPR gRNA sequence
accccacagagcactgggct

SEQ ID NO: 14755 - DNA, 20 bp, Artificial
  CRISPR gRNA sequence
agagcactgggcttggcacc

SEQ ID NO: 14756 - DNA, 20 bp, Artificial
  CRISPR gRNA sequence
tgggcttggcaccaagaccg

SEQ ID NO: 14757 - DNA, 20 bp, Artificial
  CRISPR gRNA sequence
ccgcagttaatgcccaacac

SEQ ID NO: 14758 - DNA, 20 bp, Artificial
  CRISPR gRNA sequence
cgcagttaatgcccaacaca

SEQ ID NO: 14759 - DNA, 20 bp, Artificial
  CRISPR gRNA sequence
cacaaggatgtctcttcccc

SEQ ID NO: 14760 - DNA, 20 bp, Artificial
  CRISPR gRNA sequence
gcccctcaccccacctgaaa

SEQ ID NO: 14761 - DNA, 20 bp, Artificial
  CRISPR gRNA sequence
cccctcaccccacctgaaac

SEQ ID NO: 14762 - DNA, 20 bp, Artificial
  CRISPR gRNA sequence
cccacctgaaacgggtgaca

SEQ ID NO: 14763 - DNA, 20 bp, Artificial
  CRISPR gRNA sequence
ctgaaacgggtgacacagct

SEQ ID NO: 14764 - DNA, 20 bp, Artificial
  CRISPR gRNA sequence
gtgacacagctgagtcccac

SEQ ID NO: 14765 - DNA, 20 bp, Artificial
  CRISPR gRNA sequence
tgacacagctgagtcccacg

SEQ ID NO: 14766 - DNA, 20 bp, Artificial
  CRISPR gRNA sequence
tcccacgaggctccccaatc

SEQ ID NO: 14767 - DNA, 20 bp, Artificial
  CRISPR gRNA sequence
ccacgaggctccccaatcca

SEQ ID NO: 14768 - DNA, 20 bp, Artificial
  CRISPR gRNA sequence
cacgaggctccccaatccag

SEQ ID NO: 14769 - DNA, 20 bp, Artificial
  CRISPR gRNA sequence
acgaggctccccaatccaga

SEQ ID NO: 14770 - DNA, 20 bp, Artificial
  CRISPR gRNA sequence
cgaggctccccaatccagag

SEQ ID NO: 14771 - DNA, 20 bp, Artificial
  CRISPR gRNA sequence
caatccagaggggcaaatgc

SEQ ID NO: 14772 - DNA, 20 bp, Artificial
  CRISPR gRNA sequence
aggggcaaatgccagtgctg

SEQ ID NO: 14773 - DNA, 20 bp, Artificial
  CRISPR gRNA sequence
gggcaaatgccagtgctgcg

SEQ ID NO: 14774 - DNA, 20 bp, Artificial
  CRISPR gRNA sequence
ggcaaatgccagtgctgcgg

SEQ ID NO: 14775 - DNA, 20 bp, Artificial
  CRISPR gRNA sequence
atgccagtgctgcggaggtc

SEQ ID NO: 14776 - DNA, 20 bp, Artificial
  CRISPR gRNA sequence
tgccagtgctgcggaggtcc

SEQ ID NO: 14777 - DNA, 20 bp, Artificial
  CRISPR gRNA sequence
gccagtgctgcggaggtcca

SEQ ID NO: 14778 - DNA, 20 bp, Artificial
  CRISPR gRNA sequence
cagtgctgcggaggtccagg

SEQ ID NO: 14779 - DNA, 20 bp, Artificial
  CRISPR gRNA sequence
tgctgcggaggtccagggag

SEQ ID NO: 14780 - DNA, 20 bp, Artificial
  CRISPR gRNA sequence
ggaggtccagggagaagtct

SEQ ID NO: 14781 - DNA, 20 bp, Artificial
  CRISPR gRNA sequence
agtcttggcccgccgcctcc

SEQ ID NO: 14782 - DNA, 20 bp, Artificial
  CRISPR gRNA sequence
gtcttggcccgccgcctcca

SEQ ID NO: 14783 - DNA, 20 bp, Artificial
  CRISPR gRNA sequence
gccgcctccaaggccttgcc

SEQ ID NO: 14784 - DNA, 20 bp, Artificial
  CRISPR gRNA sequence
cttgcccagtacatgtgcat

SEQ ID NO: 14785 - DNA, 20 bp, Artificial
  CRISPR gRNA sequence
ttgcccagtacatgtgcatc

SEQ ID NO: 14786 - DNA, 20 bp, Artificial
  CRISPR gRNA sequence
gcccagtacatgtgcatcag

SEQ ID NO: 14787 - DNA, 20 bp, Artificial
  CRISPR gRNA sequence
cccagtacatgtgcatcagg

SEQ ID NO: 14788 - DNA, 20 bp, Artificial
  CRISPR gRNA sequence
acatgtgcatcaggaggcgt

SEQ ID NO: 14789 - DNA, 20 bp, Artificial
  CRISPR gRNA sequence
catgtgcatcaggaggcgtg

SEQ ID NO: 14790 - DNA, 20 bp, Artificial
  CRISPR gRNA sequence
gtgcatcaggaggcgtgagg

SEQ ID NO: 14791 - DNA, 20 bp, Artificial
  CRISPR gRNA sequence
tgcatcaggaggcgtgaggc

SEQ ID NO: 14792 - DNA, 20 bp, Artificial
  CRISPR gRNA sequence
ggaggcgtgaggcgggtgcc

SEQ ID NO: 14793 - DNA, 20 bp, Artificial
  CRISPR gRNA sequence
cgtgaggcgggtgcccagaa

SEQ ID NO: 14794 - DNA, 20 bp, Artificial
  CRISPR gRNA sequence
tgaggcgggtgcccagaaaa

SEQ ID NO: 14795 - DNA, 20 bp, Artificial
  CRISPR gRNA sequence
aggcgggtgcccagaaaaga

SEQ ID NO: 14796 - DNA, 20 bp, Artificial
  CRISPR gRNA sequence
ggcgggtgcccagaaaagag

SEQ ID NO: 14797 - DNA, 20 bp, Artificial
  CRISPR gRNA sequence
gggtgcccagaaaagagagg

SEQ ID NO: 14798 - DNA, 20 bp, Artificial
  CRISPR gRNA sequence
gcccagaaaagagaggcggc

SEQ ID NO: 14799 - DNA, 20 bp, Artificial
  CRISPR gRNA sequence
cccagaaaagagaggcggcc

SEQ ID NO: 14800 - DNA, 20 bp, Artificial
  CRISPR gRNA sequence
ccagaaaagagaggcggccg

SEQ ID NO: 14801 - DNA, 20 bp, Artificial
  CRISPR gRNA sequence
agaaaagagaggcggccggg

SEQ ID NO: 14802 - DNA, 20 bp, Artificial
  CRISPR gRNA sequence
taccacgtgctgccaaattc

SEQ ID NO: 14803 - DNA, 20 bp, Artificial
  CRISPR gRNA sequence
ctgccaaattccagcctcct

SEQ ID NO: 14804 - DNA, 20 bp, Artificial
  CRISPR gRNA sequence
ttccagcctcctcggcctcg

SEQ ID NO: 14805 - DNA, 20 bp, Artificial
  CRISPR gRNA sequence
tccagcctcctcggcctcgt

SEQ ID NO: 14806 - DNA, 20 bp, Artificial
  CRISPR gRNA sequence
cctcctcggcctcgtgggcg

SEQ ID NO: 14807 - DNA, 20 bp, Artificial
  CRISPR gRNA sequence
tcggcctcgtgggcgcagtg

SEQ ID NO: 14808 - DNA, 20 bp, Artificial
  CRISPR gRNA sequence
gcctcgtgggcgcagtgcag

SEQ ID NO: 14809 - DNA, 20 bp, Artificial
  CRISPR gRNA sequence
tgggcgcagtgcagcagctc

SEQ ID NO: 14810 - DNA, 20 bp, Artificial
  CRISPR gRNA sequence
gcgcagtgcagcagctccag

SEQ ID NO: 14811 - DNA, 20 bp, Artificial
  CRISPR gRNA sequence
tccagcagctgccgcgcccg

SEQ ID NO: 14812 - DNA, 20 bp, Artificial
  CRISPR gRNA sequence
tgccgcgcccgcagtgtccc

SEQ ID NO: 14813 - DNA, 20 bp, Artificial
  CRISPR gRNA sequence
gcccgcagtgtccccggctg

SEQ ID NO: 14814 - DNA, 20 bp, Artificial
  CRISPR gRNA sequence
gtccccggctgcagccgctt

SEQ ID NO: 14815 - DNA, 20 bp, Artificial
  CRISPR gRNA sequence
tccccggctgcagccgcttc

SEQ ID NO: 14816 - DNA, 20 bp, Artificial
  CRISPR gRNA sequence
agccgcttcaggtacctcgc

SEQ ID NO: 14817 - DNA, 20 bp, Artificial
  CRISPR gRNA sequence
ccttctgcttcctgtccacc

SEQ ID NO: 14818 - DNA, 20 bp, Artificial
  CRISPR gRNA sequence
cttctgcttcctgtccaccg

SEQ ID NO: 14819 - DNA, 20 bp, Artificial
  CRISPR gRNA sequence
ctgcttcctgtccaccgagg

SEQ ID NO: 14820 - DNA, 20 bp, Artificial
  CRISPR gRNA sequence
tccaccgaggcagccgccga

SEQ ID NO: 14821 - DNA, 20 bp, Artificial
  CRISPR gRNA sequence
gaggcagccgccgatggccc

SEQ ID NO: 14822 - DNA, 20 bp, Artificial
  CRISPR gRNA sequence
gcagccgccgatggcccgag

SEQ ID NO: 14823 - DNA, 20 bp, Artificial
  CRISPR gRNA sequence
cagccgccgatggcccgagt

SEQ ID NO: 14824 - DNA, 20 bp, Artificial
  CRISPR gRNA sequence
agccgccgatggcccgagta

SEQ ID NO: 14825 - DNA, 20 bp, Artificial
  CRISPR gRNA sequence
gatggcccgagtagggctcc

SEQ ID NO: 14826 - DNA, 20 bp, Artificial
  CRISPR gRNA sequence
atggcccgagtagggctccc

SEQ ID NO: 14827 - DNA, 20 bp, Artificial
  CRISPR gRNA sequence
gcccgagtagggctcccagg

SEQ ID NO: 14828 - DNA, 20 bp, Artificial
  CRISPR gRNA sequence
cgagtagggctcccaggcag

SEQ ID NO: 14829 - DNA, 20 bp, Artificial
  CRISPR gRNA sequence
gagtagggctcccaggcagc

SEQ ID NO: 14830 - DNA, 20 bp, Artificial
  CRISPR gRNA sequence
tagggctcccaggcagcggg

SEQ ID NO: 14831 - DNA, 20 bp, Artificial
  CRISPR gRNA sequence
agggctcccaggcagcgggc

SEQ ID NO: 14832 - DNA, 20 bp, Artificial
  CRISPR gRNA sequence
ggctcccaggcagcgggcgg

SEQ ID NO: 14833 - DNA, 20 bp, Artificial
  CRISPR gRNA sequence
gctcccaggcagcgggcggg

SEQ ID NO: 14834 - DNA, 20 bp, Artificial
  CRISPR gRNA sequence
ccaggcagcgggcgggaggc

SEQ ID NO: 14835 - DNA, 20 bp, Artificial
  CRISPR gRNA sequence
ggcagcgggcgggaggctgg

SEQ ID NO: 14836 - DNA, 20 bp, Artificial
  CRISPR gRNA sequence
cgggcgggaggctggaagat

SEQ ID NO: 14837 - DNA, 20 bp, Artificial
  CRISPR gRNA sequence
gggaggctggaagatcagcc

SEQ ID NO: 14838 - DNA, 20 bp, Artificial
  CRISPR gRNA sequence
ggctggaagatcagcccagc

SEQ ID NO: 14839 - DNA, 20 bp, Artificial
  CRISPR gRNA sequence
ggaagatcagcccagccaga

SEQ ID NO: 14840 - DNA, 20 bp, Artificial
  CRISPR gRNA sequence
atcagcccagccagaaagcg

SEQ ID NO: 14841 - DNA, 20 bp, Artificial
  CRISPR gRNA sequence
agaaagcgtggcacgccctc

SEQ ID NO: 14842 - DNA, 20 bp, Artificial
  CRISPR gRNA sequence
agcgtggcacgccctccagc

SEQ ID NO: 14843 - DNA, 20 bp, Artificial
  CRISPR gRNA sequence
cgccctccagccagttgtca

SEQ ID NO: 14844 - DNA, 20 bp, Artificial
  CRISPR gRNA sequence
gccctccagccagttgtcat

SEQ ID NO: 14845 - DNA, 20 bp, Artificial
  CRISPR gRNA sequence
ccctccagccagttgtcata

SEQ ID NO: 14846 - DNA, 20 bp, Artificial
  CRISPR gRNA sequence
tcatagggcctcttcttcct

SEQ ID NO: 14847 - DNA, 20 bp, Artificial
  CRISPR gRNA sequence
catagggcctcttcttcctt

SEQ ID NO: 14848 - DNA, 20 bp, Artificial
  CRISPR gRNA sequence
atagggcctcttcttccttg

SEQ ID NO: 14849 - DNA, 20 bp, Artificial
  CRISPR gRNA sequence
ttcttccttggggtcaatgc

SEQ ID NO: 14850 - DNA, 20 bp, Artificial
  CRISPR gRNA sequence
tcttccttggggtcaatgct

SEQ ID NO: 14851 - DNA, 20 bp, Artificial
  CRISPR gRNA sequence
ggggtcaatgctaggtactg

SEQ ID NO: 14852 - DNA, 20 bp, Artificial
  CRISPR gRNA sequence
gggtcaatgctaggtactgc

SEQ ID NO: 14853 - DNA, 20 bp, Artificial
  CRISPR gRNA sequence
gtcaatgctaggtactgcgg

SEQ ID NO: 14854 - DNA, 20 bp, Artificial
  CRISPR gRNA sequence
ttgtccttgatttcgccact

SEQ ID NO: 14855 - DNA, 20 bp, Artificial
  CRISPR gRNA sequence
gtccttgatttcgccactca

SEQ ID NO: 14856 - DNA, 20 bp, Artificial
  CRISPR gRNA sequence
ttgatttcgccactcagagc

SEQ ID NO: 14857 - DNA, 20 bp, Artificial
  CRISPR gRNA sequence
tcgccactcagagccagcca

SEQ ID NO: 14858 - DNA, 20 bp, Artificial
  CRISPR gRNA sequence
cgccactcagagccagccac

SEQ ID NO: 14859 - DNA, 20 bp, Artificial
  CRISPR gRNA sequence
gccactcagagccagccaca

SEQ ID NO: 14860 - DNA, 20 bp, Artificial
  CRISPR gRNA sequence
agagccagccacagggcccc

SEQ ID NO: 14861 - DNA, 20 bp, Artificial
  CRISPR gRNA sequence
gagccagccacagggccccc

SEQ ID NO: 14862 - DNA, 20 bp, Artificial
  CRISPR gRNA sequence
ccagccacagggcccccagg

SEQ ID NO: 14863 - DNA, 20 bp, Artificial
  CRISPR gRNA sequence
agggcccccaggaagcattg

SEQ ID NO: 14864 - DNA, 20 bp, Artificial
  CRISPR gRNA sequence
gggcccccaggaagcattgc

SEQ ID NO: 14865 - DNA, 20 bp, Artificial
  CRISPR gRNA sequence
gcccccaggaagcattgcag

SEQ ID NO: 14866 - DNA, 20 bp, Artificial
  CRISPR gRNA sequence
cccccaggaagcattgcagg

SEQ ID NO: 14867 - DNA, 20 bp, Artificial
  CRISPR gRNA sequence
ccaggaagcattgcaggagg

SEQ ID NO: 14868 - DNA, 20 bp, Artificial
  CRISPR gRNA sequence
gaagcattgcaggaggaagc

SEQ ID NO: 14869 - DNA, 20 bp, Artificial
  CRISPR gRNA sequence
aagcattgcaggaggaagct

SEQ ID NO: 14870 - DNA, 20 bp, Artificial
  CRISPR gRNA sequence
agcattgcaggaggaagctg

SEQ ID NO: 14871 - DNA, 20 bp, Artificial
  CRISPR gRNA sequence
attgcaggaggaagctgggg

SEQ ID NO: 14872 - DNA, 20 bp, Artificial
  CRISPR gRNA sequence
ttgcaggaggaagctgggga

SEQ ID NO: 14873 - DNA, 20 bp, Artificial
  CRISPR gRNA sequence
aggaggaagctggggaaggc

SEQ ID NO: 14874 - DNA, 20 bp, Artificial
  CRISPR gRNA sequence
gaagctggggaaggccagct

SEQ ID NO: 14875 - DNA, 20 bp, Artificial
  CRISPR gRNA sequence
gaaggccagctcggactctg

SEQ ID NO: 14876 - DNA, 20 bp, Artificial
  CRISPR gRNA sequence
agctcggactctgcggcccg

SEQ ID NO: 14877 - DNA, 20 bp, Artificial
  CRISPR gRNA sequence
tcggactctgcggcccgcgg

SEQ ID NO: 14878 - DNA, 20 bp, Artificial
  CRISPR gRNA sequence
cggactctgcggcccgcggt

SEQ ID NO: 14879 - DNA, 20 bp, Artificial
  CRISPR gRNA sequence
ctgcggcccgcggtgggtgt

SEQ ID NO: 14880 - DNA, 20 bp, Artificial
  CRISPR gRNA sequence
cccgcggtgggtgttggact

SEQ ID NO: 14881 - DNA, 20 bp, Artificial
  CRISPR gRNA sequence
tgggtgttggactaagcctt

SEQ ID NO: 14882 - DNA, 20 bp, Artificial
  CRISPR gRNA sequence
ctaagcctttggccatcgcc

SEQ ID NO: 14883 - DNA, 20 bp, Artificial
  CRISPR gRNA sequence
taagcctttggccatcgccc

SEQ ID NO: 14884 - DNA, 20 bp, Artificial
  CRISPR gRNA sequence
cgcccaggtcctcacgtctg

SEQ ID NO: 14885 - DNA, 20 bp, Artificial
  CRISPR gRNA sequence
caggtcctcacgtctgcgga

SEQ ID NO: 14886 - DNA, 20 bp, Artificial
  CRISPR gRNA sequence
aggtcctcacgtctgcggat

SEQ ID NO: 14887 - DNA, 20 bp, Artificial
  CRISPR gRNA sequence
tcacgtctgcggatgggaac

SEQ ID NO: 14888 - DNA, 20 bp, Artificial
  CRISPR gRNA sequence
gatgggaactggtcctcctg

SEQ ID NO: 14889 - DNA, 20 bp, Artificial
  CRISPR gRNA sequence
atgggaactggtcctcctgt

SEQ ID NO: 14890 - DNA, 20 bp, Artificial
  CRISPR gRNA sequence
tgggaactggtcctcctgta

SEQ ID NO: 14891 - DNA, 20 bp, Artificial
  CRISPR gRNA sequence
gtagggtactttgatgtctg

SEQ ID NO: 14892 - DNA, 20 bp, Artificial
  CRISPR gRNA sequence
gtactttgatgtctgcggcc

SEQ ID NO: 14893 - DNA, 20 bp, Artificial
  CRISPR gRNA sequence
gatgtctgcggcccagctcc

SEQ ID NO: 14894 - DNA, 20 bp, Artificial
  CRISPR gRNA sequence
atgtctgcggcccagctccc

SEQ ID NO: 14895 - DNA, 20 bp, Artificial
  CRISPR gRNA sequence
ctgcggcccagctcccaggc

SEQ ID NO: 14896 - DNA, 20 bp, Artificial
  CRISPR gRNA sequence
gcccagctcccaggccagct

SEQ ID NO: 14897 - DNA, 20 bp, Artificial
  CRISPR gRNA sequence
agctcccaggccagcttggc

SEQ ID NO: 14898 - DNA, 20 bp, Artificial
  CRISPR gRNA sequence
gccagcttggccagctctgc

SEQ ID NO: 14899 - DNA, 20 bp, Artificial
  CRISPR gRNA sequence
ccagcttggccagctctgcc

SEQ ID NO: 14900 - DNA, 20 bp, Artificial
  CRISPR gRNA sequence
cagcttggccagctctgcca

SEQ ID NO: 14901 - DNA, 20 bp, Artificial
  CRISPR gRNA sequence
ggccagctctgccagggccc

SEQ ID NO: 14902 - DNA, 20 bp, Artificial
  CRISPR gRNA sequence
gccagctctgccagggcccc

SEQ ID NO: 14903 - DNA, 20 bp, Artificial
  CRISPR gRNA sequence
ccagctctgccagggccccg

SEQ ID NO: 14904 - DNA, 20 bp, Artificial
  CRISPR gRNA sequence
cagctctgccagggccccgg

SEQ ID NO: 14905 - DNA, 20 bp, Artificial
  CRISPR gRNA sequence
agctctgccagggccccggg

SEQ ID NO: 14906 - DNA, 20 bp, Artificial
  CRISPR gRNA sequence
gctctgccagggccccgggg

SEQ ID NO: 14907 - DNA, 20 bp, Artificial
  CRISPR gRNA sequence
agggccccgggggggctgtc

SEQ ID NO: 14908 - DNA, 20 bp, Artificial
  CRISPR gRNA sequence
gggccccgggggggctgtcg

SEQ ID NO: 14909 - DNA, 20 bp, Artificial
  CRISPR gRNA sequence
ggccccgggggggctgtcga

SEQ ID NO: 14910 - DNA, 20 bp, Artificial
  CRISPR gRNA sequence
gggggctgtcgagggctgca

SEQ ID NO: 14911 - DNA, 20 bp, Artificial
  CRISPR gRNA sequence
ctgtcgagggctgcacggcc

SEQ ID NO: 14912 - DNA, 20 bp, Artificial
  CRISPR gRNA sequence
tcgagggctgcacggcccag

SEQ ID NO: 14913 - DNA, 20 bp, Artificial
  CRISPR gRNA sequence
cgagggctgcacggcccagc

SEQ ID NO: 14914 - DNA, 20 bp, Artificial
  CRISPR gRNA sequence
cacggcccagcaggccgaca

SEQ ID NO: 14915 - DNA, 20 bp, Artificial
  CRISPR gRNA sequence
cggcccagcaggccgacata

SEQ ID NO: 14916 - DNA, 20 bp, Artificial
  CRISPR gRNA sequence
aggccgacatagagtcccgt

SEQ ID NO: 14917 - DNA, 20 bp, Artificial
  CRISPR gRNA sequence
gacatagagtcccgtgagcg

SEQ ID NO: 14918 - DNA, 20 bp, Artificial
  CRISPR gRNA sequence
catagagtcccgtgagcgtg

SEQ ID NO: 14919 - DNA, 20 bp, Artificial
  CRISPR gRNA sequence
atagagtcccgtgagcgtgg

SEQ ID NO: 14920 - DNA, 20 bp, Artificial
  CRISPR gRNA sequence
tagagtcccgtgagcgtgga

SEQ ID NO: 14921 - DNA, 20 bp, Artificial
  CRISPR gRNA sequence
agtcccgtgagcgtggaggg

SEQ ID NO: 14922 - DNA, 20 bp, Artificial
  CRISPR gRNA sequence
cgtgagcgtggagggcagct

SEQ ID NO: 14923 - DNA, 20 bp, Artificial
  CRISPR gRNA sequence
ggcagcttggcgtcctcccc

SEQ ID NO: 14924 - DNA, 20 bp, Artificial
  CRISPR gRNA sequence
ttggcgtcctccccaagctc

SEQ ID NO: 14925 - DNA, 20 bp, Artificial
  CRISPR gRNA sequence
gcgtcctccccaagctccag

SEQ ID NO: 14926 - DNA, 20 bp, Artificial
  CRISPR gRNA sequence
cgtcctccccaagctccagc

SEQ ID NO: 14927 - DNA, 20 bp, Artificial
  CRISPR gRNA sequence
gtcctccccaagctccagca

SEQ ID NO: 14928 - DNA, 20 bp, Artificial
  CRISPR gRNA sequence
caagctccagcagggcctct

SEQ ID NO: 14929 - DNA, 20 bp, Artificial
  CRISPR gRNA sequence
agctccagcagggcctctga

SEQ ID NO: 14930 - DNA, 20 bp, Artificial
  CRISPR gRNA sequence
ccagcagggcctctgagagc

SEQ ID NO: 14931 - DNA, 20 bp, Artificial
  CRISPR gRNA sequence
ctgagagctggcacactgcc

SEQ ID NO: 14932 - DNA, 20 bp, Artificial
  CRISPR gRNA sequence
ctggcacactgcccggcaca

SEQ ID NO: 14933 - DNA, 20 bp, Artificial
  CRISPR gRNA sequence
gcacactgcccggcacaaag

SEQ ID NO: 14934 - DNA, 20 bp, Artificial
  CRISPR gRNA sequence
cacactgcccggcacaaagt

SEQ ID NO: 14935 - DNA, 20 bp, Artificial
  CRISPR gRNA sequence
acactgcccggcacaaagta

SEQ ID NO: 14936 - DNA, 20 bp, Artificial
  CRISPR gRNA sequence
cccggcacaaagtagggctg

SEQ ID NO: 14937 - DNA, 20 bp, Artificial
  CRISPR gRNA sequence
gtagggctgtggctgtgact

SEQ ID NO: 14938 - DNA, 20 bp, Artificial
  CRISPR gRNA sequence
gggctgtggctgtgactgag

SEQ ID NO: 14939 - DNA, 20 bp, Artificial
  CRISPR gRNA sequence
ctgtggctgtgactgagaag

SEQ ID NO: 14940 - DNA, 20 bp, Artificial
  CRISPR gRNA sequence
tggctgtgactgagaagaag

SEQ ID NO: 14941 - DNA, 20 bp, Artificial
  CRISPR gRNA sequence
tgtgactgagaagaagtggc

SEQ ID NO: 14942 - DNA, 20 bp, Artificial
  CRISPR gRNA sequence
tgagaagaagtggccggtcc

SEQ ID NO: 14943 - DNA, 20 bp, Artificial
  CRISPR gRNA sequence
agaagaagtggccggtcccg

SEQ ID NO: 14944 - DNA, 20 bp, Artificial
  CRISPR gRNA sequence
gaagaagtggccggtcccgg

SEQ ID NO: 14945 - DNA, 20 bp, Artificial
  CRISPR gRNA sequence
agaagtggccggtcccggag

SEQ ID NO: 14946 - DNA, 20 bp, Artificial
  CRISPR gRNA sequence
ggccggtcccggaggagcgt

SEQ ID NO: 14947 - DNA, 20 bp, Artificial
  CRISPR gRNA sequence
gccggtcccggaggagcgtc

SEQ ID NO: 14948 - DNA, 20 bp, Artificial
  CRISPR gRNA sequence
ccggtcccggaggagcgtca

SEQ ID NO: 14949 - DNA, 20 bp, Artificial
  CRISPR gRNA sequence
ggagcgtcagggctctgtct

SEQ ID NO: 14950 - DNA, 20 bp, Artificial
  CRISPR gRNA sequence
cttggtgctctgtcatccct

SEQ ID NO: 14951 - DNA, 20 bp, Artificial
  CRISPR gRNA sequence
ctgtcatccctgagctctca

SEQ ID NO: 14952 - DNA, 20 bp, Artificial
  CRISPR gRNA sequence
tcatccctgagctctcaaag

SEQ ID NO: 14953 - DNA, 20 bp, Artificial
  CRISPR gRNA sequence
agtagcgcatcacgtatgcc

SEQ ID NO: 14954 - DNA, 20 bp, Artificial
  CRISPR gRNA sequence
gtagcgcatcacgtatgcct

SEQ ID NO: 14955 - DNA, 20 bp, Artificial
  CRISPR gRNA sequence
gtatgcctgggcctgctcca

SEQ ID NO: 14956 - DNA, 20 bp, Artificial
  CRISPR gRNA sequence
atgcctgggcctgctccatg

SEQ ID NO: 14957 - DNA, 20 bp, Artificial
  CRISPR gRNA sequence
cctgggcctgctccatggag

SEQ ID NO: 14958 - DNA, 20 bp, Artificial
  CRISPR gRNA sequence
ggcctgctccatggagaagc

SEQ ID NO: 14959 - DNA, 20 bp, Artificial
  CRISPR gRNA sequence
tgctccatggagaagccgga

SEQ ID NO: 14960 - DNA, 20 bp, Artificial
  CRISPR gRNA sequence
gagaagccggacagctcaaa

SEQ ID NO: 14961 - DNA, 20 bp, Artificial
  CRISPR gRNA sequence
agaagccggacagctcaaat

SEQ ID NO: 14962 - DNA, 20 bp, Artificial
  CRISPR gRNA sequence
gaagccggacagctcaaata

SEQ ID NO: 14963 - DNA, 20 bp, Artificial
  CRISPR gRNA sequence
ggacagctcaaatagggcgt

SEQ ID NO: 14964 - DNA, 20 bp, Artificial
  CRISPR gRNA sequence
aatagggcgtcggccttgct

SEQ ID NO: 14965 - DNA, 20 bp, Artificial
  CRISPR gRNA sequence
atagggcgtcggccttgctc

SEQ ID NO: 14966 - DNA, 20 bp, Artificial
  CRISPR gRNA sequence
cgtcggccttgctcaggctc

SEQ ID NO: 14967 - DNA, 20 bp, Artificial
  CRISPR gRNA sequence
gccttgctcaggctctggac

SEQ ID NO: 14968 - DNA, 20 bp, Artificial
  CRISPR gRNA sequence
ccttgctcaggctctggacc

SEQ ID NO: 14969 - DNA, 20 bp, Artificial
  CRISPR gRNA sequence
tgctcaggctctggaccagg

SEQ ID NO: 14970 - DNA, 20 bp, Artificial
  CRISPR gRNA sequence
ggctctggaccaggcggccc

SEQ ID NO: 14971 - DNA, 20 bp, Artificial
  CRISPR gRNA sequence
gctctggaccaggcggcccc

SEQ ID NO: 14972 - DNA, 20 bp, Artificial
  CRISPR gRNA sequence
ctctggaccaggcggccccg

SEQ ID NO: 14973 - DNA, 20 bp, Artificial
  CRISPR gRNA sequence
ggaccaggcggccccggggc

SEQ ID NO: 14974 - DNA, 20 bp, Artificial
  CRISPR gRNA sequence
gaccaggcggccccggggcc

SEQ ID NO: 14975 - DNA, 20 bp, Artificial
  CRISPR gRNA sequence
cggccccggggccgggctgt

SEQ ID NO: 14976 - DNA, 20 bp, Artificial
  CRISPR gRNA sequence
ggccccggggccgggctgtg

SEQ ID NO: 14977 - DNA, 20 bp, Artificial
  CRISPR gRNA sequence
ccccggggccgggctgtgag

SEQ ID NO: 14978 - DNA, 20 bp, Artificial
  CRISPR gRNA sequence
cccggggccgggctgtgagg

SEQ ID NO: 14979 - DNA, 20 bp, Artificial
  CRISPR gRNA sequence
cggggccgggctgtgaggag

SEQ ID NO: 14980 - DNA, 20 bp, Artificial
  CRISPR gRNA sequence
ggggccgggctgtgaggagg

SEQ ID NO: 14981 - DNA, 20 bp, Artificial
  CRISPR gRNA sequence
gggccgggctgtgaggagga

SEQ ID NO: 14982 - DNA, 20 bp, Artificial
  CRISPR gRNA sequence
tgaggaggagggtgcaacct

SEQ ID NO: 14983 - DNA, 20 bp, Artificial
  CRISPR gRNA sequence
aggaggagggtgcaacctcg

SEQ ID NO: 14984 - DNA, 20 bp, Artificial
  CRISPR gRNA sequence
aggagggtgcaacctcggag

SEQ ID NO: 14985 - DNA, 20 bp, Artificial
  CRISPR gRNA sequence
aacctcggagcagcttcttc

SEQ ID NO: 14986 - DNA, 20 bp, Artificial
  CRISPR gRNA sequence
cggagcagcttcttctggaa

SEQ ID NO: 14987 - DNA, 20 bp, Artificial
  CRISPR gRNA sequence
ggagcagcttcttctggaaa

SEQ ID NO: 14988 - DNA, 20 bp, Artificial
  CRISPR gRNA sequence
cagcttcttctggaaaaggc

SEQ ID NO: 14989 - DNA, 20 bp, Artificial
  CRISPR gRNA sequence
ttcttctggaaaaggccggc

SEQ ID NO: 14990 - DNA, 20 bp, Artificial
  CRISPR gRNA sequence
ttctggaaaaggccggccag

SEQ ID NO: 14991 - DNA, 20 bp, Artificial
  CRISPR gRNA sequence
aaaggccggccagcagcccc

SEQ ID NO: 14992 - DNA, 20 bp, Artificial
  CRISPR gRNA sequence
aggccggccagcagcccccg

SEQ ID NO: 14993 - DNA, 20 bp, Artificial
  CRISPR gRNA sequence
ggccggccagcagcccccgg

SEQ ID NO: 14994 - DNA, 20 bp, Artificial
  CRISPR gRNA sequence
gccggccagcagcccccgga

SEQ ID NO: 14995 - DNA, 20 bp, Artificial
  CRISPR gRNA sequence
cggccagcagcccccggagg

SEQ ID NO: 14996 - DNA, 20 bp, Artificial
  CRISPR gRNA sequence
ccagcagcccccggagggag

SEQ ID NO: 14997 - DNA, 20 bp, Artificial
  CRISPR gRNA sequence
cagcagcccccggagggagc

SEQ ID NO: 14998 - DNA, 20 bp, Artificial
  CRISPR gRNA sequence
agcagcccccggagggagca

SEQ ID NO: 14999 - DNA, 20 bp, Artificial
  CRISPR gRNA sequence
cggagggagcagggctccgc

SEQ ID NO: 15000 - DNA, 20 bp, Artificial
  CRISPR gRNA sequence
gagcagggctccgccggtgc

SEQ ID NO: 15001 - DNA, 20 bp, Artificial
  CRISPR gRNA sequence
gccggtccgcacgtgctgtg

SEQ ID NO: 15002 - DNA, 20 bp, Artificial
  CRISPR gRNA sequence
ccggtccgcacgtgctgtgc

SEQ ID NO: 15003 - DNA, 20 bp, Artificial
  CRISPR gRNA sequence
gtccgcacgtgctgtgcagg

SEQ ID NO: 15004 - DNA, 20 bp, Artificial
  CRISPR gRNA sequence
aggaagccatcttgcgcttc

SEQ ID NO: 15005 - DNA, 20 bp, Artificial
  CRISPR gRNA sequence
cttgcgcttccagctcctcg

SEQ ID NO: 15006 - DNA, 20 bp, Artificial
  CRISPR gRNA sequence
tccagctcctcgaagccgtc

SEQ ID NO: 15007 - DNA, 20 bp, Artificial
  CRISPR gRNA sequence
ccagctcctcgaagccgtct

SEQ ID NO: 15008 - DNA, 20 bp, Artificial
  CRISPR gRNA sequence
tcctcgaagccgtctaggat

SEQ ID NO: 15009 - DNA, 20 bp, Artificial
  CRISPR gRNA sequence
tcgaagccgtctaggatgag

SEQ ID NO: 15010 - DNA, 20 bp, Artificial
  CRISPR gRNA sequence
cgtctaggatgagcagaacg

SEQ ID NO: 15011 - DNA, 20 bp, Artificial
  CRISPR gRNA sequence
taggatgagcagaacgcggt

SEQ ID NO: 15012 - DNA, 20 bp, Artificial
  CRISPR gRNA sequence
aggatgagcagaacgcggtc

SEQ ID NO: 15013 - DNA, 20 bp, Artificial
  CRISPR gRNA sequence
gaacgcggtcaggtctcttc

SEQ ID NO: 15014 - DNA, 20 bp, Artificial
  CRISPR gRNA sequence
ggtcaggtctcttcaagatg

SEQ ID NO: 15015 - DNA, 20 bp, Artificial
  CRISPR gRNA sequence
gatgtggctgaaaacctcat

SEQ ID NO: 15016 - DNA, 20 bp, Artificial
  CRISPR gRNA sequence
aaaacctcatcggccgccac

SEQ ID NO: 15017 - DNA, 20 bp, Artificial
  CRISPR gRNA sequence
acctcatcggccgccacgag

SEQ ID NO: 15018 - DNA, 20 bp, Artificial
  CRISPR gRNA sequence
tcggccgccacgagtggctg

SEQ ID NO: 15019 - DNA, 20 bp, Artificial
  CRISPR gRNA sequence
cggccgccacgagtggctgt

SEQ ID NO: 15020 - DNA, 20 bp, Artificial
  CRISPR gRNA sequence
gccacgagtggctgtgggcc

SEQ ID NO: 15021 - DNA, 20 bp, Artificial
  CRISPR gRNA sequence
ccacgagtggctgtgggccc

SEQ ID NO: 15022 - DNA, 20 bp, Artificial
  CRISPR gRNA sequence
cacgagtggctgtgggccca

SEQ ID NO: 15023 - DNA, 20 bp, Artificial
  CRISPR gRNA sequence
cgagtggctgtgggcccagg

SEQ ID NO: 15024 - DNA, 20 bp, Artificial
  CRISPR gRNA sequence
gtggctgtgggcccagggag

SEQ ID NO: 15025 - DNA, 20 bp, Artificial
  CRISPR gRNA sequence
ggctgtgggcccagggagaa

SEQ ID NO: 15026 - DNA, 20 bp, Artificial
  CRISPR gRNA sequence
tgtgggcccagggagaagag

SEQ ID NO: 15027 - DNA, 20 bp, Artificial
  CRISPR gRNA sequence
agggagaagagcagatcctg

SEQ ID NO: 15028 - DNA, 20 bp, Artificial
  CRISPR gRNA sequence
gggagaagagcagatcctgc

SEQ ID NO: 15029 - DNA, 20 bp, Artificial
  CRISPR gRNA sequence
agagcagatcctgcaggcca

SEQ ID NO: 15030 - DNA, 20 bp, Artificial
  CRISPR gRNA sequence
gagcagatcctgcaggccat

SEQ ID NO: 15031 - DNA, 20 bp, Artificial
  CRISPR gRNA sequence
tgcaggccataggcatcccc

SEQ ID NO: 15032 - DNA, 20 bp, Artificial
  CRISPR gRNA sequence
ggccataggcatcccccgga

SEQ ID NO: 15033 - DNA, 20 bp, Artificial
  CRISPR gRNA sequence
aggcatcccccggacggttc

SEQ ID NO: 15034 - DNA, 20 bp, Artificial
  CRISPR gRNA sequence
cccccggacggttcaagcaa

SEQ ID NO: 15035 - DNA, 20 bp, Artificial
  CRISPR gRNA sequence
ccggacggttcaagcaatgg

SEQ ID NO: 15036 - DNA, 20 bp, Artificial
  CRISPR gRNA sequence
cggacggttcaagcaatggc

SEQ ID NO: 15037 - DNA, 20 bp, Artificial
  CRISPR gRNA sequence
ggacggttcaagcaatggca

SEQ ID NO: 15038 - DNA, 20 bp, Artificial
  CRISPR gRNA sequence
gacggttcaagcaatggcag

SEQ ID NO: 15039 - DNA, 20 bp, Artificial
  CRISPR gRNA sequence
gttcaagcaatggcagggga

SEQ ID NO: 15040 - DNA, 20 bp, Artificial
  CRISPR gRNA sequence
tcaagcaatggcaggggaca

SEQ ID NO: 15041 - DNA, 20 bp, Artificial
  CRISPR gRNA sequence
agcaatggcaggggacagag

SEQ ID NO: 15042 - DNA, 20 bp, Artificial
  CRISPR gRNA sequence
ggcaggggacagagaagaca

SEQ ID NO: 15043 - DNA, 20 bp, Artificial
  CRISPR gRNA sequence
cagagaagacaaagtcgtac

SEQ ID NO: 15044 - DNA, 20 bp, Artificial
  CRISPR gRNA sequence
agagaagacaaagtcgtact

SEQ ID NO: 15045 - DNA, 20 bp, Artificial
  CRISPR gRNA sequence
gagaagacaaagtcgtactg

SEQ ID NO: 15046 - DNA, 20 bp, Artificial
  CRISPR gRNA sequence
aagacaaagtcgtactgggg

SEQ ID NO: 15047 - DNA, 20 bp, Artificial
  CRISPR gRNA sequence
caaagtcgtactggggaagc

SEQ ID NO: 15048 - DNA, 20 bp, Artificial
  CRISPR gRNA sequence
gtactggggaagccggccac

SEQ ID NO: 15049 - DNA, 20 bp, Artificial
  CRISPR gRNA sequence
ggggaagccggccacaagcc

SEQ ID NO: 15050 - DNA, 20 bp, Artificial
  CRISPR gRNA sequence
gggaagccggccacaagccc

SEQ ID NO: 15051 - DNA, 20 bp, Artificial
  CRISPR gRNA sequence
gccggccacaagcccaggcc

SEQ ID NO: 15052 - DNA, 20 bp, Artificial
  CRISPR gRNA sequence
ccaggcccggctcactgccc

SEQ ID NO: 15053 - DNA, 20 bp, Artificial
  CRISPR gRNA sequence
ggctcactgccccagcccaa

SEQ ID NO: 15054 - DNA, 20 bp, Artificial
  CRISPR gRNA sequence
ccaatagctcttgccctgac

SEQ ID NO: 15055 - DNA, 20 bp, Artificial
  CRISPR gRNA sequence
ttgccctgaccagctttgcc

SEQ ID NO: 15056 - DNA, 20 bp, Artificial
  CRISPR gRNA sequence
ctgaccagctttgcccagca

SEQ ID NO: 15057 - DNA, 20 bp, Artificial
  CRISPR gRNA sequence
gcaatcactcgtgtctcacg

SEQ ID NO: 15058 - DNA, 20 bp, Artificial
  CRISPR gRNA sequence
ctcgtgtctcacgcggccgc

SEQ ID NO: 15059 - DNA, 20 bp, Artificial
  CRISPR gRNA sequence
acgcggccgccggtgctcct

SEQ ID NO: 15060 - DNA, 20 bp, Artificial
  CRISPR gRNA sequence
cggccgccggtgctccttgg

SEQ ID NO: 15061 - DNA, 20 bp, Artificial
  CRISPR gRNA sequence
cggtgctccttggcagccaa

SEQ ID NO: 15062 - DNA, 20 bp, Artificial
  CRISPR gRNA sequence
cttggcagccaacagcacct

SEQ ID NO: 15063 - DNA, 20 bp, Artificial
  CRISPR gRNA sequence
gcagccaacagcacctcagc

SEQ ID NO: 15064 - DNA, 20 bp, Artificial
  CRISPR gRNA sequence
cagccaacagcacctcagcc

SEQ ID NO: 15065 - DNA, 20 bp, Artificial
  CRISPR gRNA sequence
gcacctcagccaggcctcct

SEQ ID NO: 15066 - DNA, 20 bp, Artificial
  CRISPR gRNA sequence
cacctcagccaggcctcctt

SEQ ID NO: 15067 - DNA, 20 bp, Artificial
  CRISPR gRNA sequence
tcagccaggcctccttgggc

SEQ ID NO: 15068 - DNA, 20 bp, Artificial
  CRISPR gRNA sequence
gggccagctgccgttctgcc

SEQ ID NO: 15069 - DNA, 20 bp, Artificial
  CRISPR gRNA sequence
agctgccgttctgcccagtc

SEQ ID NO: 15070 - DNA, 20 bp, Artificial
  CRISPR gRNA sequence
gctgccgttctgcccagtcc

SEQ ID NO: 15071 - DNA, 20 bp, Artificial
  CRISPR gRNA sequence
ctgccgttctgcccagtccg

SEQ ID NO: 15072 - DNA, 20 bp, Artificial
  CRISPR gRNA sequence
ccgttctgcccagtccgggg

SEQ ID NO: 15073 - DNA, 20 bp, Artificial
  CRISPR gRNA sequence
tctgcccagtccggggtggc

SEQ ID NO: 15074 - DNA, 20 bp, Artificial
  CRISPR gRNA sequence
ggggtggccagttcccgctc

SEQ ID NO: 15075 - DNA, 20 bp, Artificial
  CRISPR gRNA sequence
gggtggccagttcccgctcc

SEQ ID NO: 15076 - DNA, 20 bp, Artificial
  CRISPR gRNA sequence
ctcttgctgctgctcctctc

SEQ ID NO: 15077 - DNA, 20 bp, Artificial
  CRISPR gRNA sequence
gctgctgctcctctccagcc

SEQ ID NO: 15078 - DNA, 20 bp, Artificial
  CRISPR gRNA sequence
ctctccagcctggcctgcac

SEQ ID NO: 15079 - DNA, 20 bp, Artificial
  CRISPR gRNA sequence
tgcaccagatccacctccac

SEQ ID NO: 15080 - DNA, 20 bp, Artificial
  CRISPR gRNA sequence
gcaccagatccacctccact

SEQ ID NO: 15081 - DNA, 20 bp, Artificial
  CRISPR gRNA sequence
acctccactaggatgccatc

SEQ ID NO: 15082 - DNA, 20 bp, Artificial
  CRISPR gRNA sequence
cctccactaggatgccatcc

SEQ ID NO: 15083 - DNA, 20 bp, Artificial
  CRISPR gRNA sequence
taggatgccatccgggcctg

SEQ ID NO: 15084 - DNA, 20 bp, Artificial
  CRISPR gRNA sequence
aggatgccatccgggcctgc

SEQ ID NO: 15085 - DNA, 20 bp, Artificial
  CRISPR gRNA sequence
gccatccgggcctgcgggct

SEQ ID NO: 15086 - DNA, 20 bp, Artificial
  CRISPR gRNA sequence
tcggcaccatacgtgtcctg

SEQ ID NO: 15087 - DNA, 20 bp, Artificial
  CRISPR gRNA sequence
caccatacgtgtcctgcagt

SEQ ID NO: 15088 - DNA, 20 bp, Artificial
  CRISPR gRNA sequence
catacgtgtcctgcagtgag

SEQ ID NO: 15089 - DNA, 20 bp, Artificial
  CRISPR gRNA sequence
acgtgtcctgcagtgagcgg

SEQ ID NO: 15090 - DNA, 20 bp, Artificial
  CRISPR gRNA sequence
gagcggtagaactgctccac

SEQ ID NO: 15091 - DNA, 20 bp, Artificial
  CRISPR gRNA sequence
actgctccaccggctctgca

SEQ ID NO: 15092 - DNA, 20 bp, Artificial
  CRISPR gRNA sequence
ctgctccaccggctctgcaa

SEQ ID NO: 15093 - DNA, 20 bp, Artificial
  CRISPR gRNA sequence
tccaccggctctgcaaaggc

SEQ ID NO: 15094 - DNA, 20 bp, Artificial
  CRISPR gRNA sequence
ccaccggctctgcaaaggcc

SEQ ID NO: 15095 - DNA, 20 bp, Artificial
  CRISPR gRNA sequence
caccggctctgcaaaggcca

SEQ ID NO: 15096 - DNA, 20 bp, Artificial
  CRISPR gRNA sequence
accggctctgcaaaggccag

SEQ ID NO: 15097 - DNA, 20 bp, Artificial
  CRISPR gRNA sequence
tgcaaaggccaggggcgtgt

SEQ ID NO: 15098 - DNA, 20 bp, Artificial
  CRISPR gRNA sequence
gcaaaggccaggggcgtgtc

SEQ ID NO: 15099 - DNA, 20 bp, Artificial
  CRISPR gRNA sequence
caaaggccaggggcgtgtca

SEQ ID NO: 15100 - DNA, 20 bp, Artificial
  CRISPR gRNA sequence
aggccaggggcgtgtcaggg

SEQ ID NO: 15101 - DNA, 20 bp, Artificial
  CRISPR gRNA sequence
ggccaggggcgtgtcagggt

SEQ ID NO: 15102 - DNA, 20 bp, Artificial
  CRISPR gRNA sequence
gccaggggcgtgtcagggtg

SEQ ID NO: 15103 - DNA, 20 bp, Artificial
  CRISPR gRNA sequence
ccaggggcgtgtcagggtgg

SEQ ID NO: 15104 - DNA, 20 bp, Artificial
  CRISPR gRNA sequence
gtgtcagggtgggggtatgt

SEQ ID NO: 15105 - DNA, 20 bp, Artificial
  CRISPR gRNA sequence
gtcagggtgggggtatgtga

SEQ ID NO: 15106 - DNA, 20 bp, Artificial
  CRISPR gRNA sequence
tcagggtgggggtatgtgag

SEQ ID NO: 15107 - DNA, 20 bp, Artificial
  CRISPR gRNA sequence
gggtgggggtatgtgagagg

SEQ ID NO: 15108 - DNA, 20 bp, Artificial
  CRISPR gRNA sequence
ggtgggggtatgtgagaggc

SEQ ID NO: 15109 - DNA, 20 bp, Artificial
  CRISPR gRNA sequence
gtgggggtatgtgagaggca

SEQ ID NO: 15110 - DNA, 20 bp, Artificial
  CRISPR gRNA sequence
gggtatgtgagaggcagggc

SEQ ID NO: 15111 - DNA, 20 bp, Artificial
  CRISPR gRNA sequence
ggtatgtgagaggcagggcc

SEQ ID NO: 15112 - DNA, 20 bp, Artificial
  CRISPR gRNA sequence
gtatgtgagaggcagggcca

SEQ ID NO: 15113 - DNA, 20 bp, Artificial
  CRISPR gRNA sequence
gtgagaggcagggccagggc

SEQ ID NO: 15114 - DNA, 20 bp, Artificial
  CRISPR gRNA sequence
gggccagggccagccaccac

SEQ ID NO: 15115 - DNA, 20 bp, Artificial
  CRISPR gRNA sequence
ggccagggccagccaccaca

SEQ ID NO: 15116 - DNA, 20 bp, Artificial
  CRISPR gRNA sequence
agggccagccaccacaaggc

SEQ ID NO: 15117 - DNA, 20 bp, Artificial
  CRISPR gRNA sequence
atttacatctgttccccaca

SEQ ID NO: 15118 - DNA, 20 bp, Artificial
  CRISPR gRNA sequence
tgtttgttttgttttgtttt

SEQ ID NO: 15119 - DNA, 20 bp, Artificial
  CRISPR gRNA sequence
tgttttgttttgttttgaga

SEQ ID NO: 15120 - DNA, 20 bp, Artificial
  CRISPR gRNA sequence
gttttgttttgttttgagac

SEQ ID NO: 15121 - DNA, 20 bp, Artificial
  CRISPR gRNA sequence
ttttgttttgttttgagaca

SEQ ID NO: 15122 - DNA, 20 bp, Artificial
  CRISPR gRNA sequence
ttttgttttgagacagggtc

SEQ ID NO: 15123 - DNA, 20 bp, Artificial
  CRISPR gRNA sequence
cagggtctggcttttttgcc

SEQ ID NO: 15124 - DNA, 20 bp, Artificial
  CRISPR gRNA sequence
agggtctggcttttttgccc

SEQ ID NO: 15125 - DNA, 20 bp, Artificial
  CRISPR gRNA sequence
tctggcttttttgcccaggc

SEQ ID NO: 15126 - DNA, 20 bp, Artificial
  CRISPR gRNA sequence
tttttgcccaggctggaatg

SEQ ID NO: 15127 - DNA, 20 bp, Artificial
  CRISPR gRNA sequence
ttgcccaggctggaatgcag

SEQ ID NO: 15128 - DNA, 20 bp, Artificial
  CRISPR gRNA sequence
ggaatgcagtggtgtgatca

SEQ ID NO: 15129 - DNA, 20 bp, Artificial
  CRISPR gRNA sequence
tcgctgcaacctcaacctcc

SEQ ID NO: 15130 - DNA, 20 bp, Artificial
  CRISPR gRNA sequence
cgctgcaacctcaacctcct

SEQ ID NO: 15131 - DNA, 20 bp, Artificial
  CRISPR gRNA sequence
tcctcctgactccacctccc

SEQ ID NO: 15132 - DNA, 20 bp, Artificial
  CRISPR gRNA sequence
tcctgactccacctcccaag

SEQ ID NO: 15133 - DNA, 20 bp, Artificial
  CRISPR gRNA sequence
gactccacctcccaagtagc

SEQ ID NO: 15134 - DNA, 20 bp, Artificial
  CRISPR gRNA sequence
actccacctcccaagtagct

SEQ ID NO: 15135 - DNA, 20 bp, Artificial
  CRISPR gRNA sequence
ctcccaagtagctgggacca

SEQ ID NO: 15136 - DNA, 20 bp, Artificial
  CRISPR gRNA sequence
cagacatgtgacaccatgcc

SEQ ID NO: 15137 - DNA, 20 bp, Artificial
  CRISPR gRNA sequence
ataattttttgatttttttg

SEQ ID NO: 15138 - DNA, 20 bp, Artificial
  CRISPR gRNA sequence
aattttttgatttttttgta

SEQ ID NO: 15139 - DNA, 20 bp, Artificial
  CRISPR gRNA sequence
ttttgatttttttgtagaga

SEQ ID NO: 15140 - DNA, 20 bp, Artificial
  CRISPR gRNA sequence
tttgatttttttgtagagat

SEQ ID NO: 15141 - DNA, 20 bp, Artificial
  CRISPR gRNA sequence
ttgatttttttgtagagatg

SEQ ID NO: 15142 - DNA, 20 bp, Artificial
  CRISPR gRNA sequence
tggggtctcactatgtcgcc

SEQ ID NO: 15143 - DNA, 20 bp, Artificial
  CRISPR gRNA sequence
ggggtctcactatgtcgccc

SEQ ID NO: 15144 - DNA, 20 bp, Artificial
  CRISPR gRNA sequence
tctcactatgtcgcccaggc

SEQ ID NO: 15145 - DNA, 20 bp, Artificial
  CRISPR gRNA sequence
tcgcccaggctggcgtgcaa

SEQ ID NO: 15146 - DNA, 20 bp, Artificial
  CRISPR gRNA sequence
ggcgtgcaatggcacaatca

SEQ ID NO: 15147 - DNA, 20 bp, Artificial
  CRISPR gRNA sequence
ggcacaatcatggtccacca

SEQ ID NO: 15148 - DNA, 20 bp, Artificial
  CRISPR gRNA sequence
ccaccacagcttcaacctca

SEQ ID NO: 15149 - DNA, 20 bp, Artificial
  CRISPR gRNA sequence
caccacagcttcaacctcac

SEQ ID NO: 15150 - DNA, 20 bp, Artificial
  CRISPR gRNA sequence
agcttcaacctcacaggctc

SEQ ID NO: 15151 - DNA, 20 bp, Artificial
  CRISPR gRNA sequence
ctcaagcaatcctcccacct

SEQ ID NO: 15152 - DNA, 20 bp, Artificial
  CRISPR gRNA sequence
tcctcccacctcagcctcct

SEQ ID NO: 15153 - DNA, 20 bp, Artificial
  CRISPR gRNA sequence
tcccacctcagcctcctgag

SEQ ID NO: 15154 - DNA, 20 bp, Artificial
  CRISPR gRNA sequence
acctcagcctcctgagtagc

SEQ ID NO: 15155 - DNA, 20 bp, Artificial
  CRISPR gRNA sequence
cctcagcctcctgagtagct

SEQ ID NO: 15156 - DNA, 20 bp, Artificial
  CRISPR gRNA sequence
ctcctgagtagctgggacta

SEQ ID NO: 15157 - DNA, 20 bp, Artificial
  CRISPR gRNA sequence
tcctgagtagctgggactac

SEQ ID NO: 15158 - DNA, 20 bp, Artificial
  CRISPR gRNA sequence
caggcgcccactgccatgcc

SEQ ID NO: 15159 - DNA, 20 bp, Artificial
  CRISPR gRNA sequence
ttttcttttttgtttttttg

SEQ ID NO: 15160 - DNA, 20 bp, Artificial
  CRISPR gRNA sequence
ttcttttttgtttttttgtg

SEQ ID NO: 15161 - DNA, 20 bp, Artificial
  CRISPR gRNA sequence
ttttgtttttttgtggagat

SEQ ID NO: 15162 - DNA, 20 bp, Artificial
  CRISPR gRNA sequence
taagttctcactattttgcc

SEQ ID NO: 15163 - DNA, 20 bp, Artificial
  CRISPR gRNA sequence
aagttctcactattttgccc

SEQ ID NO: 15164 - DNA, 20 bp, Artificial
  CRISPR gRNA sequence
tctcactattttgcccaggc

SEQ ID NO: 15165 - DNA, 20 bp, Artificial
  CRISPR gRNA sequence
attttgcccaggctggtctt

SEQ ID NO: 15166 - DNA, 20 bp, Artificial
  CRISPR gRNA sequence
ccaggctggtcttgagctcc

SEQ ID NO: 15167 - DNA, 20 bp, Artificial
  CRISPR gRNA sequence
caggctggtcttgagctcct

SEQ ID NO: 15168 - DNA, 20 bp, Artificial
  CRISPR gRNA sequence
ggtcttgagctcctgggctc

SEQ ID NO: 15169 - DNA, 20 bp, Artificial
  CRISPR gRNA sequence
ctcaagcaatcgttccgcct

SEQ ID NO: 15170 - DNA, 20 bp, Artificial
  CRISPR gRNA sequence
cgttccgccttggcctccca

SEQ ID NO: 15171 - DNA, 20 bp, Artificial
  CRISPR gRNA sequence
gccttggcctcccaaagtgc

SEQ ID NO: 15172 - DNA, 20 bp, Artificial
  CRISPR gRNA sequence
ccttggcctcccaaagtgct

SEQ ID NO: 15173 - DNA, 20 bp, Artificial
  CRISPR gRNA sequence
ctcccaaagtgctgggatta

SEQ ID NO: 15174 - DNA, 20 bp, Artificial
  CRISPR gRNA sequence
tcccaaagtgctgggattac

SEQ ID NO: 15175 - DNA, 20 bp, Artificial
  CRISPR gRNA sequence
agtgctgggattacaggtgt

SEQ ID NO: 15176 - DNA, 20 bp, Artificial
  CRISPR gRNA sequence
caggtgtgagccaccacatc

SEQ ID NO: 15177 - DNA, 20 bp, Artificial
  CRISPR gRNA sequence
caccacatctggcccccata

SEQ ID NO: 15178 - DNA, 20 bp, Artificial
  CRISPR gRNA sequence
tcttcatcatttgcttcatt

SEQ ID NO: 15179 - DNA, 20 bp, Artificial
  CRISPR gRNA sequence
gtcacccaccactcattcat

SEQ ID NO: 15180 - DNA, 20 bp, Artificial
  CRISPR gRNA sequence
actcatcgtctctcttgttt

SEQ ID NO: 15181 - DNA, 20 bp, Artificial
  CRISPR gRNA sequence
gtttaagtgtccactccttt

SEQ ID NO: 15182 - DNA, 20 bp, Artificial
  CRISPR gRNA sequence
tttctctctttttttttttt

SEQ ID NO: 15183 - DNA, 20 bp, Artificial
  CRISPR gRNA sequence
tctcttttttttttttgaga

SEQ ID NO: 15184 - DNA, 20 bp, Artificial
  CRISPR gRNA sequence
atggatcctgccctgtgccc

SEQ ID NO: 15185 - DNA, 20 bp, Artificial
  CRISPR gRNA sequence
tggatcctgccctgtgcccc

SEQ ID NO: 15186 - DNA, 20 bp, Artificial
  CRISPR gRNA sequence
tcctgccctgtgccccaggc

SEQ ID NO: 15187 - DNA, 20 bp, Artificial
  CRISPR gRNA sequence
ctgccctgtgccccaggctg

SEQ ID NO: 15188 - DNA, 20 bp, Artificial
  CRISPR gRNA sequence
tgccccaggctggagtgcac

SEQ ID NO: 15189 - DNA, 20 bp, Artificial
  CRISPR gRNA sequence
ggagtgcactggcgcaatct

SEQ ID NO: 15190 - DNA, 20 bp, Artificial
  CRISPR gRNA sequence
actggcgcaatctcagctca

SEQ ID NO: 15191 - DNA, 20 bp, Artificial
  CRISPR gRNA sequence
tcacggcaacctccacctcc

SEQ ID NO: 15192 - DNA, 20 bp, Artificial
  CRISPR gRNA sequence
cacggcaacctccacctcct

SEQ ID NO: 15193 - DNA, 20 bp, Artificial
  CRISPR gRNA sequence
caacctccacctcctgggtt

SEQ ID NO: 15194 - DNA, 20 bp, Artificial
  CRISPR gRNA sequence
aacctccacctcctgggttt

SEQ ID NO: 15195 - DNA, 20 bp, Artificial
  CRISPR gRNA sequence
tttaggcgattctcctgcct

SEQ ID NO: 15196 - DNA, 20 bp, Artificial
  CRISPR gRNA sequence
ttctcctgcctcggcctgcc

SEQ ID NO: 15197 - DNA, 20 bp, Artificial
  CRISPR gRNA sequence
tcctgcctcggcctgccaag

SEQ ID NO: 15198 - DNA, 20 bp, Artificial
  CRISPR gRNA sequence
gcctcggcctgccaagtagc

SEQ ID NO: 15199 - DNA, 20 bp, Artificial
  CRISPR gRNA sequence
cctcggcctgccaagtagct

SEQ ID NO: 15200 - DNA, 20 bp, Artificial
  CRISPR gRNA sequence
ctgccaagtagctgggatta

SEQ ID NO: 15201 - DNA, 20 bp, Artificial
  CRISPR gRNA sequence
tgccaagtagctgggattac

SEQ ID NO: 15202 - DNA, 20 bp, Artificial
  CRISPR gRNA sequence
caggcacccactaccacgtc

SEQ ID NO: 15203 - DNA, 20 bp, Artificial
  CRISPR gRNA sequence
ctaatttttgtattttttaa

SEQ ID NO: 15204 - DNA, 20 bp, Artificial
  CRISPR gRNA sequence
aatttttgtattttttaatg

SEQ ID NO: 15205 - DNA, 20 bp, Artificial
  CRISPR gRNA sequence
tttgtattttttaatggaga

SEQ ID NO: 15206 - DNA, 20 bp, Artificial
  CRISPR gRNA sequence
ttgtattttttaatggagac

SEQ ID NO: 15207 - DNA, 20 bp, Artificial
  CRISPR gRNA sequence
tgtattttttaatggagacg

SEQ ID NO: 15208 - DNA, 20 bp, Artificial
  CRISPR gRNA sequence
gagacggggtttcactatgt

SEQ ID NO: 15209 - DNA, 20 bp, Artificial
  CRISPR gRNA sequence
cggggtttcactatgttggc

SEQ ID NO: 15210 - DNA, 20 bp, Artificial
  CRISPR gRNA sequence
ggggtttcactatgttggcc

SEQ ID NO: 15211 - DNA, 20 bp, Artificial
  CRISPR gRNA sequence
tttcactatgttggccaggc

SEQ ID NO: 15212 - DNA, 20 bp, Artificial
  CRISPR gRNA sequence
tggtctcgaactcctgacct

SEQ ID NO: 15213 - DNA, 20 bp, Artificial
  CRISPR gRNA sequence
ggtctcgaactcctgacctc

SEQ ID NO: 15214 - DNA, 20 bp, Artificial
  CRISPR gRNA sequence
ctcaggtgatccacctgcct

SEQ ID NO: 15215 - DNA, 20 bp, Artificial
  CRISPR gRNA sequence
ccacctgccttggcctccca

SEQ ID NO: 15216 - DNA, 20 bp, Artificial
  CRISPR gRNA sequence
gccttggcctcccaaagtgc

SEQ ID NO: 15217 - DNA, 20 bp, Artificial
  CRISPR gRNA sequence
ccttggcctcccaaagtgct

SEQ ID NO: 15218 - DNA, 20 bp, Artificial
  CRISPR gRNA sequence
ctcccaaagtgctgggatta

SEQ ID NO: 15219 - DNA, 20 bp, Artificial
  CRISPR gRNA sequence
tcccaaagtgctgggattac

SEQ ID NO: 15220 - DNA, 20 bp, Artificial
  CRISPR gRNA sequence
agtgctgggattacaggcat

SEQ ID NO: 15221 - DNA, 20 bp, Artificial
  CRISPR gRNA sequence
gtgctgggattacaggcata

SEQ ID NO: 15222 - DNA, 20 bp, Artificial
  CRISPR gRNA sequence
caggcataaggcaccatgca

SEQ ID NO: 15223 - DNA, 20 bp, Artificial
  CRISPR gRNA sequence
cattccttcatttactcact

SEQ ID NO: 15224 - DNA, 20 bp, Artificial
  CRISPR gRNA sequence
tgatcactactcactcacca

SEQ ID NO: 15225 - DNA, 20 bp, Artificial
  CRISPR gRNA sequence
gatcactactcactcaccat

SEQ ID NO: 15226 - DNA, 20 bp, Artificial
  CRISPR gRNA sequence
atcactactcactcaccatg

SEQ ID NO: 15227 - DNA, 20 bp, Artificial
  CRISPR gRNA sequence
cactactcactcaccatggg

SEQ ID NO: 15228 - DNA, 20 bp, Artificial
  CRISPR gRNA sequence
actactcactcaccatgggg

SEQ ID NO: 15229 - DNA, 20 bp, Artificial
  CRISPR gRNA sequence
cactcaccatggggaggtca

SEQ ID NO: 15230 - DNA, 20 bp, Artificial
  CRISPR gRNA sequence
actcaccatggggaggtcat

SEQ ID NO: 15231 - DNA, 20 bp, Artificial
  CRISPR gRNA sequence
tcaccatggggaggtcatgg

SEQ ID NO: 15232 - DNA, 20 bp, Artificial
  CRISPR gRNA sequence
caccatggggaggtcatggg

SEQ ID NO: 15233 - DNA, 20 bp, Artificial
  CRISPR gRNA sequence
accatggggaggtcatggga

SEQ ID NO: 15234 - DNA, 20 bp, Artificial
  CRISPR gRNA sequence
catggggaggtcatgggagg

SEQ ID NO: 15235 - DNA, 20 bp, Artificial
  CRISPR gRNA sequence
aggtcatgggagggagtgtt

SEQ ID NO: 15236 - DNA, 20 bp, Artificial
  CRISPR gRNA sequence
gtcatgggagggagtgttaa

SEQ ID NO: 15237 - DNA, 20 bp, Artificial
  CRISPR gRNA sequence
gggagggagtgttaagagtt

SEQ ID NO: 15238 - DNA, 20 bp, Artificial
  CRISPR gRNA sequence
gggagtgttaagagttaaga

SEQ ID NO: 15239 - DNA, 20 bp, Artificial
  CRISPR gRNA sequence
agtgttaagagttaagacag

SEQ ID NO: 15240 - DNA, 20 bp, Artificial
  CRISPR gRNA sequence
tgttaagagttaagacagtg

SEQ ID NO: 15241 - DNA, 20 bp, Artificial
  CRISPR gRNA sequence
gacagtggagcccacgtgtc

SEQ ID NO: 15242 - DNA, 20 bp, Artificial
  CRISPR gRNA sequence
acagtggagcccacgtgtct

SEQ ID NO: 15243 - DNA, 20 bp, Artificial
  CRISPR gRNA sequence
acgtgtctgggttcaaatcc

SEQ ID NO: 15244 - DNA, 20 bp, Artificial
  CRISPR gRNA sequence
atcccggttctaccacttgc

SEQ ID NO: 15245 - DNA, 20 bp, Artificial
  CRISPR gRNA sequence
cccggttctaccacttgctg

SEQ ID NO: 15246 - DNA, 20 bp, Artificial
  CRISPR gRNA sequence
ccacttgctggagcaattct

SEQ ID NO: 15247 - DNA, 20 bp, Artificial
  CRISPR gRNA sequence
ctatacatcccaccatgcct

SEQ ID NO: 15248 - DNA, 20 bp, Artificial
  CRISPR gRNA sequence
tacatcccaccatgcctcag

SEQ ID NO: 15249 - DNA, 20 bp, Artificial
  CRISPR gRNA sequence
catgcctcagtagcctcatc

SEQ ID NO: 15250 - DNA, 20 bp, Artificial
  CRISPR gRNA sequence
cagtagcctcatctggaaaa

SEQ ID NO: 15251 - DNA, 20 bp, Artificial
  CRISPR gRNA sequence
agtagcctcatctggaaaat

SEQ ID NO: 15252 - DNA, 20 bp, Artificial
  CRISPR gRNA sequence
gtagcctcatctggaaaatg

SEQ ID NO: 15253 - DNA, 20 bp, Artificial
  CRISPR gRNA sequence
ctggaaaatggggataatat

SEQ ID NO: 15254 - DNA, 20 bp, Artificial
  CRISPR gRNA sequence
tggaaaatggggataatatt

SEQ ID NO: 15255 - DNA, 20 bp, Artificial
  CRISPR gRNA sequence
ggataatattgggattgtgt

SEQ ID NO: 15256 - DNA, 20 bp, Artificial
  CRISPR gRNA sequence
tgtgtgagatgttaatgatt

SEQ ID NO: 15257 - DNA, 20 bp, Artificial
  CRISPR gRNA sequence
tttagcatacctaacatgct

SEQ ID NO: 15258 - DNA, 20 bp, Artificial
  CRISPR gRNA sequence
catacctaacatgcttagac

SEQ ID NO: 15259 - DNA, 20 bp, Artificial
  CRISPR gRNA sequence
acatgcttagaccagtatgt

SEQ ID NO: 15260 - DNA, 20 bp, Artificial
  CRISPR gRNA sequence
atgcttagaccagtatgtga

SEQ ID NO: 15261 - DNA, 20 bp, Artificial
  CRISPR gRNA sequence
ttagaccagtatgtgagagt

SEQ ID NO: 15262 - DNA, 20 bp, Artificial
  CRISPR gRNA sequence
agtatgtgagagtaagcatt

SEQ ID NO: 15263 - DNA, 20 bp, Artificial
  CRISPR gRNA sequence
agagtaagcatttagtaatt

SEQ ID NO: 15264 - DNA, 20 bp, Artificial
  CRISPR gRNA sequence
ttagtaattctcttattcac

SEQ ID NO: 15265 - DNA, 20 bp, Artificial
  CRISPR gRNA sequence
ttgcccctcattcattctct

SEQ ID NO: 15266 - DNA, 20 bp, Artificial
  CRISPR gRNA sequence
attctctcagcctgacaatg

SEQ ID NO: 15267 - DNA, 20 bp, Artificial
  CRISPR gRNA sequence
gacaatgaagtgttaacacc

SEQ ID NO: 15268 - DNA, 20 bp, Artificial
  CRISPR gRNA sequence
tgaagtgttaacacccagtg

SEQ ID NO: 15269 - DNA, 20 bp, Artificial
  CRISPR gRNA sequence
gaagtgttaacacccagtgc

SEQ ID NO: 15270 - DNA, 20 bp, Artificial
  CRISPR gRNA sequence
cacccagtgcaggcttattg

SEQ ID NO: 15271 - DNA, 20 bp, Artificial
  CRISPR gRNA sequence
acccagtgcaggcttattga

SEQ ID NO: 15272 - DNA, 20 bp, Artificial
  CRISPR gRNA sequence
cccagtgcaggcttattgaa

SEQ ID NO: 15273 - DNA, 20 bp, Artificial
  CRISPR gRNA sequence
aagggcaataaatattattt

SEQ ID NO: 15274 - DNA, 20 bp, Artificial
  CRISPR gRNA sequence
agggcaataaatattatttg

SEQ ID NO: 15275 - DNA, 20 bp, Artificial
  CRISPR gRNA sequence
gggcaataaatattatttga

SEQ ID NO: 15276 - DNA, 20 bp, Artificial
  CRISPR gRNA sequence
gcaataaatattatttgagg

SEQ ID NO: 15277 - DNA, 20 bp, Artificial
  CRISPR gRNA sequence
ataaatattatttgagggag

SEQ ID NO: 15278 - DNA, 20 bp, Artificial
  CRISPR gRNA sequence
aatattatttgagggagtgg

SEQ ID NO: 15279 - DNA, 20 bp, Artificial
  CRISPR gRNA sequence
tattatttgagggagtggtg

SEQ ID NO: 15280 - DNA, 20 bp, Artificial
  CRISPR gRNA sequence
tgagggagtggtggagtgaa

SEQ ID NO: 15281 - DNA, 20 bp, Artificial
  CRISPR gRNA sequence
tggagtgaatggtgaaatga

SEQ ID NO: 15282 - DNA, 20 bp, Artificial
  CRISPR gRNA sequence
aaatgatggcataatcaaat

SEQ ID NO: 15283 - DNA, 20 bp, Artificial
  CRISPR gRNA sequence
gaatgaatgaataaataaat

SEQ ID NO: 15284 - DNA, 20 bp, Artificial
  CRISPR gRNA sequence
gaataaataaatgagtgtgt

SEQ ID NO: 15285 - DNA, 20 bp, Artificial
  CRISPR gRNA sequence
aatgagtgtgtgagccaaca

SEQ ID NO: 15286 - DNA, 20 bp, Artificial
  CRISPR gRNA sequence
gagtgtgtgagccaacaaag

SEQ ID NO: 15287 - DNA, 20 bp, Artificial
  CRISPR gRNA sequence
agtgtgtgagccaacaaaga

SEQ ID NO: 15288 - DNA, 20 bp, Artificial
  CRISPR gRNA sequence
gtgtgtgagccaacaaagaa

SEQ ID NO: 15289 - DNA, 20 bp, Artificial
  CRISPR gRNA sequence
tgtgtgagccaacaaagaag

SEQ ID NO: 15290 - DNA, 20 bp, Artificial
  CRISPR gRNA sequence
caacaaagaaggggttgaat

SEQ ID NO: 15291 - DNA, 20 bp, Artificial
  CRISPR gRNA sequence
gaaggggttgaataagtgtc

SEQ ID NO: 15292 - DNA, 20 bp, Artificial
  CRISPR gRNA sequence
tgaataagtgtcaagtgaat

SEQ ID NO: 15293 - DNA, 20 bp, Artificial
  CRISPR gRNA sequence
tcaagtgaatgagcaatgtg

SEQ ID NO: 15294 - DNA, 20 bp, Artificial
  CRISPR gRNA sequence
gtgaatgagcaatgtgaagc

SEQ ID NO: 15295 - DNA, 20 bp, Artificial
  CRISPR gRNA sequence
gagcaatgtgaagccagata

SEQ ID NO: 15296 - DNA, 20 bp, Artificial
  CRISPR gRNA sequence
agcaatgtgaagccagatat

SEQ ID NO: 15297 - DNA, 20 bp, Artificial
  CRISPR gRNA sequence
gggcttccatctccaccacc

SEQ ID NO: 15298 - DNA, 20 bp, Artificial
  CRISPR gRNA sequence
ggcttccatctccaccaccc

SEQ ID NO: 15299 - DNA, 20 bp, Artificial
  CRISPR gRNA sequence
gcttccatctccaccaccca

SEQ ID NO: 15300 - DNA, 20 bp, Artificial
  CRISPR gRNA sequence
tccatctccaccacccaggg

SEQ ID NO: 15301 - DNA, 20 bp, Artificial
  CRISPR gRNA sequence
catctccaccacccagggca

SEQ ID NO: 15302 - DNA, 20 bp, Artificial
  CRISPR gRNA sequence
tctccaccacccagggcaga

SEQ ID NO: 15303 - DNA, 20 bp, Artificial
  CRISPR gRNA sequence
agagatcccgcatcactcac

SEQ ID NO: 15304 - DNA, 20 bp, Artificial
  CRISPR gRNA sequence
gagatcccgcatcactcacc

SEQ ID NO: 15305 - DNA, 20 bp, Artificial
  CRISPR gRNA sequence
catcactcaccaggccattt

SEQ ID NO: 15306 - DNA, 20 bp, Artificial
  CRISPR gRNA sequence
cactcaccaggccattttgg

SEQ ID NO: 15307 - DNA, 20 bp, Artificial
  CRISPR gRNA sequence
aggccattttggaagcttgt

SEQ ID NO: 15308 - DNA, 20 bp, Artificial
  CRISPR gRNA sequence
gccattttggaagcttgttg

SEQ ID NO: 15309 - DNA, 20 bp, Artificial
  CRISPR gRNA sequence
aagcttgttggagacctctc

SEQ ID NO: 15310 - DNA, 20 bp, Artificial
  CRISPR gRNA sequence
ttggagacctctccagctgc

SEQ ID NO: 15311 - DNA, 20 bp, Artificial
  CRISPR gRNA sequence
tggagacctctccagctgcc

SEQ ID NO: 15312 - DNA, 20 bp, Artificial
  CRISPR gRNA sequence
cctctccagctgccgggcat

SEQ ID NO: 15313 - DNA, 20 bp, Artificial
  CRISPR gRNA sequence
ctctccagctgccgggcatt

SEQ ID NO: 15314 - DNA, 20 bp, Artificial
  CRISPR gRNA sequence
tccagctgccgggcattggg

SEQ ID NO: 15315 - DNA, 20 bp, Artificial
  CRISPR gRNA sequence
ccagctgccgggcattgggt

SEQ ID NO: 15316 - DNA, 20 bp, Artificial
  CRISPR gRNA sequence
cagctgccgggcattgggtg

SEQ ID NO: 15317 - DNA, 20 bp, Artificial
  CRISPR gRNA sequence
agctgccgggcattgggtgg

SEQ ID NO: 15318 - DNA, 20 bp, Artificial
  CRISPR gRNA sequence
gtgggggacgtcttgtgctc

SEQ ID NO: 15319 - DNA, 20 bp, Artificial
  CRISPR gRNA sequence
gggggacgtcttgtgctctg

SEQ ID NO: 15320 - DNA, 20 bp, Artificial
  CRISPR gRNA sequence
gacgtcttgtgctctggaga

SEQ ID NO: 15321 - DNA, 20 bp, Artificial
  CRISPR gRNA sequence
cgtcttgtgctctggagatg

SEQ ID NO: 15322 - DNA, 20 bp, Artificial
  CRISPR gRNA sequence
cttgtgctctggagatggag

SEQ ID NO: 15323 - DNA, 20 bp, Artificial
  CRISPR gRNA sequence
gtgctctggagatggagaag

SEQ ID NO: 15324 - DNA, 20 bp, Artificial
  CRISPR gRNA sequence
tgctctggagatggagaagc

SEQ ID NO: 15325 - DNA, 20 bp, Artificial
  CRISPR gRNA sequence
ggagatggagaagcaggtgc

SEQ ID NO: 15326 - DNA, 20 bp, Artificial
  CRISPR gRNA sequence
ggagaagcaggtgccagatt

SEQ ID NO: 15327 - DNA, 20 bp, Artificial
  CRISPR gRNA sequence
gagaagcaggtgccagattt

SEQ ID NO: 15328 - DNA, 20 bp, Artificial
  CRISPR gRNA sequence
agaagcaggtgccagattta

SEQ ID NO: 15329 - DNA, 20 bp, Artificial
  CRISPR gRNA sequence
gcaggtgccagatttagggt

SEQ ID NO: 15330 - DNA, 20 bp, Artificial
  CRISPR gRNA sequence
caggtgccagatttagggtg

SEQ ID NO: 15331 - DNA, 20 bp, Artificial
  CRISPR gRNA sequence
aggtgccagatttagggtga

SEQ ID NO: 15332 - DNA, 20 bp, Artificial
  CRISPR gRNA sequence
tttagggtgagggttacccc

SEQ ID NO: 15333 - DNA, 20 bp, Artificial
  CRISPR gRNA sequence
ttagggtgagggttacccct

SEQ ID NO: 15334 - DNA, 20 bp, Artificial
  CRISPR gRNA sequence
tagggtgagggttacccctg

SEQ ID NO: 15335 - DNA, 20 bp, Artificial
  CRISPR gRNA sequence
cctggggacccccctccctc

SEQ ID NO: 15336 - DNA, 20 bp, Artificial
  CRISPR gRNA sequence
ctggggacccccctccctct

SEQ ID NO: 15337 - DNA, 20 bp, Artificial
  CRISPR gRNA sequence
ccccctccctctgggccact

SEQ ID NO: 15338 - DNA, 20 bp, Artificial
  CRISPR gRNA sequence
tctgggccacttagtcctta

SEQ ID NO: 15339 - DNA, 20 bp, Artificial
  CRISPR gRNA sequence
cttagtccttacagccttca

SEQ ID NO: 15340 - DNA, 20 bp, Artificial
  CRISPR gRNA sequence
ttagtccttacagccttcat

SEQ ID NO: 15341 - DNA, 20 bp, Artificial
  CRISPR gRNA sequence
ccttacagccttcatgggct

SEQ ID NO: 15342 - DNA, 20 bp, Artificial
  CRISPR gRNA sequence
cttcatgggctgagtttccc

SEQ ID NO: 15343 - DNA, 20 bp, Artificial
  CRISPR gRNA sequence
atgggctgagtttcccaaga

SEQ ID NO: 15344 - DNA, 20 bp, Artificial
  CRISPR gRNA sequence
gggctgagtttcccaagatg

SEQ ID NO: 15345 - DNA, 20 bp, Artificial
  CRISPR gRNA sequence
ggctgagtttcccaagatgg

SEQ ID NO: 15346 - DNA, 20 bp, Artificial
  CRISPR gRNA sequence
tttcccaagatggaggttat

SEQ ID NO: 15347 - DNA, 20 bp, Artificial
  CRISPR gRNA sequence
ccaagatggaggttataaga

SEQ ID NO: 15348 - DNA, 20 bp, Artificial
  CRISPR gRNA sequence
agatggaggttataagatag

SEQ ID NO: 15349 - DNA, 20 bp, Artificial
  CRISPR gRNA sequence
aggttataagatagcggcct

SEQ ID NO: 15350 - DNA, 20 bp, Artificial
  CRISPR gRNA sequence
ggttataagatagcggcctg

SEQ ID NO: 15351 - DNA, 20 bp, Artificial
  CRISPR gRNA sequence
aactcaaatatgtctttctt

SEQ ID NO: 15352 - DNA, 20 bp, Artificial
  CRISPR gRNA sequence
aatttcactcatgtttaaaa

SEQ ID NO: 15353 - DNA, 20 bp, Artificial
  CRISPR gRNA sequence
aaaaaagaaaatcgcaatat

SEQ ID NO: 15354 - DNA, 20 bp, Artificial
  CRISPR gRNA sequence
aaaaagaaaatcgcaatatc

SEQ ID NO: 15355 - DNA, 20 bp, Artificial
  CRISPR gRNA sequence
agaaaatcgcaatatcaggc

SEQ ID NO: 15356 - DNA, 20 bp, Artificial
  CRISPR gRNA sequence
gaaaatcgcaatatcaggct

SEQ ID NO: 15357 - DNA, 20 bp, Artificial
  CRISPR gRNA sequence
tcgcaatatcaggctgggtg

SEQ ID NO: 15358 - DNA, 20 bp, Artificial
  CRISPR gRNA sequence
caatatcaggctgggtgcag

SEQ ID NO: 15359 - DNA, 20 bp, Artificial
  CRISPR gRNA sequence
gtggctcacacctgtaatcc

SEQ ID NO: 15360 - DNA, 20 bp, Artificial
  CRISPR gRNA sequence
cacctgtaatcccagcactt

SEQ ID NO: 15361 - DNA, 20 bp, Artificial
  CRISPR gRNA sequence
acctgtaatcccagcacttt

SEQ ID NO: 15362 - DNA, 20 bp, Artificial
  CRISPR gRNA sequence
ctgtaatcccagcactttgg

SEQ ID NO: 15363 - DNA, 20 bp, Artificial
  CRISPR gRNA sequence
tgtaatcccagcactttggg

SEQ ID NO: 15364 - DNA, 20 bp, Artificial
  CRISPR gRNA sequence
tcccagcactttgggaggtc

SEQ ID NO: 15365 - DNA, 20 bp, Artificial
  CRISPR gRNA sequence
cccagcactttgggaggtcg

SEQ ID NO: 15366 - DNA, 20 bp, Artificial
  CRISPR gRNA sequence
agcactttgggaggtcgagg

SEQ ID NO: 15367 - DNA, 20 bp, Artificial
  CRISPR gRNA sequence
gcactttgggaggtcgaggc

SEQ ID NO: 15368 - DNA, 20 bp, Artificial
  CRISPR gRNA sequence
ctttgggaggtcgaggcagg

SEQ ID NO: 15369 - DNA, 20 bp, Artificial
  CRISPR gRNA sequence
tcgaggcaggtggatcactt

SEQ ID NO: 15370 - DNA, 20 bp, Artificial
  CRISPR gRNA sequence
gcaggtggatcacttgagat

SEQ ID NO: 15371 - DNA, 20 bp, Artificial
  CRISPR gRNA sequence
caggtggatcacttgagatc

SEQ ID NO: 15372 - DNA, 20 bp, Artificial
  CRISPR gRNA sequence
ggtggatcacttgagatcag

SEQ ID NO: 15373 - DNA, 20 bp, Artificial
  CRISPR gRNA sequence
tcacttgagatcaggagttc

SEQ ID NO: 15374 - DNA, 20 bp, Artificial
  CRISPR gRNA sequence
tgagatcaggagttcgagac

SEQ ID NO: 15375 - DNA, 20 bp, Artificial
  CRISPR gRNA sequence
tcaggagttcgagaccagcc

SEQ ID NO: 15376 - DNA, 20 bp, Artificial
  CRISPR gRNA sequence
cgagaccagcctggccaaca

SEQ ID NO: 15377 - DNA, 20 bp, Artificial
  CRISPR gRNA sequence
tctactgaaattacaaaaat

SEQ ID NO: 15378 - DNA, 20 bp, Artificial
  CRISPR gRNA sequence
ctgaaattacaaaaattggc

SEQ ID NO: 15379 - DNA, 20 bp, Artificial
  CRISPR gRNA sequence
tgaaattacaaaaattggct

SEQ ID NO: 15380 - DNA, 20 bp, Artificial
  CRISPR gRNA sequence
caaaaattggctgggtgtga

SEQ ID NO: 15381 - DNA, 20 bp, Artificial
  CRISPR gRNA sequence
acggtgcacacctgtaattc

SEQ ID NO: 15382 - DNA, 20 bp, Artificial
  CRISPR gRNA sequence
acctgtaattccagctgctc

SEQ ID NO: 15383 - DNA, 20 bp, Artificial
  CRISPR gRNA sequence
ctgtaattccagctgctccg

SEQ ID NO: 15384 - DNA, 20 bp, Artificial
  CRISPR gRNA sequence
tgtaattccagctgctccgg

SEQ ID NO: 15385 - DNA, 20 bp, Artificial
  CRISPR gRNA sequence
ttccagctgctccggaggct

SEQ ID NO: 15386 - DNA, 20 bp, Artificial
  CRISPR gRNA sequence
tccagctgctccggaggctg

SEQ ID NO: 15387 - DNA, 20 bp, Artificial
  CRISPR gRNA sequence
agctgctccggaggctgagg

SEQ ID NO: 15388 - DNA, 20 bp, Artificial
  CRISPR gRNA sequence
gctgctccggaggctgaggc

SEQ ID NO: 15389 - DNA, 20 bp, Artificial
  CRISPR gRNA sequence
tgctccggaggctgaggcag

SEQ ID NO: 15390 - DNA, 20 bp, Artificial
  CRISPR gRNA sequence
aggagaatcacttgaacctg

SEQ ID NO: 15391 - DNA, 20 bp, Artificial
  CRISPR gRNA sequence
ggagaatcacttgaacctgt

SEQ ID NO: 15392 - DNA, 20 bp, Artificial
  CRISPR gRNA sequence
gagaatcacttgaacctgta

SEQ ID NO: 15393 - DNA, 20 bp, Artificial
  CRISPR gRNA sequence
aatcacttgaacctgtaggg

SEQ ID NO: 15394 - DNA, 20 bp, Artificial
  CRISPR gRNA sequence
tcacttgaacctgtagggcg

SEQ ID NO: 15395 - DNA, 20 bp, Artificial
  CRISPR gRNA sequence
cacttgaacctgtagggcgg

SEQ ID NO: 15396 - DNA, 20 bp, Artificial
  CRISPR gRNA sequence
aacctgtagggcggaggttg

SEQ ID NO: 15397 - DNA, 20 bp, Artificial
  CRISPR gRNA sequence
ggcggaggttgcagtgatct

SEQ ID NO: 15398 - DNA, 20 bp, Artificial
  CRISPR gRNA sequence
gagatcgcaccactgcactc

SEQ ID NO: 15399 - DNA, 20 bp, Artificial
  CRISPR gRNA sequence
cgcaccactgcactctagcc

SEQ ID NO: 15400 - DNA, 20 bp, Artificial
  CRISPR gRNA sequence
gcaccactgcactctagcct

SEQ ID NO: 15401 - DNA, 20 bp, Artificial
  CRISPR gRNA sequence
ctgcactctagcctgggcaa

SEQ ID NO: 15402 - DNA, 20 bp, Artificial
  CRISPR gRNA sequence
gcactctagcctgggcaaca

SEQ ID NO: 15403 - DNA, 20 bp, Artificial
  CRISPR gRNA sequence
tctagcctgggcaacagagt

SEQ ID NO: 15404 - DNA, 20 bp, Artificial
  CRISPR gRNA sequence
cacaatatctatgtaaaaat

SEQ ID NO: 15405 - DNA, 20 bp, Artificial
  CRISPR gRNA sequence
acaatatctatgtaaaaatc

SEQ ID NO: 15406 - DNA, 20 bp, Artificial
  CRISPR gRNA sequence
caatatctatgtaaaaatca

SEQ ID NO: 15407 - DNA, 20 bp, Artificial
  CRISPR gRNA sequence
atcagggttttcaacttcaa

SEQ ID NO: 15408 - DNA, 20 bp, Artificial
  CRISPR gRNA sequence
aaagatctgaccacattgtc

SEQ ID NO: 15409 - DNA, 20 bp, Artificial
  CRISPR gRNA sequence
acattgtctggcttttctgc

SEQ ID NO: 15410 - DNA, 20 bp, Artificial
  CRISPR gRNA sequence
cattgtctggcttttctgct

SEQ ID NO: 15411 - DNA, 20 bp, Artificial
  CRISPR gRNA sequence
tggcttttctgctgggtaac

SEQ ID NO: 15412 - DNA, 20 bp, Artificial
  CRISPR gRNA sequence
cttttctgctgggtaacaag

SEQ ID NO: 15413 - DNA, 20 bp, Artificial
  CRISPR gRNA sequence
tgctgggtaacaagcagctg

SEQ ID NO: 15414 - DNA, 20 bp, Artificial
  CRISPR gRNA sequence
gctgggtaacaagcagctga

SEQ ID NO: 15415 - DNA, 20 bp, Artificial
  CRISPR gRNA sequence
aacaagcagctgaaggctga

SEQ ID NO: 15416 - DNA, 20 bp, Artificial
  CRISPR gRNA sequence
tgaaggctgatggctgtatt

SEQ ID NO: 15417 - DNA, 20 bp, Artificial
  CRISPR gRNA sequence
ggctgatggctgtatttgga

SEQ ID NO: 15418 - DNA, 20 bp, Artificial
  CRISPR gRNA sequence
gctgatggctgtatttggat

SEQ ID NO: 15419 - DNA, 20 bp, Artificial
  CRISPR gRNA sequence
ggctgtatttggatgggatg

SEQ ID NO: 15420 - DNA, 20 bp, Artificial
  CRISPR gRNA sequence
tggatgggatgtggattctc

SEQ ID NO: 15421 - DNA, 20 bp, Artificial
  CRISPR gRNA sequence
acaaccatgcctccactccc

SEQ ID NO: 15422 - DNA, 20 bp, Artificial
  CRISPR gRNA sequence
aaccatgcctccactccctg

SEQ ID NO: 15423 - DNA, 20 bp, Artificial
  CRISPR gRNA sequence
aacatgacctgttgtcccta

SEQ ID NO: 15424 - DNA, 20 bp, Artificial
  CRISPR gRNA sequence
acatgacctgttgtccctac

SEQ ID NO: 15425 - DNA, 20 bp, Artificial
  CRISPR gRNA sequence
tgacctgttgtccctacagg

SEQ ID NO: 15426 - DNA, 20 bp, Artificial
  CRISPR gRNA sequence
cctacaggcagctttgcttg

SEQ ID NO: 15427 - DNA, 20 bp, Artificial
  CRISPR gRNA sequence
tttgcttgtggatcttattt

SEQ ID NO: 15428 - DNA, 20 bp, Artificial
  CRISPR gRNA sequence
atttgagacaattccttccc

SEQ ID NO: 15429 - DNA, 20 bp, Artificial
  CRISPR gRNA sequence
tttgagacaattccttcccc

SEQ ID NO: 15430 - DNA, 20 bp, Artificial
  CRISPR gRNA sequence
ttgagacaattccttcccca

SEQ ID NO: 15431 - DNA, 20 bp, Artificial
  CRISPR gRNA sequence
cagggcctcgatcctgcttc

SEQ ID NO: 15432 - DNA, 20 bp, Artificial
  CRISPR gRNA sequence
cctgcttctagtacctctca

SEQ ID NO: 15433 - DNA, 20 bp, Artificial
  CRISPR gRNA sequence
ctgcttctagtacctctcac

SEQ ID NO: 15434 - DNA, 20 bp, Artificial
  CRISPR gRNA sequence
tagtacctctcacaggccct

SEQ ID NO: 15435 - DNA, 20 bp, Artificial
  CRISPR gRNA sequence
agtacctctcacaggcccta

SEQ ID NO: 15436 - DNA, 20 bp, Artificial
  CRISPR gRNA sequence
gtacctctcacaggccctaa

SEQ ID NO: 15437 - DNA, 20 bp, Artificial
  CRISPR gRNA sequence
ccttacctgtcatgtttgct

SEQ ID NO: 15438 - DNA, 20 bp, Artificial
  CRISPR gRNA sequence
cttacctgtcatgtttgctc

SEQ ID NO: 15439 - DNA, 20 bp, Artificial
  CRISPR gRNA sequence
tacctgtcatgtttgctcgg

SEQ ID NO: 15440 - DNA, 20 bp, Artificial
  CRISPR gRNA sequence
acctgtcatgtttgctcggg

SEQ ID NO: 15441 - DNA, 20 bp, Artificial
  CRISPR gRNA sequence
gtcatgtttgctcgggaggt

SEQ ID NO: 15442 - DNA, 20 bp, Artificial
  CRISPR gRNA sequence
tcatgtttgctcgggaggtc

SEQ ID NO: 15443 - DNA, 20 bp, Artificial
  CRISPR gRNA sequence
catgtttgctcgggaggtca

SEQ ID NO: 15444 - DNA, 20 bp, Artificial
  CRISPR gRNA sequence
gtttgctcgggaggtcaggg

SEQ ID NO: 15445 - DNA, 20 bp, Artificial
  CRISPR gRNA sequence
tttgctcgggaggtcagggc

SEQ ID NO: 15446 - DNA, 20 bp, Artificial
  CRISPR gRNA sequence
tcgggaggtcagggcaggtt

SEQ ID NO: 15447 - DNA, 20 bp, Artificial
  CRISPR gRNA sequence
cgggaggtcagggcaggttc

SEQ ID NO: 15448 - DNA, 20 bp, Artificial
  CRISPR gRNA sequence
cagggcaggttcaggcatgc

SEQ ID NO: 15449 - DNA, 20 bp, Artificial
  CRISPR gRNA sequence
agggcaggttcaggcatgct

SEQ ID NO: 15450 - DNA, 20 bp, Artificial
  CRISPR gRNA sequence
gcaggttcaggcatgctggg

SEQ ID NO: 15451 - DNA, 20 bp, Artificial
  CRISPR gRNA sequence
caggttcaggcatgctgggc

SEQ ID NO: 15452 - DNA, 20 bp, Artificial
  CRISPR gRNA sequence
ttcaggcatgctgggcaggt

SEQ ID NO: 15453 - DNA, 20 bp, Artificial
  CRISPR gRNA sequence
aggcatgctgggcaggtcag

SEQ ID NO: 15454 - DNA, 20 bp, Artificial
  CRISPR gRNA sequence
ctgggcaggtcagtggctga

SEQ ID NO: 15455 - DNA, 20 bp, Artificial
  CRISPR gRNA sequence
gggcaggtcagtggctgatg

SEQ ID NO: 15456 - DNA, 20 bp, Artificial
  CRISPR gRNA sequence
ggtcagtggctgatggagcg

SEQ ID NO: 15457 - DNA, 20 bp, Artificial
  CRISPR gRNA sequence
gtcagtggctgatggagcga

SEQ ID NO: 15458 - DNA, 20 bp, Artificial
  CRISPR gRNA sequence
tcagtggctgatggagcgaa

SEQ ID NO: 15459 - DNA, 20 bp, Artificial
  CRISPR gRNA sequence
cagtggctgatggagcgaag

SEQ ID NO: 15460 - DNA, 20 bp, Artificial
  CRISPR gRNA sequence
ggctgatggagcgaaggggc

SEQ ID NO: 15461 - DNA, 20 bp, Artificial
  CRISPR gRNA sequence
tgatggagcgaaggggctgg

SEQ ID NO: 15462 - DNA, 20 bp, Artificial
  CRISPR gRNA sequence
atggagcgaaggggctggtg

SEQ ID NO: 15463 - DNA, 20 bp, Artificial
  CRISPR gRNA sequence
gcgaaggggctggtggagcc

SEQ ID NO: 15464 - DNA, 20 bp, Artificial
  CRISPR gRNA sequence
aggggctggtggagcctggc

SEQ ID NO: 15465 - DNA, 20 bp, Artificial
  CRISPR gRNA sequence
ctggtggagcctggccggtc

SEQ ID NO: 15466 - DNA, 20 bp, Artificial
  CRISPR gRNA sequence
ggtggagcctggccggtctg

SEQ ID NO: 15467 - DNA, 20 bp, Artificial
  CRISPR gRNA sequence
cctggccggtctggagatgt

SEQ ID NO: 15468 - DNA, 20 bp, Artificial
  CRISPR gRNA sequence
ctggccggtctggagatgtt

SEQ ID NO: 15469 - DNA, 20 bp, Artificial
  CRISPR gRNA sequence
ggccggtctggagatgttgg

SEQ ID NO: 15470 - DNA, 20 bp, Artificial
  CRISPR gRNA sequence
gccggtctggagatgttggg

SEQ ID NO: 15471 - DNA, 20 bp, Artificial
  CRISPR gRNA sequence
ctggagatgttgggaggccg

SEQ ID NO: 15472 - DNA, 20 bp, Artificial
  CRISPR gRNA sequence
agatgttgggaggccgtgga

SEQ ID NO: 15473 - DNA, 20 bp, Artificial
  CRISPR gRNA sequence
gccgtggacagtgaatccac

SEQ ID NO: 15474 - DNA, 20 bp, Artificial
  CRISPR gRNA sequence
ccgtggacagtgaatccact

SEQ ID NO: 15475 - DNA, 20 bp, Artificial
  CRISPR gRNA sequence
gtggacagtgaatccactgg

SEQ ID NO: 15476 - DNA, 20 bp, Artificial
  CRISPR gRNA sequence
tggacagtgaatccactggg

SEQ ID NO: 15477 - DNA, 20 bp, Artificial
  CRISPR gRNA sequence
ggacagtgaatccactggga

SEQ ID NO: 15478 - DNA, 20 bp, Artificial
  CRISPR gRNA sequence
gacagtgaatccactgggag

SEQ ID NO: 15479 - DNA, 20 bp, Artificial
  CRISPR gRNA sequence
acagtgaatccactgggagg

SEQ ID NO: 15480 - DNA, 20 bp, Artificial
  CRISPR gRNA sequence
atccactgggagggggtact

SEQ ID NO: 15481 - DNA, 20 bp, Artificial
  CRISPR gRNA sequence
actgggagggggtacttggc

SEQ ID NO: 15482 - DNA, 20 bp, Artificial
  CRISPR gRNA sequence
gagggggtacttggctggcc

SEQ ID NO: 15483 - DNA, 20 bp, Artificial
  CRISPR gRNA sequence
agggggtacttggctggcct

SEQ ID NO: 15484 - DNA, 20 bp, Artificial
  CRISPR gRNA sequence
gggggtacttggctggcctg

SEQ ID NO: 15485 - DNA, 20 bp, Artificial
  CRISPR gRNA sequence
ctggggcacctcacctacat

SEQ ID NO: 15486 - DNA, 20 bp, Artificial
  CRISPR gRNA sequence
tggggcacctcacctacatt

SEQ ID NO: 15487 - DNA, 20 bp, Artificial
  CRISPR gRNA sequence
ggggcacctcacctacattg

SEQ ID NO: 15488 - DNA, 20 bp, Artificial
  CRISPR gRNA sequence
gggcacctcacctacattgg

SEQ ID NO: 15489 - DNA, 20 bp, Artificial
  CRISPR gRNA sequence
cacctcacctacattggggg

SEQ ID NO: 15490 - DNA, 20 bp, Artificial
  CRISPR gRNA sequence
cctcacctacattgggggtg

SEQ ID NO: 15491 - DNA, 20 bp, Artificial
  CRISPR gRNA sequence
tcacctacattgggggtgga

SEQ ID NO: 15492 - DNA, 20 bp, Artificial
  CRISPR gRNA sequence
cctacattgggggtggagag

SEQ ID NO: 15493 - DNA, 20 bp, Artificial
  CRISPR gRNA sequence
ttgggggtggagagtggtgt

SEQ ID NO: 15494 - DNA, 20 bp, Artificial
  CRISPR gRNA sequence
gagagtggtgtgagaataac

SEQ ID NO: 15495 - DNA, 20 bp, Artificial
  CRISPR gRNA sequence
agagtggtgtgagaataacc

SEQ ID NO: 15496 - DNA, 20 bp, Artificial
  CRISPR gRNA sequence
gaataaccaggtattgattc

SEQ ID NO: 15497 - DNA, 20 bp, Artificial
  CRISPR gRNA sequence
attgattccagaaatgcact

SEQ ID NO: 15498 - DNA, 20 bp, Artificial
  CRISPR gRNA sequence
ttgattccagaaatgcactt

SEQ ID NO: 15499 - DNA, 20 bp, Artificial
  CRISPR gRNA sequence
gggtcacccctactccaaac

SEQ ID NO: 15500 - DNA, 20 bp, Artificial
  CRISPR gRNA sequence
ggtcacccctactccaaact

SEQ ID NO: 15501 - DNA, 20 bp, Artificial
  CRISPR gRNA sequence
ccctactccaaactgggctg

SEQ ID NO: 15502 - DNA, 20 bp, Artificial
  CRISPR gRNA sequence
ctactccaaactgggctgtg

SEQ ID NO: 15503 - DNA, 20 bp, Artificial
  CRISPR gRNA sequence
ccaaactgggctgtggagct

SEQ ID NO: 15504 - DNA, 20 bp, Artificial
  CRISPR gRNA sequence
caaactgggctgtggagctc

SEQ ID NO: 15505 - DNA, 20 bp, Artificial
  CRISPR gRNA sequence
actgggctgtggagctcagg

SEQ ID NO: 15506 - DNA, 20 bp, Artificial
  CRISPR gRNA sequence
gctgtggagctcaggaagtc

SEQ ID NO: 15507 - DNA, 20 bp, Artificial
  CRISPR gRNA sequence
tgtggagctcaggaagtctg

SEQ ID NO: 15508 - DNA, 20 bp, Artificial
  CRISPR gRNA sequence
tggagctcaggaagtctgga

SEQ ID NO: 15509 - DNA, 20 bp, Artificial
  CRISPR gRNA sequence
agctcaggaagtctggagag

SEQ ID NO: 15510 - DNA, 20 bp, Artificial
  CRISPR gRNA sequence
ctcaggaagtctggagagaa

SEQ ID NO: 15511 - DNA, 20 bp, Artificial
  CRISPR gRNA sequence
caggaagtctggagagaaga

SEQ ID NO: 15512 - DNA, 20 bp, Artificial
  CRISPR gRNA sequence
gaagtctggagagaagagag

SEQ ID NO: 15513 - DNA, 20 bp, Artificial
  CRISPR gRNA sequence
agaagagagtagaacttcca

SEQ ID NO: 15514 - DNA, 20 bp, Artificial
  CRISPR gRNA sequence
gaagagagtagaacttccaa

SEQ ID NO: 15515 - DNA, 20 bp, Artificial
  CRISPR gRNA sequence
gagagtagaacttccaaagg

SEQ ID NO: 15516 - DNA, 20 bp, Artificial
  CRISPR gRNA sequence
acttccaaaggaagatattt

SEQ ID NO: 15517 - DNA, 20 bp, Artificial
  CRISPR gRNA sequence
cttccaaaggaagatatttc

SEQ ID NO: 15518 - DNA, 20 bp, Artificial
  CRISPR gRNA sequence
caaaggaagatatttcagga

SEQ ID NO: 15519 - DNA, 20 bp, Artificial
  CRISPR gRNA sequence
aaggaagatatttcaggaca

SEQ ID NO: 15520 - DNA, 20 bp, Artificial
  CRISPR gRNA sequence
gatatttcaggacagagctg

SEQ ID NO: 15521 - DNA, 20 bp, Artificial
  CRISPR gRNA sequence
tttcaggacagagctgaaga

SEQ ID NO: 15522 - DNA, 20 bp, Artificial
  CRISPR gRNA sequence
tcaggacagagctgaagaaa

SEQ ID NO: 15523 - DNA, 20 bp, Artificial
  CRISPR gRNA sequence
cagagctgaagaaagagctc

SEQ ID NO: 15524 - DNA, 20 bp, Artificial
  CRISPR gRNA sequence
gagctgaagaaagagctctg

SEQ ID NO: 15525 - DNA, 20 bp, Artificial
  CRISPR gRNA sequence
aagagctctggagttacatc

SEQ ID NO: 15526 - DNA, 20 bp, Artificial
  CRISPR gRNA sequence
ctggagttacatctagctcc

SEQ ID NO: 15527 - DNA, 20 bp, Artificial
  CRISPR gRNA sequence
tgcttttccaatctgtgaaa

SEQ ID NO: 15528 - DNA, 20 bp, Artificial
  CRISPR gRNA sequence
gcttttccaatctgtgaaat

SEQ ID NO: 15529 - DNA, 20 bp, Artificial
  CRISPR gRNA sequence
atctgtgaaatgggtgcaat

SEQ ID NO: 15530 - DNA, 20 bp, Artificial
  CRISPR gRNA sequence
aatgggtgcaattagctcat

SEQ ID NO: 15531 - DNA, 20 bp, Artificial
  CRISPR gRNA sequence
atgggtgcaattagctcata

SEQ ID NO: 15532 - DNA, 20 bp, Artificial
  CRISPR gRNA sequence
caattagctcataaggaact

SEQ ID NO: 15533 - DNA, 20 bp, Artificial
  CRISPR gRNA sequence
aattagctcataaggaactt

SEQ ID NO: 15534 - DNA, 20 bp, Artificial
  CRISPR gRNA sequence
attagctcataaggaactta

SEQ ID NO: 15535 - DNA, 20 bp, Artificial
  CRISPR gRNA sequence
agctcataaggaacttaggg

SEQ ID NO: 15536 - DNA, 20 bp, Artificial
  CRISPR gRNA sequence
gctcataaggaacttagggc

SEQ ID NO: 15537 - DNA, 20 bp, Artificial
  CRISPR gRNA sequence
attgcactcttcctgctgtg

SEQ ID NO: 15538 - DNA, 20 bp, Artificial
  CRISPR gRNA sequence
cactcttcctgctgtgtggt

SEQ ID NO: 15539 - DNA, 20 bp, Artificial
  CRISPR gRNA sequence
gtggtcagtgctcattttcc

SEQ ID NO: 15540 - DNA, 20 bp, Artificial
  CRISPR gRNA sequence
gtgctcattttcctagatat

SEQ ID NO: 15541 - DNA, 20 bp, Artificial
  CRISPR gRNA sequence
tgctcattttcctagatatc

SEQ ID NO: 15542 - DNA, 20 bp, Artificial
  CRISPR gRNA sequence
ggaactgcttctctgcttct

SEQ ID NO: 15543 - DNA, 20 bp, Artificial
  CRISPR gRNA sequence
cttctctgcttctgagatac

SEQ ID NO: 15544 - DNA, 20 bp, Artificial
  CRISPR gRNA sequence
tactgaaactgtcttgcaac

SEQ ID NO: 15545 - DNA, 20 bp, Artificial
  CRISPR gRNA sequence
actgaaactgtcttgcaacc

SEQ ID NO: 15546 - DNA, 20 bp, Artificial
  CRISPR gRNA sequence
aactgtcttgcaaccaggaa

SEQ ID NO: 15547 - DNA, 20 bp, Artificial
  CRISPR gRNA sequence
gcaaccaggaatggatgctc

SEQ ID NO: 15548 - DNA, 20 bp, Artificial
  CRISPR gRNA sequence
ggaatggatgctctggactt

SEQ ID NO: 15549 - DNA, 20 bp, Artificial
  CRISPR gRNA sequence
atggatgctctggacttgag

SEQ ID NO: 15550 - DNA, 20 bp, Artificial
  CRISPR gRNA sequence
gatgctctggacttgagtgg

SEQ ID NO: 15551 - DNA, 20 bp, Artificial
  CRISPR gRNA sequence
cttgagtggaagcatcctcc

SEQ ID NO: 15552 - DNA, 20 bp, Artificial
  CRISPR gRNA sequence
cctcctggtctcatccctga

SEQ ID NO: 15553 - DNA, 20 bp, Artificial
  CRISPR gRNA sequence
agcccaaacacaccttccct

SEQ ID NO: 15554 - DNA, 20 bp, Artificial
  CRISPR gRNA sequence
aaacacaccttccctgagac

SEQ ID NO: 15555 - DNA, 20 bp, Artificial
  CRISPR gRNA sequence
tgagacaagtcacaacccct

SEQ ID NO: 15556 - DNA, 20 bp, Artificial
  CRISPR gRNA sequence
caagtcacaacccctcagtg

SEQ ID NO: 15557 - DNA, 20 bp, Artificial
  CRISPR gRNA sequence
gtcacaacccctcagtgtgg

SEQ ID NO: 15558 - DNA, 20 bp, Artificial
  CRISPR gRNA sequence
tcacaacccctcagtgtggt

SEQ ID NO: 15559 - DNA, 20 bp, Artificial
  CRISPR gRNA sequence
aacccctcagtgtggtgggt

SEQ ID NO: 15560 - DNA, 20 bp, Artificial
  CRISPR gRNA sequence
ccctcagtgtggtgggtcag

SEQ ID NO: 15561 - DNA, 20 bp, Artificial
  CRISPR gRNA sequence
cctcagtgtggtgggtcagt

SEQ ID NO: 15562 - DNA, 20 bp, Artificial
  CRISPR gRNA sequence
ctcagtgtggtgggtcagta

SEQ ID NO: 15563 - DNA, 20 bp, Artificial
  CRISPR gRNA sequence
gtagggaccattttactgat

SEQ ID NO: 15564 - DNA, 20 bp, Artificial
  CRISPR gRNA sequence
tagggaccattttactgatt

SEQ ID NO: 15565 - DNA, 20 bp, Artificial
  CRISPR gRNA sequence
cattttactgattaggaaac

SEQ ID NO: 15566 - DNA, 20 bp, Artificial
  CRISPR gRNA sequence
gattaggaaacaagacaaat

SEQ ID NO: 15567 - DNA, 20 bp, Artificial
  CRISPR gRNA sequence
ttaggaaacaagacaaatca

SEQ ID NO: 15568 - DNA, 20 bp, Artificial
  CRISPR gRNA sequence
gaaacaagacaaatcagaga

SEQ ID NO: 15569 - DNA, 20 bp, Artificial
  CRISPR gRNA sequence
caaatcagagaaagctatgc

SEQ ID NO: 15570 - DNA, 20 bp, Artificial
  CRISPR gRNA sequence
aaatcagagaaagctatgca

SEQ ID NO: 15571 - DNA, 20 bp, Artificial
  CRISPR gRNA sequence
gcacaccaaactattcacat

SEQ ID NO: 15572 - DNA, 20 bp, Artificial
  CRISPR gRNA sequence
tattcacatcagtatactaa

SEQ ID NO: 15573 - DNA, 20 bp, Artificial
  CRISPR gRNA sequence
ttcacatcagtatactaaaa

SEQ ID NO: 15574 - DNA, 20 bp, Artificial
  CRISPR gRNA sequence
catcagtatactaaaagagt

SEQ ID NO: 15575 - DNA, 20 bp, Artificial
  CRISPR gRNA sequence
tcagtatactaaaagagtga

SEQ ID NO: 15576 - DNA, 20 bp, Artificial
  CRISPR gRNA sequence
agtatactaaaagagtgaga

SEQ ID NO: 15577 - DNA, 20 bp, Artificial
  CRISPR gRNA sequence
tactaaaagagtgagagaga

SEQ ID NO: 15578 - DNA, 20 bp, Artificial
  CRISPR gRNA sequence
ttgtaaacatcacttgtcat

SEQ ID NO: 15579 - DNA, 20 bp, Artificial
  CRISPR gRNA sequence
atcacttgtcattagcttat

SEQ ID NO: 15580 - DNA, 20 bp, Artificial
  CRISPR gRNA sequence
cttgtcattagcttattagt

SEQ ID NO: 15581 - DNA, 20 bp, Artificial
  CRISPR gRNA sequence
caaaaacatttaaaaaaaat

SEQ ID NO: 15582 - DNA, 20 bp, Artificial
  CRISPR gRNA sequence
aaaaacatttaaaaaaaata

SEQ ID NO: 15583 - DNA, 20 bp, Artificial
  CRISPR gRNA sequence
aaaaaaaataaggaaaaact

SEQ ID NO: 15584 - DNA, 20 bp, Artificial
  CRISPR gRNA sequence
aaaaaaataaggaaaaacta

SEQ ID NO: 15585 - DNA, 20 bp, Artificial
  CRISPR gRNA sequence
aaaaaataaggaaaaactaa

SEQ ID NO: 15586 - DNA, 20 bp, Artificial
  CRISPR gRNA sequence
aataaggaaaaactaagggt

SEQ ID NO: 15587 - DNA, 20 bp, Artificial
  CRISPR gRNA sequence
aaggaaaaactaagggtcag

SEQ ID NO: 15588 - DNA, 20 bp, Artificial
  CRISPR gRNA sequence
aggaaaaactaagggtcaga

SEQ ID NO: 15589 - DNA, 20 bp, Artificial
  CRISPR gRNA sequence
ggaaaaactaagggtcagaa

SEQ ID NO: 15590 - DNA, 20 bp, Artificial
  CRISPR gRNA sequence
gaaaaactaagggtcagaag

SEQ ID NO: 15591 - DNA, 20 bp, Artificial
  CRISPR gRNA sequence
aactaagggtcagaagggga

SEQ ID NO: 15592 - DNA, 20 bp, Artificial
  CRISPR gRNA sequence
cagaaggggaaagcaacata

SEQ ID NO: 15593 - DNA, 20 bp, Artificial
  CRISPR gRNA sequence
aaggggaaagcaacatatgg

SEQ ID NO: 15594 - DNA, 20 bp, Artificial
  CRISPR gRNA sequence
aggggaaagcaacatatgga

SEQ ID NO: 15595 - DNA, 20 bp, Artificial
  CRISPR gRNA sequence
gaaggccacacaaccactct

SEQ ID NO: 15596 - DNA, 20 bp, Artificial
  CRISPR gRNA sequence
accactcttggtcatgcacc

SEQ ID NO: 15597 - DNA, 20 bp, Artificial
  CRISPR gRNA sequence
gtcatgcacccagaccacct

SEQ ID NO: 15598 - DNA, 20 bp, Artificial
  CRISPR gRNA sequence
tcatgcacccagaccacctc

SEQ ID NO: 15599 - DNA, 20 bp, Artificial
  CRISPR gRNA sequence
tgctcttctgctttgatttt

SEQ ID NO: 15600 - DNA, 20 bp, Artificial
  CRISPR gRNA sequence
gctcttctgctttgattttt

SEQ ID NO: 15601 - DNA, 20 bp, Artificial
  CRISPR gRNA sequence
ctgctttgatttttgggaaa

SEQ ID NO: 15602 - DNA, 20 bp, Artificial
  CRISPR gRNA sequence
tgctttgatttttgggaaat

SEQ ID NO: 15603 - DNA, 20 bp, Artificial
  CRISPR gRNA sequence
gctttgatttttgggaaata

SEQ ID NO: 15604 - DNA, 20 bp, Artificial
  CRISPR gRNA sequence
tgatttttgggaaataggga

SEQ ID NO: 15605 - DNA, 20 bp, Artificial
  CRISPR gRNA sequence
atttttgggaaatagggaca

SEQ ID NO: 15606 - DNA, 20 bp, Artificial
  CRISPR gRNA sequence
ttgggaaatagggacagaga

SEQ ID NO: 15607 - DNA, 20 bp, Artificial
  CRISPR gRNA sequence
agggacagagaaagttgtgc

SEQ ID NO: 15608 - DNA, 20 bp, Artificial
  CRISPR gRNA sequence
gggacagagaaagttgtgct

SEQ ID NO: 15609 - DNA, 20 bp, Artificial
  CRISPR gRNA sequence
ggacagagaaagttgtgctg

SEQ ID NO: 15610 - DNA, 20 bp, Artificial
  CRISPR gRNA sequence
acagagaaagttgtgctggg

SEQ ID NO: 15611 - DNA, 20 bp, Artificial
  CRISPR gRNA sequence
cagagaaagttgtgctgggg

SEQ ID NO: 15612 - DNA, 20 bp, Artificial
  CRISPR gRNA sequence
agagaaagttgtgctgggga

SEQ ID NO: 15613 - DNA, 20 bp, Artificial
  CRISPR gRNA sequence
agaaagttgtgctggggagg

SEQ ID NO: 15614 - DNA, 20 bp, Artificial
  CRISPR gRNA sequence
gaaagttgtgctggggaggg

SEQ ID NO: 15615 - DNA, 20 bp, Artificial
  CRISPR gRNA sequence
tgctggggagggaggatcat

SEQ ID NO: 15616 - DNA, 20 bp, Artificial
  CRISPR gRNA sequence
tggggagggaggatcatgag

SEQ ID NO: 15617 - DNA, 20 bp, Artificial
  CRISPR gRNA sequence
ggggagggaggatcatgaga

SEQ ID NO: 15618 - DNA, 20 bp, Artificial
  CRISPR gRNA sequence
ggaggatcatgagaaggtgc

SEQ ID NO: 15619 - DNA, 20 bp, Artificial
  CRISPR gRNA sequence
gaggatcatgagaaggtgct

SEQ ID NO: 15620 - DNA, 20 bp, Artificial
  CRISPR gRNA sequence
aggatcatgagaaggtgcta

SEQ ID NO: 15621 - DNA, 20 bp, Artificial
  CRISPR gRNA sequence
ggtgctagggcaccactgcc

SEQ ID NO: 15622 - DNA, 20 bp, Artificial
  CRISPR gRNA sequence
gggcaccactgccaagtgca

SEQ ID NO: 15623 - DNA, 20 bp, Artificial
  CRISPR gRNA sequence
gcaccactgccaagtgcatg

SEQ ID NO: 15624 - DNA, 20 bp, Artificial
  CRISPR gRNA sequence
actgccaagtgcatggagta

SEQ ID NO: 15625 - DNA, 20 bp, Artificial
  CRISPR gRNA sequence
ctgccaagtgcatggagtat

SEQ ID NO: 15626 - DNA, 20 bp, Artificial
  CRISPR gRNA sequence
tgccaagtgcatggagtatg

SEQ ID NO: 15627 - DNA, 20 bp, Artificial
  CRISPR gRNA sequence
ccaagtgcatggagtatggg

SEQ ID NO: 15628 - DNA, 20 bp, Artificial
  CRISPR gRNA sequence
caagtgcatggagtatgggg

SEQ ID NO: 15629 - DNA, 20 bp, Artificial
  CRISPR gRNA sequence
gcatggagtatggggaggat

SEQ ID NO: 15630 - DNA, 20 bp, Artificial
  CRISPR gRNA sequence
catggagtatggggaggatg

SEQ ID NO: 15631 - DNA, 20 bp, Artificial
  CRISPR gRNA sequence
gagtatggggaggatgaggt

SEQ ID NO: 15632 - DNA, 20 bp, Artificial
  CRISPR gRNA sequence
agtatggggaggatgaggtc

SEQ ID NO: 15633 - DNA, 20 bp, Artificial
  CRISPR gRNA sequence
gtatggggaggatgaggtca

SEQ ID NO: 15634 - DNA, 20 bp, Artificial
  CRISPR gRNA sequence
atggggaggatgaggtcagg

SEQ ID NO: 15635 - DNA, 20 bp, Artificial
  CRISPR gRNA sequence
gggaggatgaggtcagggag

SEQ ID NO: 15636 - DNA, 20 bp, Artificial
  CRISPR gRNA sequence
ggatgaggtcagggagcagt

SEQ ID NO: 15637 - DNA, 20 bp, Artificial
  CRISPR gRNA sequence
gatgaggtcagggagcagtc

SEQ ID NO: 15638 - DNA, 20 bp, Artificial
  CRISPR gRNA sequence
gaggtcagggagcagtcagg

SEQ ID NO: 15639 - DNA, 20 bp, Artificial
  CRISPR gRNA sequence
aggtcagggagcagtcaggt

SEQ ID NO: 15640 - DNA, 20 bp, Artificial
  CRISPR gRNA sequence
gtcagggagcagtcaggtag

SEQ ID NO: 15641 - DNA, 20 bp, Artificial
  CRISPR gRNA sequence
tcagggagcagtcaggtagg

SEQ ID NO: 15642 - DNA, 20 bp, Artificial
  CRISPR gRNA sequence
cagggagcagtcaggtagga

SEQ ID NO: 15643 - DNA, 20 bp, Artificial
  CRISPR gRNA sequence
gggagcagtcaggtaggagg

SEQ ID NO: 15644 - DNA, 20 bp, Artificial
  CRISPR gRNA sequence
gagcagtcaggtaggaggga

SEQ ID NO: 15645 - DNA, 20 bp, Artificial
  CRISPR gRNA sequence
agcagtcaggtaggagggag

SEQ ID NO: 15646 - DNA, 20 bp, Artificial
  CRISPR gRNA sequence
agtcaggtaggagggagagg

SEQ ID NO: 15647 - DNA, 20 bp, Artificial
  CRISPR gRNA sequence
aggtaggagggagaggtggt

SEQ ID NO: 15648 - DNA, 20 bp, Artificial
  CRISPR gRNA sequence
ggtaggagggagaggtggtc

SEQ ID NO: 15649 - DNA, 20 bp, Artificial
  CRISPR gRNA sequence
gtaggagggagaggtggtcg

SEQ ID NO: 15650 - DNA, 20 bp, Artificial
  CRISPR gRNA sequence
aggagggagaggtggtcggg

SEQ ID NO: 15651 - DNA, 20 bp, Artificial
  CRISPR gRNA sequence
gggagaggtggtcggggagc

SEQ ID NO: 15652 - DNA, 20 bp, Artificial
  CRISPR gRNA sequence
ggagaggtggtcggggagcc

SEQ ID NO: 15653 - DNA, 20 bp, Artificial
  CRISPR gRNA sequence
gccaggccccgcactcacca

SEQ ID NO: 15654 - DNA, 20 bp, Artificial
  CRISPR gRNA sequence
aggccccgcactcaccatgg

SEQ ID NO: 15655 - DNA, 20 bp, Artificial
  CRISPR gRNA sequence
accatggtagatgaatatac

SEQ ID NO: 15656 - DNA, 20 bp, Artificial
  CRISPR gRNA sequence
catggtagatgaatatactg

SEQ ID NO: 15657 - DNA, 20 bp, Artificial
  CRISPR gRNA sequence
tatactggagacccctgttc

SEQ ID NO: 15658 - DNA, 20 bp, Artificial
  CRISPR gRNA sequence
ggagacccctgttccagcct

SEQ ID NO: 15659 - DNA, 20 bp, Artificial
  CRISPR gRNA sequence
agacccctgttccagcctca

SEQ ID NO: 15660 - DNA, 20 bp, Artificial
  CRISPR gRNA sequence
ttccagcctcagagatttgc

SEQ ID NO: 15661 - DNA, 20 bp, Artificial
  CRISPR gRNA sequence
ccagcctcagagatttgcca

SEQ ID NO: 15662 - DNA, 20 bp, Artificial
  CRISPR gRNA sequence
cagagatttgccagagccca

SEQ ID NO: 15663 - DNA, 20 bp, Artificial
  CRISPR gRNA sequence
agagatttgccagagcccat

SEQ ID NO: 15664 - DNA, 20 bp, Artificial
  CRISPR gRNA sequence
gagatttgccagagcccatg

SEQ ID NO: 15665 - DNA, 20 bp, Artificial
  CRISPR gRNA sequence
atttgccagagcccatgggg

SEQ ID NO: 15666 - DNA, 20 bp, Artificial
  CRISPR gRNA sequence
ttgccagagcccatggggca

SEQ ID NO: 15667 - DNA, 20 bp, Artificial
  CRISPR gRNA sequence
ccagagcccatggggcagag

SEQ ID NO: 15668 - DNA, 20 bp, Artificial
  CRISPR gRNA sequence
agagcccatggggcagagtg

SEQ ID NO: 15669 - DNA, 20 bp, Artificial
  CRISPR gRNA sequence
cccatggggcagagtggaga

SEQ ID NO: 15670 - DNA, 20 bp, Artificial
  CRISPR gRNA sequence
atggggcagagtggagatgg

SEQ ID NO: 15671 - DNA, 20 bp, Artificial
  CRISPR gRNA sequence
tggggcagagtggagatggt

SEQ ID NO: 15672 - DNA, 20 bp, Artificial
  CRISPR gRNA sequence
ggggcagagtggagatggtg

SEQ ID NO: 15673 - DNA, 20 bp, Artificial
  CRISPR gRNA sequence
tggagatggtggggacaaac

SEQ ID NO: 15674 - DNA, 20 bp, Artificial
  CRISPR gRNA sequence
gatggtggggacaaactgga

SEQ ID NO: 15675 - DNA, 20 bp, Artificial
  CRISPR gRNA sequence
atggtggggacaaactggat

SEQ ID NO: 15676 - DNA, 20 bp, Artificial
  CRISPR gRNA sequence
gacaaactggatgggtccct

SEQ ID NO: 15677 - DNA, 20 bp, Artificial
  CRISPR gRNA sequence
acaaactggatgggtccctc

SEQ ID NO: 15678 - DNA, 20 bp, Artificial
  CRISPR gRNA sequence
caaactggatgggtccctca

SEQ ID NO: 15679 - DNA, 20 bp, Artificial
  CRISPR gRNA sequence
aactggatgggtccctcagg

SEQ ID NO: 15680 - DNA, 20 bp, Artificial
  CRISPR gRNA sequence
atgggtccctcagggagatt

SEQ ID NO: 15681 - DNA, 20 bp, Artificial
  CRISPR gRNA sequence
tgggtccctcagggagattc

SEQ ID NO: 15682 - DNA, 20 bp, Artificial
  CRISPR gRNA sequence
gtccctcagggagattcagg

SEQ ID NO: 15683 - DNA, 20 bp, Artificial
  CRISPR gRNA sequence
ggagattcaggcagctcaac

SEQ ID NO: 15684 - DNA, 20 bp, Artificial
  CRISPR gRNA sequence
gagattcaggcagctcaacg

SEQ ID NO: 15685 - DNA, 20 bp, Artificial
  CRISPR gRNA sequence
caggcagctcaacgaggaac

SEQ ID NO: 15686 - DNA, 20 bp, Artificial
  CRISPR gRNA sequence
ggcagctcaacgaggaactg

SEQ ID NO: 15687 - DNA, 20 bp, Artificial
  CRISPR gRNA sequence
gctcaacgaggaactggaga

SEQ ID NO: 15688 - DNA, 20 bp, Artificial
  CRISPR gRNA sequence
ctcaacgaggaactggagaa

SEQ ID NO: 15689 - DNA, 20 bp, Artificial
  CRISPR gRNA sequence
gaactggagaaaggcactgc

SEQ ID NO: 15690 - DNA, 20 bp, Artificial
  CRISPR gRNA sequence
actggagaaaggcactgcaa

SEQ ID NO: 15691 - DNA, 20 bp, Artificial
  CRISPR gRNA sequence
gaaaggcactgcaagagaca

SEQ ID NO: 15692 - DNA, 20 bp, Artificial
  CRISPR gRNA sequence
aaaggcactgcaagagacaa

SEQ ID NO: 15693 - DNA, 20 bp, Artificial
  CRISPR gRNA sequence
ggcactgcaagagacaaagg

SEQ ID NO: 15694 - DNA, 20 bp, Artificial
  CRISPR gRNA sequence
ctgcaagagacaaaggcagt

SEQ ID NO: 15695 - DNA, 20 bp, Artificial
  CRISPR gRNA sequence
tgcaagagacaaaggcagtg

SEQ ID NO: 15696 - DNA, 20 bp, Artificial
  CRISPR gRNA sequence
aagagacaaaggcagtgagg

SEQ ID NO: 15697 - DNA, 20 bp, Artificial
  CRISPR gRNA sequence
agagacaaaggcagtgaggt

SEQ ID NO: 15698 - DNA, 20 bp, Artificial
  CRISPR gRNA sequence
cagtgaggtgggatcttgca

SEQ ID NO: 15699 - DNA, 20 bp, Artificial
  CRISPR gRNA sequence
attaatgtctgaccccccta

SEQ ID NO: 15700 - DNA, 20 bp, Artificial
  CRISPR gRNA sequence
ttaatgtctgacccccctaa

SEQ ID NO: 15701 - DNA, 20 bp, Artificial
  CRISPR gRNA sequence
taatgtctgacccccctaaa

SEQ ID NO: 15702 - DNA, 20 bp, Artificial
  CRISPR gRNA sequence
taaagggccctaatttccct

SEQ ID NO: 15703 - DNA, 20 bp, Artificial
  CRISPR gRNA sequence
aagggccctaatttccctaa

SEQ ID NO: 15704 - DNA, 20 bp, Artificial
  CRISPR gRNA sequence
ggccctaatttccctaagag

SEQ ID NO: 15705 - DNA, 20 bp, Artificial
  CRISPR gRNA sequence
cctaatttccctaagagcag

SEQ ID NO: 15706 - DNA, 20 bp, Artificial
  CRISPR gRNA sequence
ctgtttctgtcctgccctga

SEQ ID NO: 15707 - DNA, 20 bp, Artificial
  CRISPR gRNA sequence
tcctgccctgatggaattct

SEQ ID NO: 15708 - DNA, 20 bp, Artificial
  CRISPR gRNA sequence
ctgatggaattcttagcacc

SEQ ID NO: 15709 - DNA, 20 bp, Artificial
  CRISPR gRNA sequence
atggaattcttagcacctag

SEQ ID NO: 15710 - DNA, 20 bp, Artificial
  CRISPR gRNA sequence
ggaattcttagcacctagca

SEQ ID NO: 15711 - DNA, 20 bp, Artificial
  CRISPR gRNA sequence
attcttagcacctagcagag

SEQ ID NO: 15712 - DNA, 20 bp, Artificial
  CRISPR gRNA sequence
ttagcacctagcagagcagt

SEQ ID NO: 15713 - DNA, 20 bp, Artificial
  CRISPR gRNA sequence
acctagcagagcagttggca

SEQ ID NO: 15714 - DNA, 20 bp, Artificial
  CRISPR gRNA sequence
ctagcagagcagttggcaca

SEQ ID NO: 15715 - DNA, 20 bp, Artificial
  CRISPR gRNA sequence
gcagagcagttggcacagag

SEQ ID NO: 15716 - DNA, 20 bp, Artificial
  CRISPR gRNA sequence
cagagcagttggcacagaga

SEQ ID NO: 15717 - DNA, 20 bp, Artificial
  CRISPR gRNA sequence
agagcagttggcacagagaa

SEQ ID NO: 15718 - DNA, 20 bp, Artificial
  CRISPR gRNA sequence
gagcagttggcacagagaag

SEQ ID NO: 15719 - DNA, 20 bp, Artificial
  CRISPR gRNA sequence
cacagagaaggggctccatg

SEQ ID NO: 15720 - DNA, 20 bp, Artificial
  CRISPR gRNA sequence
cagagaaggggctccatgaa

SEQ ID NO: 15721 - DNA, 20 bp, Artificial
  CRISPR gRNA sequence
tgaagagctgatgaacgaat

SEQ ID NO: 15722 - DNA, 20 bp, Artificial
  CRISPR gRNA sequence
gaagagctgatgaacgaata

SEQ ID NO: 15723 - DNA, 20 bp, Artificial
  CRISPR gRNA sequence
agctgatgaacgaataaggc

SEQ ID NO: 15724 - DNA, 20 bp, Artificial
  CRISPR gRNA sequence
tgatgaacgaataaggctgg

SEQ ID NO: 15725 - DNA, 20 bp, Artificial
  CRISPR gRNA sequence
gatgaacgaataaggctggc

SEQ ID NO: 15726 - DNA, 20 bp, Artificial
  CRISPR gRNA sequence
tggcaggtgaatgctctaat

SEQ ID NO: 15727 - DNA, 20 bp, Artificial
  CRISPR gRNA sequence
caggtgaatgctctaattgg

SEQ ID NO: 15728 - DNA, 20 bp, Artificial
  CRISPR gRNA sequence
ggtgaatgctctaattggtg

SEQ ID NO: 15729 - DNA, 20 bp, Artificial
  CRISPR gRNA sequence
attccctcctgatgctcgca

SEQ ID NO: 15730 - DNA, 20 bp, Artificial
  CRISPR gRNA sequence
gcacggatgtgtttccttct

SEQ ID NO: 15731 - DNA, 20 bp, Artificial
  CRISPR gRNA sequence
cacggatgtgtttccttctg

SEQ ID NO: 15732 - DNA, 20 bp, Artificial
  CRISPR gRNA sequence
ttctgaggcatgttctctgc

SEQ ID NO: 15733 - DNA, 20 bp, Artificial
  CRISPR gRNA sequence
tctgaggcatgttctctgcc

SEQ ID NO: 15734 - DNA, 20 bp, Artificial
  CRISPR gRNA sequence
ctgaggcatgttctctgcca

SEQ ID NO: 15735 - DNA, 20 bp, Artificial
  CRISPR gRNA sequence
catgttctctgccagggatt

SEQ ID NO: 15736 - DNA, 20 bp, Artificial
  CRISPR gRNA sequence
tctgccagggattgagctga

SEQ ID NO: 15737 - DNA, 20 bp, Artificial
  CRISPR gRNA sequence
ctgccagggattgagctgac

SEQ ID NO: 15738 - DNA, 20 bp, Artificial
  CRISPR gRNA sequence
tgccagggattgagctgacg

SEQ ID NO: 15739 - DNA, 20 bp, Artificial
  CRISPR gRNA sequence
gccagggattgagctgacgg

SEQ ID NO: 15740 - DNA, 20 bp, Artificial
  CRISPR gRNA sequence
attgagctgacgggggcccc

SEQ ID NO: 15741 - DNA, 20 bp, Artificial
  CRISPR gRNA sequence
ttgagctgacgggggcccca

SEQ ID NO: 15742 - DNA, 20 bp, Artificial
  CRISPR gRNA sequence
gggggccccaaggataaaac

SEQ ID NO: 15743 - DNA, 20 bp, Artificial
  CRISPR gRNA sequence
gccccaaggataaaactggc

SEQ ID NO: 15744 - DNA, 20 bp, Artificial
  CRISPR gRNA sequence
ccccaaggataaaactggct

SEQ ID NO: 15745 - DNA, 20 bp, Artificial
  CRISPR gRNA sequence
cccaaggataaaactggctg

SEQ ID NO: 15746 - DNA, 20 bp, Artificial
  CRISPR gRNA sequence
aaggataaaactggctgggg

SEQ ID NO: 15747 - DNA, 20 bp, Artificial
  CRISPR gRNA sequence
ggataaaactggctggggca

SEQ ID NO: 15748 - DNA, 20 bp, Artificial
  CRISPR gRNA sequence
gataaaactggctggggcag

SEQ ID NO: 15749 - DNA, 20 bp, Artificial
  CRISPR gRNA sequence
aaactggctggggcagaggt

SEQ ID NO: 15750 - DNA, 20 bp, Artificial
  CRISPR gRNA sequence
gcagaggtgagtgacactga

SEQ ID NO: 15751 - DNA, 20 bp, Artificial
  CRISPR gRNA sequence
cagaggtgagtgacactgat

SEQ ID NO: 15752 - DNA, 20 bp, Artificial
  CRISPR gRNA sequence
agaggtgagtgacactgata

SEQ ID NO: 15753 - DNA, 20 bp, Artificial
  CRISPR gRNA sequence
gtgagtgacactgatagggt

SEQ ID NO: 15754 - DNA, 20 bp, Artificial
  CRISPR gRNA sequence
tgagtgacactgatagggtt

SEQ ID NO: 15755 - DNA, 20 bp, Artificial
  CRISPR gRNA sequence
gagtgacactgatagggttg

SEQ ID NO: 15756 - DNA, 20 bp, Artificial
  CRISPR gRNA sequence
gtgacactgatagggttggg

SEQ ID NO: 15757 - DNA, 20 bp, Artificial
  CRISPR gRNA sequence
gacactgatagggttgggga

SEQ ID NO: 15758 - DNA, 20 bp, Artificial
  CRISPR gRNA sequence
acactgatagggttggggag

SEQ ID NO: 15759 - DNA, 20 bp, Artificial
  CRISPR gRNA sequence
tgatagggttggggagaggt

SEQ ID NO: 15760 - DNA, 20 bp, Artificial
  CRISPR gRNA sequence
gatagggttggggagaggtg

SEQ ID NO: 15761 - DNA, 20 bp, Artificial
  CRISPR gRNA sequence
ggttggggagaggtgaggtc

SEQ ID NO: 15762 - DNA, 20 bp, Artificial
  CRISPR gRNA sequence
aggtgaggtccagttcctga

SEQ ID NO: 15763 - DNA, 20 bp, Artificial
  CRISPR gRNA sequence
gttcctgacagtccctgcct

SEQ ID NO: 15764 - DNA, 20 bp, Artificial
  CRISPR gRNA sequence
caactccttatccacctccc

SEQ ID NO: 15765 - DNA, 20 bp, Artificial
  CRISPR gRNA sequence
actccttatccacctcccaa

SEQ ID NO: 15766 - DNA, 20 bp, Artificial
  CRISPR gRNA sequence
ctccttatccacctcccaag

SEQ ID NO: 15767 - DNA, 20 bp, Artificial
  CRISPR gRNA sequence
tccttatccacctcccaaga

SEQ ID NO: 15768 - DNA, 20 bp, Artificial
  CRISPR gRNA sequence
cttatccacctcccaagagg

SEQ ID NO: 15769 - DNA, 20 bp, Artificial
  CRISPR gRNA sequence
tccacctcccaagagggaga

SEQ ID NO: 15770 - DNA, 20 bp, Artificial
  CRISPR gRNA sequence
ggagaaagcccactctctcc

SEQ ID NO: 15771 - DNA, 20 bp, Artificial
  CRISPR gRNA sequence
ctccaagccccctaacatac

SEQ ID NO: 15772 - DNA, 20 bp, Artificial
  CRISPR gRNA sequence
tccaagccccctaacatact

SEQ ID NO: 15773 - DNA, 20 bp, Artificial
  CRISPR gRNA sequence
cccctaacatactgggaatc

SEQ ID NO: 15774 - DNA, 20 bp, Artificial
  CRISPR gRNA sequence
taacatactgggaatctggt

SEQ ID NO: 15775 - DNA, 20 bp, Artificial
  CRISPR gRNA sequence
ggaatctggtcggttttctc

SEQ ID NO: 15776 - DNA, 20 bp, Artificial
  CRISPR gRNA sequence
gaatctggtcggttttctcc

SEQ ID NO: 15777 - DNA, 20 bp, Artificial
  CRISPR gRNA sequence
cggttttctccaggcgcatc

SEQ ID NO: 15778 - DNA, 20 bp, Artificial
  CRISPR gRNA sequence
tttctccaggcgcatctggc

SEQ ID NO: 15779 - DNA, 20 bp, Artificial
  CRISPR gRNA sequence
tctccaggcgcatctggccg

SEQ ID NO: 15780 - DNA, 20 bp, Artificial
  CRISPR gRNA sequence
ctccaggcgcatctggccgg

SEQ ID NO: 15781 - DNA, 20 bp, Artificial
  CRISPR gRNA sequence
aggcgcatctggccggaggc

SEQ ID NO: 15782 - DNA, 20 bp, Artificial
  CRISPR gRNA sequence
tctggccggaggctggctcc

SEQ ID NO: 15783 - DNA, 20 bp, Artificial
  CRISPR gRNA sequence
gaggctggctcctggttgaa

SEQ ID NO: 15784 - DNA, 20 bp, Artificial
  CRISPR gRNA sequence
tggctcctggttgaacagcg

SEQ ID NO: 15785 - DNA, 20 bp, Artificial
  CRISPR gRNA sequence
ggctcctggttgaacagcgc

SEQ ID NO: 15786 - DNA, 20 bp, Artificial
  CRISPR gRNA sequence
tcctggttgaacagcgcagg

SEQ ID NO: 15787 - DNA, 20 bp, Artificial
  CRISPR gRNA sequence
tggttgaacagcgcaggcag

SEQ ID NO: 15788 - DNA, 20 bp, Artificial
  CRISPR gRNA sequence
ttgaacagcgcaggcagtgg

SEQ ID NO: 15789 - DNA, 20 bp, Artificial
  CRISPR gRNA sequence
tgaacagcgcaggcagtggc

SEQ ID NO: 15790 - DNA, 20 bp, Artificial
  CRISPR gRNA sequence
acagcgcaggcagtggcagg

SEQ ID NO: 15791 - DNA, 20 bp, Artificial
  CRISPR gRNA sequence
cagcgcaggcagtggcaggc

SEQ ID NO: 15792 - DNA, 20 bp, Artificial
  CRISPR gRNA sequence
agcgcaggcagtggcaggca

SEQ ID NO: 15793 - DNA, 20 bp, Artificial
  CRISPR gRNA sequence
gcaggcagtggcaggcaggg

SEQ ID NO: 15794 - DNA, 20 bp, Artificial
  CRISPR gRNA sequence
caggcagtggcaggcagggc

SEQ ID NO: 15795 - DNA, 20 bp, Artificial
  CRISPR gRNA sequence
aggcagtggcaggcagggca

SEQ ID NO: 15796 - DNA, 20 bp, Artificial
  CRISPR gRNA sequence
cagtggcaggcagggcaggg

SEQ ID NO: 15797 - DNA, 20 bp, Artificial
  CRISPR gRNA sequence
gtggcaggcagggcagggtg

SEQ ID NO: 15798 - DNA, 20 bp, Artificial
  CRISPR gRNA sequence
gcaggcagggcagggtggag

SEQ ID NO: 15799 - DNA, 20 bp, Artificial
  CRISPR gRNA sequence
agggtggagcagtcgctcac

SEQ ID NO: 15800 - DNA, 20 bp, Artificial
  CRISPR gRNA sequence
cagtcgctcactggtctcac

SEQ ID NO: 15801 - DNA, 20 bp, Artificial
  CRISPR gRNA sequence
agtcgctcactggtctcact

SEQ ID NO: 15802 - DNA, 20 bp, Artificial
  CRISPR gRNA sequence
tcgctcactggtctcactag

SEQ ID NO: 15803 - DNA, 20 bp, Artificial
  CRISPR gRNA sequence
tggtctcactaggagactgc

SEQ ID NO: 15804 - DNA, 20 bp, Artificial
  CRISPR gRNA sequence
taggagactgccagtcacca

SEQ ID NO: 15805 - DNA, 20 bp, Artificial
  CRISPR gRNA sequence
gagactgccagtcaccacag

SEQ ID NO: 15806 - DNA, 20 bp, Artificial
  CRISPR gRNA sequence
agactgccagtcaccacagt

SEQ ID NO: 15807 - DNA, 20 bp, Artificial
  CRISPR gRNA sequence
gactgccagtcaccacagtg

SEQ ID NO: 15808 - DNA, 20 bp, Artificial
  CRISPR gRNA sequence
actgccagtcaccacagtgg

SEQ ID NO: 15809 - DNA, 20 bp, Artificial
  CRISPR gRNA sequence
ctgccagtcaccacagtggg

SEQ ID NO: 15810 - DNA, 20 bp, Artificial
  CRISPR gRNA sequence
agtcaccacagtggggggct

SEQ ID NO: 15811 - DNA, 20 bp, Artificial
  CRISPR gRNA sequence
acagtggggggctcagctgt

SEQ ID NO: 15812 - DNA, 20 bp, Artificial
  CRISPR gRNA sequence
cagtggggggctcagctgtg

SEQ ID NO: 15813 - DNA, 20 bp, Artificial
  CRISPR gRNA sequence
tggggggctcagctgtgagg

SEQ ID NO: 15814 - DNA, 20 bp, Artificial
  CRISPR gRNA sequence
ggggctcagctgtgaggaag

SEQ ID NO: 15815 - DNA, 20 bp, Artificial
  CRISPR gRNA sequence
gggctcagctgtgaggaagt

SEQ ID NO: 15816 - DNA, 20 bp, Artificial
  CRISPR gRNA sequence
tgtgaggaagtgggctgtgt

SEQ ID NO: 15817 - DNA, 20 bp, Artificial
  CRISPR gRNA sequence
tgaggaagtgggctgtgtta

SEQ ID NO: 15818 - DNA, 20 bp, Artificial
  CRISPR gRNA sequence
aagtgggctgtgttagagac

SEQ ID NO: 15819 - DNA, 20 bp, Artificial
  CRISPR gRNA sequence
agtgggctgtgttagagact

SEQ ID NO: 15820 - DNA, 20 bp, Artificial
  CRISPR gRNA sequence
tgtgttagagactgggtgct

SEQ ID NO: 15821 - DNA, 20 bp, Artificial
  CRISPR gRNA sequence
tgttagagactgggtgcttg

SEQ ID NO: 15822 - DNA, 20 bp, Artificial
  CRISPR gRNA sequence
gttagagactgggtgcttgg

SEQ ID NO: 15823 - DNA, 20 bp, Artificial
  CRISPR gRNA sequence
ttagagactgggtgcttgga

SEQ ID NO: 15824 - DNA, 20 bp, Artificial
  CRISPR gRNA sequence
tagagactgggtgcttggag

SEQ ID NO: 15825 - DNA, 20 bp, Artificial
  CRISPR gRNA sequence
ggtgcttggaggggccttcc

SEQ ID NO: 15826 - DNA, 20 bp, Artificial
  CRISPR gRNA sequence
gtgcttggaggggccttcct

SEQ ID NO: 15827 - DNA, 20 bp, Artificial
  CRISPR gRNA sequence
ttggaggggccttcctggga

SEQ ID NO: 15828 - DNA, 20 bp, Artificial
  CRISPR gRNA sequence
tggaggggccttcctgggat

SEQ ID NO: 15829 - DNA, 20 bp, Artificial
  CRISPR gRNA sequence
ggaggggccttcctgggatg

SEQ ID NO: 15830 - DNA, 20 bp, Artificial
  CRISPR gRNA sequence
aggggccttcctgggatggg

SEQ ID NO: 15831 - DNA, 20 bp, Artificial
  CRISPR gRNA sequence
ggggccttcctgggatgggg

SEQ ID NO: 15832 - DNA, 20 bp, Artificial
  CRISPR gRNA sequence
gggccttcctgggatgggga

SEQ ID NO: 15833 - DNA, 20 bp, Artificial
  CRISPR gRNA sequence
tcctgggatggggagggccc

SEQ ID NO: 15834 - DNA, 20 bp, Artificial
  CRISPR gRNA sequence
ctgggatggggagggccctg

SEQ ID NO: 15835 - DNA, 20 bp, Artificial
  CRISPR gRNA sequence
ggatggggagggccctggag

SEQ ID NO: 15836 - DNA, 20 bp, Artificial
  CRISPR gRNA sequence
gggagggccctggagtggca

SEQ ID NO: 15837 - DNA, 20 bp, Artificial
  CRISPR gRNA sequence
ggcatggatgtctctcctga

SEQ ID NO: 15838 - DNA, 20 bp, Artificial
  CRISPR gRNA sequence
catggatgtctctcctgaca

SEQ ID NO: 15839 - DNA, 20 bp, Artificial
  CRISPR gRNA sequence
atggatgtctctcctgacag

SEQ ID NO: 15840 - DNA, 20 bp, Artificial
  CRISPR gRNA sequence
ggaaatgcttgtcatcttct

SEQ ID NO: 15841 - DNA, 20 bp, Artificial
  CRISPR gRNA sequence
gcttgtcatcttctcagccc

SEQ ID NO: 15842 - DNA, 20 bp, Artificial
  CRISPR gRNA sequence
catcttctcagccctggctg

SEQ ID NO: 15843 - DNA, 20 bp, Artificial
  CRISPR gRNA sequence
ctggctgcagctgtgttgat

SEQ ID NO: 15844 - DNA, 20 bp, Artificial
  CRISPR gRNA sequence
gatcagcaactgctctgtgc

SEQ ID NO: 15845 - DNA, 20 bp, Artificial
  CRISPR gRNA sequence
atcagcaactgctctgtgcc

SEQ ID NO: 15846 - DNA, 20 bp, Artificial
  CRISPR gRNA sequence
agcaactgctctgtgccagg

SEQ ID NO: 15847 - DNA, 20 bp, Artificial
  CRISPR gRNA sequence
ctctgtgccaggcagtcccc

SEQ ID NO: 15848 - DNA, 20 bp, Artificial
  CRISPR gRNA sequence
ccagtcctctccttgtgact

SEQ ID NO: 15849 - DNA, 20 bp, Artificial
  CRISPR gRNA sequence
tctccttgtgacttggctct

SEQ ID NO: 15850 - DNA, 20 bp, Artificial
  CRISPR gRNA sequence
tccttgtgacttggctctga

SEQ ID NO: 15851 - DNA, 20 bp, Artificial
  CRISPR gRNA sequence
ttggctctgagagctatgct

SEQ ID NO: 15852 - DNA, 20 bp, Artificial
  CRISPR gRNA sequence
gctctgagagctatgctgag

SEQ ID NO: 15853 - DNA, 20 bp, Artificial
  CRISPR gRNA sequence
ctctgagagctatgctgagc

SEQ ID NO: 15854 - DNA, 20 bp, Artificial
  CRISPR gRNA sequence
agctatgctgagcaggaccc

SEQ ID NO: 15855 - DNA, 20 bp, Artificial
  CRISPR gRNA sequence
gctatgctgagcaggaccct

SEQ ID NO: 15856 - DNA, 20 bp, Artificial
  CRISPR gRNA sequence
ctatgctgagcaggacccta

SEQ ID NO: 15857 - DNA, 20 bp, Artificial
  CRISPR gRNA sequence
aggaccctagggcctccaca

SEQ ID NO: 15858 - DNA, 20 bp, Artificial
  CRISPR gRNA sequence
gaccctagggcctccacacg

SEQ ID NO: 15859 - DNA, 20 bp, Artificial
  CRISPR gRNA sequence
ccctagggcctccacacgga

SEQ ID NO: 15860 - DNA, 20 bp, Artificial
  CRISPR gRNA sequence
agggcctccacacggagagc

SEQ ID NO: 15861 - DNA, 20 bp, Artificial
  CRISPR gRNA sequence
gggcctccacacggagagct

SEQ ID NO: 15862 - DNA, 20 bp, Artificial
  CRISPR gRNA sequence
ggcctccacacggagagctg

SEQ ID NO: 15863 - DNA, 20 bp, Artificial
  CRISPR gRNA sequence
ctccacacggagagctgggg

SEQ ID NO: 15864 - DNA, 20 bp, Artificial
  CRISPR gRNA sequence
cacggagagctggggcagaa

SEQ ID NO: 15865 - DNA, 20 bp, Artificial
  CRISPR gRNA sequence
agaacctatgaacaatctgt

SEQ ID NO: 15866 - DNA, 20 bp, Artificial
  CRISPR gRNA sequence
atgaacaatctgttagctcc

SEQ ID NO: 15867 - DNA, 20 bp, Artificial
  CRISPR gRNA sequence
cccctaccaccttccacaaa

SEQ ID NO: 15868 - DNA, 20 bp, Artificial
  CRISPR gRNA sequence
caccttccacaaacagtcgt

SEQ ID NO: 15869 - DNA, 20 bp, Artificial
  CRISPR gRNA sequence
acaaacagtcgtgagcccct

SEQ ID NO: 15870 - DNA, 20 bp, Artificial
  CRISPR gRNA sequence
aaacagtcgtgagcccctta

SEQ ID NO: 15871 - DNA, 20 bp, Artificial
  CRISPR gRNA sequence
aacagtcgtgagccccttag

SEQ ID NO: 15872 - DNA, 20 bp, Artificial
  CRISPR gRNA sequence
tgagccccttagaggactct

SEQ ID NO: 15873 - DNA, 20 bp, Artificial
  CRISPR gRNA sequence
gagccccttagaggactcta

SEQ ID NO: 15874 - DNA, 20 bp, Artificial
  CRISPR gRNA sequence
agccccttagaggactctaa

SEQ ID NO: 15875 - DNA, 20 bp, Artificial
  CRISPR gRNA sequence
agaggactctaagggacccc

SEQ ID NO: 15876 - DNA, 20 bp, Artificial
  CRISPR gRNA sequence
tctaagggaccccaagctct

SEQ ID NO: 15877 - DNA, 20 bp, Artificial
  CRISPR gRNA sequence
aagctctcagcctctaccca

SEQ ID NO: 15878 - DNA, 20 bp, Artificial
  CRISPR gRNA sequence
ctctcagcctctacccaaag

SEQ ID NO: 15879 - DNA, 20 bp, Artificial
  CRISPR gRNA sequence
tctcagcctctacccaaaga

SEQ ID NO: 15880 - DNA, 20 bp, Artificial
  CRISPR gRNA sequence
ctcagcctctacccaaagaa

SEQ ID NO: 15881 - DNA, 20 bp, Artificial
  CRISPR gRNA sequence
agcctctacccaaagaaggg

SEQ ID NO: 15882 - DNA, 20 bp, Artificial
  CRISPR gRNA sequence
gcctctacccaaagaagggc

SEQ ID NO: 15883 - DNA, 20 bp, Artificial
  CRISPR gRNA sequence
cctctacccaaagaagggca

SEQ ID NO: 15884 - DNA, 20 bp, Artificial
  CRISPR gRNA sequence
ctctacccaaagaagggcag

SEQ ID NO: 15885 - DNA, 20 bp, Artificial
  CRISPR gRNA sequence
gcaccatgcaccatccccat

SEQ ID NO: 15886 - DNA, 20 bp, Artificial
  CRISPR gRNA sequence
tgcaccatccccatcagact

SEQ ID NO: 15887 - DNA, 20 bp, Artificial
  CRISPR gRNA sequence
gcaccatccccatcagactt

SEQ ID NO: 15888 - DNA, 20 bp, Artificial
  CRISPR gRNA sequence
catccccatcagacttgggc

SEQ ID NO: 15889 - DNA, 20 bp, Artificial
  CRISPR gRNA sequence
atccccatcagacttgggcc

SEQ ID NO: 15890 - DNA, 20 bp, Artificial
  CRISPR gRNA sequence
ccccatcagacttgggccag

SEQ ID NO: 15891 - DNA, 20 bp, Artificial
  CRISPR gRNA sequence
atctcttccatcccctcccc

SEQ ID NO: 15892 - DNA, 20 bp, Artificial
  CRISPR gRNA sequence
tctcttccatcccctcccca

SEQ ID NO: 15893 - DNA, 20 bp, Artificial
  CRISPR gRNA sequence
gcatccacccttcccaaccc

SEQ ID NO: 15894 - DNA, 20 bp, Artificial
  CRISPR gRNA sequence
gcccacctgccctgcacacc

SEQ ID NO: 15895 - DNA, 20 bp, Artificial
  CRISPR gRNA sequence
tgccctgcacacctggcttc

SEQ ID NO: 15896 - DNA, 20 bp, Artificial
  CRISPR gRNA sequence
acacctggcttccagtgctt

SEQ ID NO: 15897 - DNA, 20 bp, Artificial
  CRISPR gRNA sequence
cacctggcttccagtgcttc

SEQ ID NO: 15898 - DNA, 20 bp, Artificial
  CRISPR gRNA sequence
ttccagtgcttcaggtctgc

SEQ ID NO: 15899 - DNA, 20 bp, Artificial
  CRISPR gRNA sequence
cagtgcttcaggtctgccgg

SEQ ID NO: 15900 - DNA, 20 bp, Artificial
  CRISPR gRNA sequence
aggtctgccggaagctcctc

SEQ ID NO: 15901 - DNA, 20 bp, Artificial
  CRISPR gRNA sequence
ggtctgccggaagctcctct

SEQ ID NO: 15902 - DNA, 20 bp, Artificial
  CRISPR gRNA sequence
ctgccggaagctcctctggg

SEQ ID NO: 15903 - DNA, 20 bp, Artificial
  CRISPR gRNA sequence
tgccggaagctcctctggga

SEQ ID NO: 15904 - DNA, 20 bp, Artificial
  CRISPR gRNA sequence
aagctcctctgggaaggctg

SEQ ID NO: 15905 - DNA, 20 bp, Artificial
  CRISPR gRNA sequence
gctcctctgggaaggctgca

SEQ ID NO: 15906 - DNA, 20 bp, Artificial
  CRISPR gRNA sequence
ctgcagagaaaacatgtgat

SEQ ID NO: 15907 - DNA, 20 bp, Artificial
  CRISPR gRNA sequence
aaacatgtgatcagctgccc

SEQ ID NO: 15908 - DNA, 20 bp, Artificial
  CRISPR gRNA sequence
aacatgtgatcagctgcccc

SEQ ID NO: 15909 - DNA, 20 bp, Artificial
  CRISPR gRNA sequence
acatgtgatcagctgcccca

SEQ ID NO: 15910 - DNA, 20 bp, Artificial
  CRISPR gRNA sequence
atgtgatcagctgccccagg

SEQ ID NO: 15911 - DNA, 20 bp, Artificial
  CRISPR gRNA sequence
gtgatcagctgccccaggga

SEQ ID NO: 15912 - DNA, 20 bp, Artificial
  CRISPR gRNA sequence
tgatcagctgccccagggag

SEQ ID NO: 15913 - DNA, 20 bp, Artificial
  CRISPR gRNA sequence
ccccagggagaggatgtccc

SEQ ID NO: 15914 - DNA, 20 bp, Artificial
  CRISPR gRNA sequence
agggagaggatgtcccaagc

SEQ ID NO: 15915 - DNA, 20 bp, Artificial
  CRISPR gRNA sequence
gagaggatgtcccaagccag

SEQ ID NO: 15916 - DNA, 20 bp, Artificial
  CRISPR gRNA sequence
agaggatgtcccaagccaga

SEQ ID NO: 15917 - DNA, 20 bp, Artificial
  CRISPR gRNA sequence
gaggatgtcccaagccagaa

SEQ ID NO: 15918 - DNA, 20 bp, Artificial
  CRISPR gRNA sequence
aggatgtcccaagccagaag

SEQ ID NO: 15919 - DNA, 20 bp, Artificial
  CRISPR gRNA sequence
gtcccaagccagaaggggct

SEQ ID NO: 15920 - DNA, 20 bp, Artificial
  CRISPR gRNA sequence
tcccaagccagaaggggctc

SEQ ID NO: 15921 - DNA, 20 bp, Artificial
  CRISPR gRNA sequence
ccagaaggggctcaggactc

SEQ ID NO: 15922 - DNA, 20 bp, Artificial
  CRISPR gRNA sequence
gaaggggctcaggactctag

SEQ ID NO: 15923 - DNA, 20 bp, Artificial
  CRISPR gRNA sequence
aaggggctcaggactctagc

SEQ ID NO: 15924 - DNA, 20 bp, Artificial
  CRISPR gRNA sequence
caggactctagcaggctata

SEQ ID NO: 15925 - DNA, 20 bp, Artificial
  CRISPR gRNA sequence
ggctatacggccttaacttc

SEQ ID NO: 15926 - DNA, 20 bp, Artificial
  CRISPR gRNA sequence
gctatacggccttaacttca

SEQ ID NO: 15927 - DNA, 20 bp, Artificial
  CRISPR gRNA sequence
tacggccttaacttcaaggc

SEQ ID NO: 15928 - DNA, 20 bp, Artificial
  CRISPR gRNA sequence
acggccttaacttcaaggct

SEQ ID NO: 15929 - DNA, 20 bp, Artificial
  CRISPR gRNA sequence
gccttaacttcaaggctggg

SEQ ID NO: 15930 - DNA, 20 bp, Artificial
  CRISPR gRNA sequence
ttaacttcaaggctgggtag

SEQ ID NO: 15931 - DNA, 20 bp, Artificial
  CRISPR gRNA sequence
tcaaggctgggtagtggtct

SEQ ID NO: 15932 - DNA, 20 bp, Artificial
  CRISPR gRNA sequence
caaggctgggtagtggtctt

SEQ ID NO: 15933 - DNA, 20 bp, Artificial
  CRISPR gRNA sequence
aaggctgggtagtggtcttg

SEQ ID NO: 15934 - DNA, 20 bp, Artificial
  CRISPR gRNA sequence
aggctgggtagtggtcttgg

SEQ ID NO: 15935 - DNA, 20 bp, Artificial
  CRISPR gRNA sequence
tcgctctaacattccaaccc

SEQ ID NO: 15936 - DNA, 20 bp, Artificial
  CRISPR gRNA sequence
acattccaaccccagctcct

SEQ ID NO: 15937 - DNA, 20 bp, Artificial
  CRISPR gRNA sequence
aaccccatctcaaaccatac

SEQ ID NO: 15938 - DNA, 20 bp, Artificial
  CRISPR gRNA sequence
accccatctcaaaccatacc

SEQ ID NO: 15939 - DNA, 20 bp, Artificial
  CRISPR gRNA sequence
ccatctcaaaccataccagg

SEQ ID NO: 15940 - DNA, 20 bp, Artificial
  CRISPR gRNA sequence
tcaaaccataccaggcagtg

SEQ ID NO: 15941 - DNA, 20 bp, Artificial
  CRISPR gRNA sequence
aaccataccaggcagtgtag

SEQ ID NO: 15942 - DNA, 20 bp, Artificial
  CRISPR gRNA sequence
cataccaggcagtgtagcag

SEQ ID NO: 15943 - DNA, 20 bp, Artificial
  CRISPR gRNA sequence
accaggcagtgtagcagcag

SEQ ID NO: 15944 - DNA, 20 bp, Artificial
  CRISPR gRNA sequence
caggcagtgtagcagcagaa

SEQ ID NO: 15945 - DNA, 20 bp, Artificial
  CRISPR gRNA sequence
aggcagtgtagcagcagaag

SEQ ID NO: 15946 - DNA, 20 bp, Artificial
  CRISPR gRNA sequence
gtgtagcagcagaagaggcc

SEQ ID NO: 15947 - DNA, 20 bp, Artificial
  CRISPR gRNA sequence
agaagaggccgagtcacaaa

SEQ ID NO: 15948 - DNA, 20 bp, Artificial
  CRISPR gRNA sequence
gaagaggccgagtcacaaat

SEQ ID NO: 15949 - DNA, 20 bp, Artificial
  CRISPR gRNA sequence
aagaggccgagtcacaaatg

SEQ ID NO: 15950 - DNA, 20 bp, Artificial
  CRISPR gRNA sequence
tcacaaatggggacacaaca

SEQ ID NO: 15951 - DNA, 20 bp, Artificial
  CRISPR gRNA sequence
cacaaatggggacacaacat

SEQ ID NO: 15952 - DNA, 20 bp, Artificial
  CRISPR gRNA sequence
tggggacacaacatgggttt

SEQ ID NO: 15953 - DNA, 20 bp, Artificial
  CRISPR gRNA sequence
aaacaaaacaaaacaaaaca

SEQ ID NO: 15954 - DNA, 20 bp, Artificial
  CRISPR gRNA sequence
aacaaaacaaaacaaaacaa

SEQ ID NO: 15955 - DNA, 20 bp, Artificial
  CRISPR gRNA sequence
cctgcttttgaaccgcttcc

SEQ ID NO: 15956 - DNA, 20 bp, Artificial
  CRISPR gRNA sequence
agctgtgtgcctttgcaatg

SEQ ID NO: 15957 - DNA, 20 bp, Artificial
  CRISPR gRNA sequence
ttgatctcacatctatgaaa

SEQ ID NO: 15958 - DNA, 20 bp, Artificial
  CRISPR gRNA sequence
tgatctcacatctatgaaat

SEQ ID NO: 15959 - DNA, 20 bp, Artificial
  CRISPR gRNA sequence
gatctcacatctatgaaatg

SEQ ID NO: 15960 - DNA, 20 bp, Artificial
  CRISPR gRNA sequence
atctcacatctatgaaatgg

SEQ ID NO: 15961 - DNA, 20 bp, Artificial
  CRISPR gRNA sequence
tcacatctatgaaatggggg

SEQ ID NO: 15962 - DNA, 20 bp, Artificial
  CRISPR gRNA sequence
catctatgaaatgggggtgg

SEQ ID NO: 15963 - DNA, 20 bp, Artificial
  CRISPR gRNA sequence
gggtggtggttcctacattg

SEQ ID NO: 15964 - DNA, 20 bp, Artificial
  CRISPR gRNA sequence
ggtggtggttcctacattgc

SEQ ID NO: 15965 - DNA, 20 bp, Artificial
  CRISPR gRNA sequence
tggtggttcctacattgcag

SEQ ID NO: 15966 - DNA, 20 bp, Artificial
  CRISPR gRNA sequence
cctacattgcaggagtatgc

SEQ ID NO: 15967 - DNA, 20 bp, Artificial
  CRISPR gRNA sequence
tgcaggagtatgccagaaat

SEQ ID NO: 15968 - DNA, 20 bp, Artificial
  CRISPR gRNA sequence
ggagtatgccagaaatcagt

SEQ ID NO: 15969 - DNA, 20 bp, Artificial
  CRISPR gRNA sequence
tatgccagaaatcagtgagt

SEQ ID NO: 15970 - DNA, 20 bp, Artificial
  CRISPR gRNA sequence
gaaatcagtgagtgagtatc

SEQ ID NO: 15971 - DNA, 20 bp, Artificial
  CRISPR gRNA sequence
gagtgagtatcaagcactca

SEQ ID NO: 15972 - DNA, 20 bp, Artificial
  CRISPR gRNA sequence
gtatcaagcactcacagcaa

SEQ ID NO: 15973 - DNA, 20 bp, Artificial
  CRISPR gRNA sequence
ttaaaaacccacgtgtccct

SEQ ID NO: 15974 - DNA, 20 bp, Artificial
  CRISPR gRNA sequence
aaacccacgtgtcccttagc

SEQ ID NO: 15975 - DNA, 20 bp, Artificial
  CRISPR gRNA sequence
aacccacgtgtcccttagca

SEQ ID NO: 15976 - DNA, 20 bp, Artificial
  CRISPR gRNA sequence
acccacgtgtcccttagcaa

SEQ ID NO: 15977 - DNA, 20 bp, Artificial
  CRISPR gRNA sequence
gggactgcttaaacaaatta

SEQ ID NO: 15978 - DNA, 20 bp, Artificial
  CRISPR gRNA sequence
ctacccaacgaaacactgca

SEQ ID NO: 15979 - DNA, 20 bp, Artificial
  CRISPR gRNA sequence
gaaacactgcatggccttaa

SEQ ID NO: 15980 - DNA, 20 bp, Artificial
  CRISPR gRNA sequence
cactgcatggccttaaaaga

SEQ ID NO: 15981 - DNA, 20 bp, Artificial
  CRISPR gRNA sequence
actgcatggccttaaaagaa

SEQ ID NO: 15982 - DNA, 20 bp, Artificial
  CRISPR gRNA sequence
ccttaaaagaaaggatgctg

SEQ ID NO: 15983 - DNA, 20 bp, Artificial
  CRISPR gRNA sequence
gaaaggatgctgaagtacac

SEQ ID NO: 15984 - DNA, 20 bp, Artificial
  CRISPR gRNA sequence
aaaggatgctgaagtacacg

SEQ ID NO: 15985 - DNA, 20 bp, Artificial
  CRISPR gRNA sequence
aaggatgctgaagtacacga

SEQ ID NO: 15986 - DNA, 20 bp, Artificial
  CRISPR gRNA sequence
aggatgctgaagtacacgag

SEQ ID NO: 15987 - DNA, 20 bp, Artificial
  CRISPR gRNA sequence
gatgctgaagtacacgaggg

SEQ ID NO: 15988 - DNA, 20 bp, Artificial
  CRISPR gRNA sequence
tgtaccaaaaatataatgaa

SEQ ID NO: 15989 - DNA, 20 bp, Artificial
  CRISPR gRNA sequence
gtaccaaaaatataatgaat

SEQ ID NO: 15990 - DNA, 20 bp, Artificial
  CRISPR gRNA sequence
aaatataatgaatgggtgtg

SEQ ID NO: 15991 - DNA, 20 bp, Artificial
  CRISPR gRNA sequence
ataatgaatgggtgtgtgga

SEQ ID NO: 15992 - DNA, 20 bp, Artificial
  CRISPR gRNA sequence
tgaatgggtgtgtggatgga

SEQ ID NO: 15993 - DNA, 20 bp, Artificial
  CRISPR gRNA sequence
aatgggtgtgtggatggata

SEQ ID NO: 15994 - DNA, 20 bp, Artificial
  CRISPR gRNA sequence
atgggtgtgtggatggatag

SEQ ID NO: 15995 - DNA, 20 bp, Artificial
  CRISPR gRNA sequence
tgggtgtgtggatggataga

SEQ ID NO: 15996 - DNA, 20 bp, Artificial
  CRISPR gRNA sequence
tgtgtggatggatagaggga

SEQ ID NO: 15997 - DNA, 20 bp, Artificial
  CRISPR gRNA sequence
tggatggatagagggatgga

SEQ ID NO: 15998 - DNA, 20 bp, Artificial
  CRISPR gRNA sequence
tagagggatggacagatgaa

SEQ ID NO: 15999 - DNA, 20 bp, Artificial
  CRISPR gRNA sequence
gagggatggacagatgaata

SEQ ID NO: 16000 - DNA, 20 bp, Artificial
  CRISPR gRNA sequence
cagatgaatagagatgtgat

SEQ ID NO: 16001 - DNA, 20 bp, Artificial
  CRISPR gRNA sequence
ataaaacccaacattaattg

SEQ ID NO: 16002 - DNA, 20 bp, Artificial
  CRISPR gRNA sequence
cattaattgtagaatcaaaa

SEQ ID NO: 16003 - DNA, 20 bp, Artificial
  CRISPR gRNA sequence
tgtagaatcaaaatggtaca

SEQ ID NO: 16004 - DNA, 20 bp, Artificial
  CRISPR gRNA sequence
agaatcaaaatggtacatgg

SEQ ID NO: 16005 - DNA, 20 bp, Artificial
  CRISPR gRNA sequence
gaatcaaaatggtacatggt

SEQ ID NO: 16006 - DNA, 20 bp, Artificial
  CRISPR gRNA sequence
aatggtacatggtgggtata

SEQ ID NO: 16007 - DNA, 20 bp, Artificial
  CRISPR gRNA sequence
ggtgggtatatggaccttca

SEQ ID NO: 16008 - DNA, 20 bp, Artificial
  CRISPR gRNA sequence
atttttttttttttttgaaa

SEQ ID NO: 16009 - DNA, 20 bp, Artificial
  CRISPR gRNA sequence
ttttttttttttttgaaaca

SEQ ID NO: 16010 - DNA, 20 bp, Artificial
  CRISPR gRNA sequence
tttttttttgaaacagagtc

SEQ ID NO: 16011 - DNA, 20 bp, Artificial
  CRISPR gRNA sequence
cagagtctagctctgttgcc

SEQ ID NO: 16012 - DNA, 20 bp, Artificial
  CRISPR gRNA sequence
agagtctagctctgttgccc

SEQ ID NO: 16013 - DNA, 20 bp, Artificial
  CRISPR gRNA sequence
tctagctctgttgcccaggc

SEQ ID NO: 16014 - DNA, 20 bp, Artificial
  CRISPR gRNA sequence
tagctctgttgcccaggctg

SEQ ID NO: 16015 - DNA, 20 bp, Artificial
  CRISPR gRNA sequence
ttgcccaggctggagtgcac

SEQ ID NO: 16016 - DNA, 20 bp, Artificial
  CRISPR gRNA sequence
ggagtgcactggcgcaatct

SEQ ID NO: 16017 - DNA, 20 bp, Artificial
  CRISPR gRNA sequence
tcactgcaacctctgcttct

SEQ ID NO: 16018 - DNA, 20 bp, Artificial
  CRISPR gRNA sequence
cactgcaacctctgcttctt

SEQ ID NO: 16019 - DNA, 20 bp, Artificial
  CRISPR gRNA sequence
aacctctgcttcttaggttc

SEQ ID NO: 16020 - DNA, 20 bp, Artificial
  CRISPR gRNA sequence
ttcaagcgattctcccaccc

SEQ ID NO: 16021 - DNA, 20 bp, Artificial
  CRISPR gRNA sequence
ttctcccaccctagcctccc

SEQ ID NO: 16022 - DNA, 20 bp, Artificial
  CRISPR gRNA sequence
tcccaccctagcctccctgg

SEQ ID NO: 16023 - DNA, 20 bp, Artificial
  CRISPR gRNA sequence
accctagcctccctggtagc

SEQ ID NO: 16024 - DNA, 20 bp, Artificial
  CRISPR gRNA sequence
ccctagcctccctggtagct

SEQ ID NO: 16025 - DNA, 20 bp, Artificial
  CRISPR gRNA sequence
ctccctggtagctgggatta

SEQ ID NO: 16026 - DNA, 20 bp, Artificial
  CRISPR gRNA sequence
tccctggtagctgggattac

SEQ ID NO: 16027 - DNA, 20 bp, Artificial
  CRISPR gRNA sequence
caggtgttcgccaccacgcc

SEQ ID NO: 16028 - DNA, 20 bp, Artificial
  CRISPR gRNA sequence
ctggctaatttttgtatttt

SEQ ID NO: 16029 - DNA, 20 bp, Artificial
  CRISPR gRNA sequence
gctaatttttgtatttttag

SEQ ID NO: 16030 - DNA, 20 bp, Artificial
  CRISPR gRNA sequence
taatttttgtatttttagta

SEQ ID NO: 16031 - DNA, 20 bp, Artificial
  CRISPR gRNA sequence
ttttgtatttttagtagaga

SEQ ID NO: 16032 - DNA, 20 bp, Artificial
  CRISPR gRNA sequence
tttgtatttttagtagagat

SEQ ID NO: 16033 - DNA, 20 bp, Artificial
  CRISPR gRNA sequence
ttgtatttttagtagagatg

SEQ ID NO: 16034 - DNA, 20 bp, Artificial
  CRISPR gRNA sequence
gagatggggtttcaccatgt

SEQ ID NO: 16035 - DNA, 20 bp, Artificial
  CRISPR gRNA sequence
tggggtttcaccatgttggc

SEQ ID NO: 16036 - DNA, 20 bp, Artificial
  CRISPR gRNA sequence
ggggtttcaccatgttggcc

SEQ ID NO: 16037 - DNA, 20 bp, Artificial
  CRISPR gRNA sequence
tttcaccatgttggccaggc

SEQ ID NO: 16038 - DNA, 20 bp, Artificial
  CRISPR gRNA sequence
tggtctcaaactcttgacct

SEQ ID NO: 16039 - DNA, 20 bp, Artificial
  CRISPR gRNA sequence
ggtctcaaactcttgacctc

SEQ ID NO: 16040 - DNA, 20 bp, Artificial
  CRISPR gRNA sequence
cttgacctcaggtgatctgc

SEQ ID NO: 16041 - DNA, 20 bp, Artificial
  CRISPR gRNA sequence
ctcaggtgatctgccagcct

SEQ ID NO: 16042 - DNA, 20 bp, Artificial
  CRISPR gRNA sequence
ctgccagccttggcctccca

SEQ ID NO: 16043 - DNA, 20 bp, Artificial
  CRISPR gRNA sequence
gccttggcctcccaaagtgc

SEQ ID NO: 16044 - DNA, 20 bp, Artificial
  CRISPR gRNA sequence
ccttggcctcccaaagtgct

SEQ ID NO: 16045 - DNA, 20 bp, Artificial
  CRISPR gRNA sequence
ctcccaaagtgctgggatta

SEQ ID NO: 16046 - DNA, 20 bp, Artificial
  CRISPR gRNA sequence
agtgctgggattacagatgt

SEQ ID NO: 16047 - DNA, 20 bp, Artificial
  CRISPR gRNA sequence
cagatgtgagccaccacgcc

SEQ ID NO: 16048 - DNA, 20 bp, Artificial
  CRISPR gRNA sequence
aaactttcacaataaaatct

SEQ ID NO: 16049 - DNA, 20 bp, Artificial
  CRISPR gRNA sequence
aactttcacaataaaatctt

SEQ ID NO: 16050 - DNA, 20 bp, Artificial
  CRISPR gRNA sequence
actttcacaataaaatcttg

SEQ ID NO: 16051 - DNA, 20 bp, Artificial
  CRISPR gRNA sequence
ctttcacaataaaatcttgg

SEQ ID NO: 16052 - DNA, 20 bp, Artificial
  CRISPR gRNA sequence
tttcacaataaaatcttggg

SEQ ID NO: 16053 - DNA, 20 bp, Artificial
  CRISPR gRNA sequence
atttatcaaatgaaaacata

SEQ ID NO: 16054 - DNA, 20 bp, Artificial
  CRISPR gRNA sequence
tatcaaatgaaaacataaag

SEQ ID NO: 16055 - DNA, 20 bp, Artificial
  CRISPR gRNA sequence
aaaacataaagaagaaaaac

SEQ ID NO: 16056 - DNA, 20 bp, Artificial
  CRISPR gRNA sequence
ataaagaagaaaaacaagaa

SEQ ID NO: 16057 - DNA, 20 bp, Artificial
  CRISPR gRNA sequence
agaagaaaaacaagaaaaga

SEQ ID NO: 16058 - DNA, 20 bp, Artificial
  CRISPR gRNA sequence
acaagaaaagaaagaaaata

SEQ ID NO: 16059 - DNA, 20 bp, Artificial
  CRISPR gRNA sequence
agaaaagaaagaaaataaag

SEQ ID NO: 16060 - DNA, 20 bp, Artificial
  CRISPR gRNA sequence
agaaaataaagaagctgctg

SEQ ID NO: 16061 - DNA, 20 bp, Artificial
  CRISPR gRNA sequence
aataaagaagctgctgaaga

SEQ ID NO: 16062 - DNA, 20 bp, Artificial
  CRISPR gRNA sequence
ataaagaagctgctgaagat

SEQ ID NO: 16063 - DNA, 20 bp, Artificial
  CRISPR gRNA sequence
tgtcctctccctcaataata

SEQ ID NO: 16064 - DNA, 20 bp, Artificial
  CRISPR gRNA sequence
taatatggaacgtgacctcc

SEQ ID NO: 16065 - DNA, 20 bp, Artificial
  CRISPR gRNA sequence
atggaacgtgacctcccaga

SEQ ID NO: 16066 - DNA, 20 bp, Artificial
  CRISPR gRNA sequence
tggaacgtgacctcccagac

SEQ ID NO: 16067 - DNA, 20 bp, Artificial
  CRISPR gRNA sequence
ggaacgtgacctcccagaca

SEQ ID NO: 16068 - DNA, 20 bp, Artificial
  CRISPR gRNA sequence
aacgtgacctcccagacagg

SEQ ID NO: 16069 - DNA, 20 bp, Artificial
  CRISPR gRNA sequence
ctcccagacagggagtaatg

SEQ ID NO: 16070 - DNA, 20 bp, Artificial
  CRISPR gRNA sequence
agggagtaatgaagtaaatg

SEQ ID NO: 16071 - DNA, 20 bp, Artificial
  CRISPR gRNA sequence
agtaatgaagtaaatgaaga

SEQ ID NO: 16072 - DNA, 20 bp, Artificial
  CRISPR gRNA sequence
taaatgaagaaagcaaaatg

SEQ ID NO: 16073 - DNA, 20 bp, Artificial
  CRISPR gRNA sequence
gaagaaagcaaaatgcagaa

SEQ ID NO: 16074 - DNA, 20 bp, Artificial
  CRISPR gRNA sequence
agaatagtgtaaataaaatg

SEQ ID NO: 16075 - DNA, 20 bp, Artificial
  CRISPR gRNA sequence
ataaaatgtggtcatttgca

SEQ ID NO: 16076 - DNA, 20 bp, Artificial
  CRISPR gRNA sequence
gtcatttgcatggaaaatta

SEQ ID NO: 16077 - DNA, 20 bp, Artificial
  CRISPR gRNA sequence
atggaaaattaaagcaaata

SEQ ID NO: 16078 - DNA, 20 bp, Artificial
  CRISPR gRNA sequence
tggaaaattaaagcaaatac

SEQ ID NO: 16079 - DNA, 20 bp, Artificial
  CRISPR gRNA sequence
gaaaattaaagcaaatacag

SEQ ID NO: 16080 - DNA, 20 bp, Artificial
  CRISPR gRNA sequence
gagctcgctttatttctgac

SEQ ID NO: 16081 - DNA, 20 bp, Artificial
  CRISPR gRNA sequence
agctcgctttatttctgaca

SEQ ID NO: 16082 - DNA, 20 bp, Artificial
  CRISPR gRNA sequence
tttatttctgacaaggcaaa

SEQ ID NO: 16083 - DNA, 20 bp, Artificial
  CRISPR gRNA sequence
ttatttctgacaaggcaaaa

SEQ ID NO: 16084 - DNA, 20 bp, Artificial
  CRISPR gRNA sequence
tttctgacaaggcaaaaagg

SEQ ID NO: 16085 - DNA, 20 bp, Artificial
  CRISPR gRNA sequence
tgacaaggcaaaaaggaagc

SEQ ID NO: 16086 - DNA, 20 bp, Artificial
  CRISPR gRNA sequence
caaaaaggaagctggtcaca

SEQ ID NO: 16087 - DNA, 20 bp, Artificial
  CRISPR gRNA sequence
aaaaaggaagctggtcacat

SEQ ID NO: 16088 - DNA, 20 bp, Artificial
  CRISPR gRNA sequence
gctggtcacataggttgact

SEQ ID NO: 16089 - DNA, 20 bp, Artificial
  CRISPR gRNA sequence
gtcacataggttgactaaga

SEQ ID NO: 16090 - DNA, 20 bp, Artificial
  CRISPR gRNA sequence
tcacataggttgactaagat

SEQ ID NO: 16091 - DNA, 20 bp, Artificial
  CRISPR gRNA sequence
acataggttgactaagatag

SEQ ID NO: 16092 - DNA, 20 bp, Artificial
  CRISPR gRNA sequence
actaagataggagcaaaact

SEQ ID NO: 16093 - DNA, 20 bp, Artificial
  CRISPR gRNA sequence
ctaagataggagcaaaactg

SEQ ID NO: 16094 - DNA, 20 bp, Artificial
  CRISPR gRNA sequence
taagataggagcaaaactga

SEQ ID NO: 16095 - DNA, 20 bp, Artificial
  CRISPR gRNA sequence
ggagcaaaactgagggacta

SEQ ID NO: 16096 - DNA, 20 bp, Artificial
  CRISPR gRNA sequence
aaaactgagggactacagaa

SEQ ID NO: 16097 - DNA, 20 bp, Artificial
  CRISPR gRNA sequence
aaactgagggactacagaac

SEQ ID NO: 16098 - DNA, 20 bp, Artificial
  CRISPR gRNA sequence
actgagggactacagaacag

SEQ ID NO: 16099 - DNA, 20 bp, Artificial
  CRISPR gRNA sequence
gagggactacagaacaggag

SEQ ID NO: 16100 - DNA, 20 bp, Artificial
  CRISPR gRNA sequence
agggactacagaacaggagt

SEQ ID NO: 16101 - DNA, 20 bp, Artificial
  CRISPR gRNA sequence
ggactacagaacaggagtgg

SEQ ID NO: 16102 - DNA, 20 bp, Artificial
  CRISPR gRNA sequence
gactacagaacaggagtggg

SEQ ID NO: 16103 - DNA, 20 bp, Artificial
  CRISPR gRNA sequence
actacagaacaggagtggga

SEQ ID NO: 16104 - DNA, 20 bp, Artificial
  CRISPR gRNA sequence
tacagaacaggagtgggagg

SEQ ID NO: 16105 - DNA, 20 bp, Artificial
  CRISPR gRNA sequence
tttttcactgaatattcttt

SEQ ID NO: 16106 - DNA, 20 bp, Artificial
  CRISPR gRNA sequence
tcttttggttgttgttgttt

SEQ ID NO: 16107 - DNA, 20 bp, Artificial
  CRISPR gRNA sequence
ttggttgttgttgtttgaga

SEQ ID NO: 16108 - DNA, 20 bp, Artificial
  CRISPR gRNA sequence
ggttgttgttgtttgagaca

SEQ ID NO: 16109 - DNA, 20 bp, Artificial
  CRISPR gRNA sequence
cagagtcttactctgccacc

SEQ ID NO: 16110 - DNA, 20 bp, Artificial
  CRISPR gRNA sequence
agagtcttactctgccaccc

SEQ ID NO: 16111 - DNA, 20 bp, Artificial
  CRISPR gRNA sequence
tcttactctgccacccaggc

SEQ ID NO: 16112 - DNA, 20 bp, Artificial
  CRISPR gRNA sequence
ttactctgccacccaggctg

SEQ ID NO: 16113 - DNA, 20 bp, Artificial
  CRISPR gRNA sequence
ctgccacccaggctggagtg

SEQ ID NO: 16114 - DNA, 20 bp, Artificial
  CRISPR gRNA sequence
ccacccaggctggagtgcag

SEQ ID NO: 16115 - DNA, 20 bp, Artificial
  CRISPR gRNA sequence
ggagtgcagtggcgtgatct

SEQ ID NO: 16116 - DNA, 20 bp, Artificial
  CRISPR gRNA sequence
tcactgcaacctccacctcc

SEQ ID NO: 16117 - DNA, 20 bp, Artificial
  CRISPR gRNA sequence
cactgcaacctccacctcct

SEQ ID NO: 16118 - DNA, 20 bp, Artificial
  CRISPR gRNA sequence
aacctccacctcctgggttc

SEQ ID NO: 16119 - DNA, 20 bp, Artificial
  CRISPR gRNA sequence
ttcaagcgattctcctgcct

SEQ ID NO: 16120 - DNA, 20 bp, Artificial
  CRISPR gRNA sequence
ttctcctgcctcagcctccc

SEQ ID NO: 16121 - DNA, 20 bp, Artificial
  CRISPR gRNA sequence
tcctgcctcagcctcccgag

SEQ ID NO: 16122 - DNA, 20 bp, Artificial
  CRISPR gRNA sequence
gcctcagcctcccgagtagc

SEQ ID NO: 16123 - DNA, 20 bp, Artificial
  CRISPR gRNA sequence
cctcagcctcccgagtagct

SEQ ID NO: 16124 - DNA, 20 bp, Artificial
  CRISPR gRNA sequence
ctcccgagtagctgggatta

SEQ ID NO: 16125 - DNA, 20 bp, Artificial
  CRISPR gRNA sequence
tcccgagtagctgggattac

SEQ ID NO: 16126 - DNA, 20 bp, Artificial
  CRISPR gRNA sequence
caggcgtgcaccaccacacc

SEQ ID NO: 16127 - DNA, 20 bp, Artificial
  CRISPR gRNA sequence
cggctaatttttgtattttt

SEQ ID NO: 16128 - DNA, 20 bp, Artificial
  CRISPR gRNA sequence
ctaatttttgtattttttgg

SEQ ID NO: 16129 - DNA, 20 bp, Artificial
  CRISPR gRNA sequence
aatttttgtattttttggta

SEQ ID NO: 16130 - DNA, 20 bp, Artificial
  CRISPR gRNA sequence
tgtattttttggtagagacg

SEQ ID NO: 16131 - DNA, 20 bp, Artificial
  CRISPR gRNA sequence
gagacgcggtttcaccatgt

SEQ ID NO: 16132 - DNA, 20 bp, Artificial
  CRISPR gRNA sequence
cgcggtttcaccatgttggc

SEQ ID NO: 16133 - DNA, 20 bp, Artificial
  CRISPR gRNA sequence
gcggtttcaccatgttggcc

SEQ ID NO: 16134 - DNA, 20 bp, Artificial
  CRISPR gRNA sequence
gtttcaccatgttggccagg

SEQ ID NO: 16135 - DNA, 20 bp, Artificial
  CRISPR gRNA sequence
tttcaccatgttggccaggc

SEQ ID NO: 16136 - DNA, 20 bp, Artificial
  CRISPR gRNA sequence
ggtatcaaactcctgacctc

SEQ ID NO: 16137 - DNA, 20 bp, Artificial
  CRISPR gRNA sequence
ctcaagtgatccgtccccct

SEQ ID NO: 16138 - DNA, 20 bp, Artificial
  CRISPR gRNA sequence
cccttggcctcccaaactgc

SEQ ID NO: 16139 - DNA, 20 bp, Artificial
  CRISPR gRNA sequence
ccttggcctcccaaactgct

SEQ ID NO: 16140 - DNA, 20 bp, Artificial
  CRISPR gRNA sequence
ctcccaaactgctgggatta

SEQ ID NO: 16141 - DNA, 20 bp, Artificial
  CRISPR gRNA sequence
tcccaaactgctgggattac

SEQ ID NO: 16142 - DNA, 20 bp, Artificial
  CRISPR gRNA sequence
actgctgggattacaggtgt

SEQ ID NO: 16143 - DNA, 20 bp, Artificial
  CRISPR gRNA sequence
caggtgtgagccgctgcgcc

SEQ ID NO: 16144 - DNA, 20 bp, Artificial
  CRISPR gRNA sequence
tgtgtgcgattcacctgttt

SEQ ID NO: 16145 - DNA, 20 bp, Artificial
  CRISPR gRNA sequence
ctgtttaagaactgaataaa

SEQ ID NO: 16146 - DNA, 20 bp, Artificial
  CRISPR gRNA sequence
aagaactgaataaatagata

SEQ ID NO: 16147 - DNA, 20 bp, Artificial
  CRISPR gRNA sequence
agaactgaataaatagatac

SEQ ID NO: 16148 - DNA, 20 bp, Artificial
  CRISPR gRNA sequence
atagatacaggacttacaca

SEQ ID NO: 16149 - DNA, 20 bp, Artificial
  CRISPR gRNA sequence
atacaggacttacacatggt

SEQ ID NO: 16150 - DNA, 20 bp, Artificial
  CRISPR gRNA sequence
cacatggtcagacccataat

SEQ ID NO: 16151 - DNA, 20 bp, Artificial
  CRISPR gRNA sequence
tcagacccataataagtact

SEQ ID NO: 16152 - DNA, 20 bp, Artificial
  CRISPR gRNA sequence
taactgttacacccatttta

SEQ ID NO: 16153 - DNA, 20 bp, Artificial
  CRISPR gRNA sequence
ttacagatgttttcattcaa

SEQ ID NO: 16154 - DNA, 20 bp, Artificial
  CRISPR gRNA sequence
tcattcaacagatatctact

SEQ ID NO: 16155 - DNA, 20 bp, Artificial
  CRISPR gRNA sequence
cattcaacagatatctactg

SEQ ID NO: 16156 - DNA, 20 bp, Artificial
  CRISPR gRNA sequence
actgaggtgctactgcatac

SEQ ID NO: 16157 - DNA, 20 bp, Artificial
  CRISPR gRNA sequence
ctgaggtgctactgcatacc

SEQ ID NO: 16158 - DNA, 20 bp, Artificial
  CRISPR gRNA sequence
ctgcataccaggcactgcac

SEQ ID NO: 16159 - DNA, 20 bp, Artificial
  CRISPR gRNA sequence
ccaggcactgcactagatgc

SEQ ID NO: 16160 - DNA, 20 bp, Artificial
  CRISPR gRNA sequence
caggcactgcactagatgct

SEQ ID NO: 16161 - DNA, 20 bp, Artificial
  CRISPR gRNA sequence
aggcactgcactagatgctg

SEQ ID NO: 16162 - DNA, 20 bp, Artificial
  CRISPR gRNA sequence
tgcactagatgctggggaaa

SEQ ID NO: 16163 - DNA, 20 bp, Artificial
  CRISPR gRNA sequence
gatgctggggaaacagtcac

SEQ ID NO: 16164 - DNA, 20 bp, Artificial
  CRISPR gRNA sequence
ctggggaaacagtcacgagc

SEQ ID NO: 16165 - DNA, 20 bp, Artificial
  CRISPR gRNA sequence
ggaaacagtcacgagcaaga

SEQ ID NO: 16166 - DNA, 20 bp, Artificial
  CRISPR gRNA sequence
cagtcacgagcaagaaagac

SEQ ID NO: 16167 - DNA, 20 bp, Artificial
  CRISPR gRNA sequence
agtcacgagcaagaaagaca

SEQ ID NO: 16168 - DNA, 20 bp, Artificial
  CRISPR gRNA sequence
agacaaggtccctgtcctca

SEQ ID NO: 16169 - DNA, 20 bp, Artificial
  CRISPR gRNA sequence
caaggtccctgtcctcacag

SEQ ID NO: 16170 - DNA, 20 bp, Artificial
  CRISPR gRNA sequence
aaggtccctgtcctcacagt

SEQ ID NO: 16171 - DNA, 20 bp, Artificial
  CRISPR gRNA sequence
ggtccctgtcctcacagtgg

SEQ ID NO: 16172 - DNA, 20 bp, Artificial
  CRISPR gRNA sequence
tccctgtcctcacagtggga

SEQ ID NO: 16173 - DNA, 20 bp, Artificial
  CRISPR gRNA sequence
tgtcctcacagtgggagagc

SEQ ID NO: 16174 - DNA, 20 bp, Artificial
  CRISPR gRNA sequence
gtcctcacagtgggagagca

SEQ ID NO: 16175 - DNA, 20 bp, Artificial
  CRISPR gRNA sequence
agcaaggcgtaaaatatgtc

SEQ ID NO: 16176 - DNA, 20 bp, Artificial
  CRISPR gRNA sequence
aggcgtaaaatatgtccaga

SEQ ID NO: 16177 - DNA, 20 bp, Artificial
  CRISPR gRNA sequence
aaatatgtccagatggtaat

SEQ ID NO: 16178 - DNA, 20 bp, Artificial
  CRISPR gRNA sequence
ggtaatgagtgctaaactgc

SEQ ID NO: 16179 - DNA, 20 bp, Artificial
  CRISPR gRNA sequence
gtaatgagtgctaaactgca

SEQ ID NO: 16180 - DNA, 20 bp, Artificial
  CRISPR gRNA sequence
agtgctaaactgcaaggaaa

SEQ ID NO: 16181 - DNA, 20 bp, Artificial
  CRISPR gRNA sequence
ctgcaaggaaaaagacacac

SEQ ID NO: 16182 - DNA, 20 bp, Artificial
  CRISPR gRNA sequence
tgcaaggaaaaagacacaca

SEQ ID NO: 16183 - DNA, 20 bp, Artificial
  CRISPR gRNA sequence
aggaaaaagacacacaaggt

SEQ ID NO: 16184 - DNA, 20 bp, Artificial
  CRISPR gRNA sequence
cacacaaggtgagaataact

SEQ ID NO: 16185 - DNA, 20 bp, Artificial
  CRISPR gRNA sequence
aataactgagctaatctaca

SEQ ID NO: 16186 - DNA, 20 bp, Artificial
  CRISPR gRNA sequence
aactgagctaatctacatgg

SEQ ID NO: 16187 - DNA, 20 bp, Artificial
  CRISPR gRNA sequence
actgagctaatctacatgga

SEQ ID NO: 16188 - DNA, 20 bp, Artificial
  CRISPR gRNA sequence
agctaatctacatggaagga

SEQ ID NO: 16189 - DNA, 20 bp, Artificial
  CRISPR gRNA sequence
aatctacatggaaggatggt

SEQ ID NO: 16190 - DNA, 20 bp, Artificial
  CRISPR gRNA sequence
tctacatggaaggatggtca

SEQ ID NO: 16191 - DNA, 20 bp, Artificial
  CRISPR gRNA sequence
acatggaaggatggtcagag

SEQ ID NO: 16192 - DNA, 20 bp, Artificial
  CRISPR gRNA sequence
catggaaggatggtcagaga

SEQ ID NO: 16193 - DNA, 20 bp, Artificial
  CRISPR gRNA sequence
atggaaggatggtcagagaa

SEQ ID NO: 16194 - DNA, 20 bp, Artificial
  CRISPR gRNA sequence
ggatggtcagagaagggttc

SEQ ID NO: 16195 - DNA, 20 bp, Artificial
  CRISPR gRNA sequence
gatggtcagagaagggttcc

SEQ ID NO: 16196 - DNA, 20 bp, Artificial
  CRISPR gRNA sequence
ggtcagagaagggttccagg

SEQ ID NO: 16197 - DNA, 20 bp, Artificial
  CRISPR gRNA sequence
tcagagaagggttccaggaa

SEQ ID NO: 16198 - DNA, 20 bp, Artificial
  CRISPR gRNA sequence
cagagaagggttccaggaag

SEQ ID NO: 16199 - DNA, 20 bp, Artificial
  CRISPR gRNA sequence
agggttccaggaagaggtga

SEQ ID NO: 16200 - DNA, 20 bp, Artificial
  CRISPR gRNA sequence
tccaggaagaggtgacagtt

SEQ ID NO: 16201 - DNA, 20 bp, Artificial
  CRISPR gRNA sequence
ggtgacagtttagccaacac

SEQ ID NO: 16202 - DNA, 20 bp, Artificial
  CRISPR gRNA sequence
acagtttagccaacaccaga

SEQ ID NO: 16203 - DNA, 20 bp, Artificial
  CRISPR gRNA sequence
gccaacaccagaaagattca

SEQ ID NO: 16204 - DNA, 20 bp, Artificial
  CRISPR gRNA sequence
ccaacaccagaaagattcaa

SEQ ID NO: 16205 - DNA, 20 bp, Artificial
  CRISPR gRNA sequence
aacaccagaaagattcaaag

SEQ ID NO: 16206 - DNA, 20 bp, Artificial
  CRISPR gRNA sequence
ccagaaagattcaaaggagt

SEQ ID NO: 16207 - DNA, 20 bp, Artificial
  CRISPR gRNA sequence
agattcaaaggagtcagcca

SEQ ID NO: 16208 - DNA, 20 bp, Artificial
  CRISPR gRNA sequence
gattcaaaggagtcagccat

SEQ ID NO: 16209 - DNA, 20 bp, Artificial
  CRISPR gRNA sequence
tcaaaggagtcagccatggg

SEQ ID NO: 16210 - DNA, 20 bp, Artificial
  CRISPR gRNA sequence
gagtcagccatgggaagaac

SEQ ID NO: 16211 - DNA, 20 bp, Artificial
  CRISPR gRNA sequence
agtcagccatgggaagaact

SEQ ID NO: 16212 - DNA, 20 bp, Artificial
  CRISPR gRNA sequence
gtcagccatgggaagaactg

SEQ ID NO: 16213 - DNA, 20 bp, Artificial
  CRISPR gRNA sequence
tcagccatgggaagaactgg

SEQ ID NO: 16214 - DNA, 20 bp, Artificial
  CRISPR gRNA sequence
gccatgggaagaactggggg

SEQ ID NO: 16215 - DNA, 20 bp, Artificial
  CRISPR gRNA sequence
ccatgggaagaactggggga

SEQ ID NO: 16216 - DNA, 20 bp, Artificial
  CRISPR gRNA sequence
catgggaagaactgggggaa

SEQ ID NO: 16217 - DNA, 20 bp, Artificial
  CRISPR gRNA sequence
gaactgggggaagggcattc

SEQ ID NO: 16218 - DNA, 20 bp, Artificial
  CRISPR gRNA sequence
tgggggaagggcattccaga

SEQ ID NO: 16219 - DNA, 20 bp, Artificial
  CRISPR gRNA sequence
ggggaagggcattccagata

SEQ ID NO: 16220 - DNA, 20 bp, Artificial
  CRISPR gRNA sequence
ggcattccagatagagacta

SEQ ID NO: 16221 - DNA, 20 bp, Artificial
  CRISPR gRNA sequence
tagagactatagcaactgca

SEQ ID NO: 16222 - DNA, 20 bp, Artificial
  CRISPR gRNA sequence
agagactatagcaactgcaa

SEQ ID NO: 16223 - DNA, 20 bp, Artificial
  CRISPR gRNA sequence
atagcaactgcaaaggcccc

SEQ ID NO: 16224 - DNA, 20 bp, Artificial
  CRISPR gRNA sequence
tagcaactgcaaaggccccg

SEQ ID NO: 16225 - DNA, 20 bp, Artificial
  CRISPR gRNA sequence
gcaaaggccccgaggcttga

SEQ ID NO: 16226 - DNA, 20 bp, Artificial
  CRISPR gRNA sequence
caaaggccccgaggcttgaa

SEQ ID NO: 16227 - DNA, 20 bp, Artificial
  CRISPR gRNA sequence
aaaggccccgaggcttgaaa

SEQ ID NO: 16228 - DNA, 20 bp, Artificial
  CRISPR gRNA sequence
ccgaggcttgaaagggcaca

SEQ ID NO: 16229 - DNA, 20 bp, Artificial
  CRISPR gRNA sequence
cgaggcttgaaagggcacat

SEQ ID NO: 16230 - DNA, 20 bp, Artificial
  CRISPR gRNA sequence
ttgaaagggcacatgggtta

SEQ ID NO: 16231 - DNA, 20 bp, Artificial
  CRISPR gRNA sequence
tgaaagggcacatgggttat

SEQ ID NO: 16232 - DNA, 20 bp, Artificial
  CRISPR gRNA sequence
aaagggcacatgggttatag

SEQ ID NO: 16233 - DNA, 20 bp, Artificial
  CRISPR gRNA sequence
gggcacatgggttataggag

SEQ ID NO: 16234 - DNA, 20 bp, Artificial
  CRISPR gRNA sequence
gcacatgggttataggagtg

SEQ ID NO: 16235 - DNA, 20 bp, Artificial
  CRISPR gRNA sequence
catgggttataggagtggag

SEQ ID NO: 16236 - DNA, 20 bp, Artificial
  CRISPR gRNA sequence
ggttataggagtggagaagc

SEQ ID NO: 16237 - DNA, 20 bp, Artificial
  CRISPR gRNA sequence
tataggagtggagaagctgg

SEQ ID NO: 16238 - DNA, 20 bp, Artificial
  CRISPR gRNA sequence
aggagtggagaagctggtgg

SEQ ID NO: 16239 - DNA, 20 bp, Artificial
  CRISPR gRNA sequence
ggagaagctggtggtggctg

SEQ ID NO: 16240 - DNA, 20 bp, Artificial
  CRISPR gRNA sequence
agctggtggtggctgaagtg

SEQ ID NO: 16241 - DNA, 20 bp, Artificial
  CRISPR gRNA sequence
ggctgaagtgtggtgtctca

SEQ ID NO: 16242 - DNA, 20 bp, Artificial
  CRISPR gRNA sequence
tgaagtgtggtgtctcatag

SEQ ID NO: 16243 - DNA, 20 bp, Artificial
  CRISPR gRNA sequence
gaagtgtggtgtctcatagt

SEQ ID NO: 16244 - DNA, 20 bp, Artificial
  CRISPR gRNA sequence
gtggtgtctcatagtgggtt

SEQ ID NO: 16245 - DNA, 20 bp, Artificial
  CRISPR gRNA sequence
ggtgtctcatagtgggtttg

SEQ ID NO: 16246 - DNA, 20 bp, Artificial
  CRISPR gRNA sequence
tgtctcatagtgggtttgga

SEQ ID NO: 16247 - DNA, 20 bp, Artificial
  CRISPR gRNA sequence
gtctcatagtgggtttggag

SEQ ID NO: 16248 - DNA, 20 bp, Artificial
  CRISPR gRNA sequence
tctcatagtgggtttggaga

SEQ ID NO: 16249 - DNA, 20 bp, Artificial
  CRISPR gRNA sequence
tcatagtgggtttggagagg

SEQ ID NO: 16250 - DNA, 20 bp, Artificial
  CRISPR gRNA sequence
catagtgggtttggagaggg

SEQ ID NO: 16251 - DNA, 20 bp, Artificial
  CRISPR gRNA sequence
agtgggtttggagagggagg

SEQ ID NO: 16252 - DNA, 20 bp, Artificial
  CRISPR gRNA sequence
gtgggtttggagagggagga

SEQ ID NO: 16253 - DNA, 20 bp, Artificial
  CRISPR gRNA sequence
tgggtttggagagggaggaa

SEQ ID NO: 16254 - DNA, 20 bp, Artificial
  CRISPR gRNA sequence
gagagggaggaagggccata

SEQ ID NO: 16255 - DNA, 20 bp, Artificial
  CRISPR gRNA sequence
agagggaggaagggccatac

SEQ ID NO: 16256 - DNA, 20 bp, Artificial
  CRISPR gRNA sequence
gaagggccatacaggccttg

SEQ ID NO: 16257 - DNA, 20 bp, Artificial
  CRISPR gRNA sequence
gccttgtggcatgtattttg

SEQ ID NO: 16258 - DNA, 20 bp, Artificial
  CRISPR gRNA sequence
ggcatgtattttgtagccat

SEQ ID NO: 16259 - DNA, 20 bp, Artificial
  CRISPR gRNA sequence
catgtattttgtagccattg

SEQ ID NO: 16260 - DNA, 20 bp, Artificial
  CRISPR gRNA sequence
atgtattttgtagccattgg

SEQ ID NO: 16261 - DNA, 20 bp, Artificial
  CRISPR gRNA sequence
tgtattttgtagccattgga

SEQ ID NO: 16262 - DNA, 20 bp, Artificial
  CRISPR gRNA sequence
tgtagccattggagggttat

SEQ ID NO: 16263 - DNA, 20 bp, Artificial
  CRISPR gRNA sequence
gtagccattggagggttatc

SEQ ID NO: 16264 - DNA, 20 bp, Artificial
  CRISPR gRNA sequence
tagccattggagggttatca

SEQ ID NO: 16265 - DNA, 20 bp, Artificial
  CRISPR gRNA sequence
tatcagggccatgaaataat

SEQ ID NO: 16266 - DNA, 20 bp, Artificial
  CRISPR gRNA sequence
aataatcagatgtacatttt

SEQ ID NO: 16267 - DNA, 20 bp, Artificial
  CRISPR gRNA sequence
ataatcagatgtacatttta

SEQ ID NO: 16268 - DNA, 20 bp, Artificial
  CRISPR gRNA sequence
gtacattttaaggctcctgt

SEQ ID NO: 16269 - DNA, 20 bp, Artificial
  CRISPR gRNA sequence
aaggctcctgttggctttta

SEQ ID NO: 16270 - DNA, 20 bp, Artificial
  CRISPR gRNA sequence
aggctcctgttggcttttaa

SEQ ID NO: 16271 - DNA, 20 bp, Artificial
  CRISPR gRNA sequence
ggctcctgttggcttttaaa

SEQ ID NO: 16272 - DNA, 20 bp, Artificial
  CRISPR gRNA sequence
cttttaaagggcctcccaac

SEQ ID NO: 16273 - DNA, 20 bp, Artificial
  CRISPR gRNA sequence
taaagggcctcccaaccaga

SEQ ID NO: 16274 - DNA, 20 bp, Artificial
  CRISPR gRNA sequence
aaagggcctcccaaccagac

SEQ ID NO: 16275 - DNA, 20 bp, Artificial
  CRISPR gRNA sequence
cctcccaaccagacaggact

SEQ ID NO: 16276 - DNA, 20 bp, Artificial
  CRISPR gRNA sequence
ccaaccagacaggacttagc

SEQ ID NO: 16277 - DNA, 20 bp, Artificial
  CRISPR gRNA sequence
caaccagacaggacttagcg

SEQ ID NO: 16278 - DNA, 20 bp, Artificial
  CRISPR gRNA sequence
aaccagacaggacttagcga

SEQ ID NO: 16279 - DNA, 20 bp, Artificial
  CRISPR gRNA sequence
cagacaggacttagcgaggg

SEQ ID NO: 16280 - DNA, 20 bp, Artificial
  CRISPR gRNA sequence
caggacttagcgagggaagc

SEQ ID NO: 16281 - DNA, 20 bp, Artificial
  CRISPR gRNA sequence
acttagcgagggaagcaagt

SEQ ID NO: 16282 - DNA, 20 bp, Artificial
  CRISPR gRNA sequence
agggaagcaagttggaccca

SEQ ID NO: 16283 - DNA, 20 bp, Artificial
  CRISPR gRNA sequence
gaagcaagttggacccacag

SEQ ID NO: 16284 - DNA, 20 bp, Artificial
  CRISPR gRNA sequence
aagcaagttggacccacagc

SEQ ID NO: 16285 - DNA, 20 bp, Artificial
  CRISPR gRNA sequence
gttggacccacagcaggctt

SEQ ID NO: 16286 - DNA, 20 bp, Artificial
  CRISPR gRNA sequence
tggacccacagcaggctttg

SEQ ID NO: 16287 - DNA, 20 bp, Artificial
  CRISPR gRNA sequence
ccacagcaggctttggagtc

SEQ ID NO: 16288 - DNA, 20 bp, Artificial
  CRISPR gRNA sequence
cacagcaggctttggagtca

SEQ ID NO: 16289 - DNA, 20 bp, Artificial
  CRISPR gRNA sequence
gcaggctttggagtcaagga

SEQ ID NO: 16290 - DNA, 20 bp, Artificial
  CRISPR gRNA sequence
caggctttggagtcaaggaa

SEQ ID NO: 16291 - DNA, 20 bp, Artificial
  CRISPR gRNA sequence
ctttggagtcaaggaaaggc

SEQ ID NO: 16292 - DNA, 20 bp, Artificial
  CRISPR gRNA sequence
tttggagtcaaggaaaggcc

SEQ ID NO: 16293 - DNA, 20 bp, Artificial
  CRISPR gRNA sequence
tcaaggaaaggccaggtctc

SEQ ID NO: 16294 - DNA, 20 bp, Artificial
  CRISPR gRNA sequence
ggaaaggccaggtctcaagc

SEQ ID NO: 16295 - DNA, 20 bp, Artificial
  CRISPR gRNA sequence
gaaaggccaggtctcaagca

SEQ ID NO: 16296 - DNA, 20 bp, Artificial
  CRISPR gRNA sequence
ggccaggtctcaagcaaggc

SEQ ID NO: 16297 - DNA, 20 bp, Artificial
  CRISPR gRNA sequence
gccaggtctcaagcaaggct

SEQ ID NO: 16298 - DNA, 20 bp, Artificial
  CRISPR gRNA sequence
ggtctcaagcaaggctaggt

SEQ ID NO: 16299 - DNA, 20 bp, Artificial
  CRISPR gRNA sequence
caagcaaggctaggttggat

SEQ ID NO: 16300 - DNA, 20 bp, Artificial
  CRISPR gRNA sequence
aagcaaggctaggttggatc

SEQ ID NO: 16301 - DNA, 20 bp, Artificial
  CRISPR gRNA sequence
agcaaggctaggttggatca

SEQ ID NO: 16302 - DNA, 20 bp, Artificial
  CRISPR gRNA sequence
caaggctaggttggatcagg

SEQ ID NO: 16303 - DNA, 20 bp, Artificial
  CRISPR gRNA sequence
aaggctaggttggatcaggg

SEQ ID NO: 16304 - DNA, 20 bp, Artificial
  CRISPR gRNA sequence
aggctaggttggatcaggga

SEQ ID NO: 16305 - DNA, 20 bp, Artificial
  CRISPR gRNA sequence
ggctaggttggatcagggag

SEQ ID NO: 16306 - DNA, 20 bp, Artificial
  CRISPR gRNA sequence
cttttctgcccaacttctgc

SEQ ID NO: 16307 - DNA, 20 bp, Artificial
  CRISPR gRNA sequence
ctctcaccgatcacttcatc

SEQ ID NO: 16308 - DNA, 20 bp, Artificial
  CRISPR gRNA sequence
ggtcctatgtgctctacttt

SEQ ID NO: 16309 - DNA, 20 bp, Artificial
  CRISPR gRNA sequence
tgctctactttgagaaaaac

SEQ ID NO: 16310 - DNA, 20 bp, Artificial
  CRISPR gRNA sequence
ctctactttgagaaaaacca

SEQ ID NO: 16311 - DNA, 20 bp, Artificial
  CRISPR gRNA sequence
ccaactcacacaatcaatga

SEQ ID NO: 16312 - DNA, 20 bp, Artificial
  CRISPR gRNA sequence
cacacaatcaatgaaagccc

SEQ ID NO: 16313 - DNA, 20 bp, Artificial
  CRISPR gRNA sequence
acacaatcaatgaaagccca

SEQ ID NO: 16314 - DNA, 20 bp, Artificial
  CRISPR gRNA sequence
aatcaatgaaagcccaaggt

SEQ ID NO: 16315 - DNA, 20 bp, Artificial
  CRISPR gRNA sequence
agtctctattgtacccacct

SEQ ID NO: 16316 - DNA, 20 bp, Artificial
  CRISPR gRNA sequence
gtctctattgtacccacctt

SEQ ID NO: 16317 - DNA, 20 bp, Artificial
  CRISPR gRNA sequence
tctctattgtacccaccttg

SEQ ID NO: 16318 - DNA, 20 bp, Artificial
  CRISPR gRNA sequence
tctattgtacccaccttggg

SEQ ID NO: 16319 - DNA, 20 bp, Artificial
  CRISPR gRNA sequence
tattgtacccaccttgggga

SEQ ID NO: 16320 - DNA, 20 bp, Artificial
  CRISPR gRNA sequence
attgtacccaccttggggag

SEQ ID NO: 16321 - DNA, 20 bp, Artificial
  CRISPR gRNA sequence
ttgtacccaccttggggaga

SEQ ID NO: 16322 - DNA, 20 bp, Artificial
  CRISPR gRNA sequence
tgtacccaccttggggagag

SEQ ID NO: 16323 - DNA, 20 bp, Artificial
  CRISPR gRNA sequence
tctgactgcccatcaatgaa

SEQ ID NO: 16324 - DNA, 20 bp, Artificial
  CRISPR gRNA sequence
gcccatcaatgaatggtcgt

SEQ ID NO: 16325 - DNA, 20 bp, Artificial
  CRISPR gRNA sequence
cccatcaatgaatggtcgtc

SEQ ID NO: 16326 - DNA, 20 bp, Artificial
  CRISPR gRNA sequence
aatgaatggtcgtcaggtat

SEQ ID NO: 16327 - DNA, 20 bp, Artificial
  CRISPR gRNA sequence
atgaatggtcgtcaggtatt

SEQ ID NO: 16328 - DNA, 20 bp, Artificial
  CRISPR gRNA sequence
tgaatggtcgtcaggtatta

SEQ ID NO: 16329 - DNA, 20 bp, Artificial
  CRISPR gRNA sequence
tcaggtattagggcaccccc

SEQ ID NO: 16330 - DNA, 20 bp, Artificial
  CRISPR gRNA sequence
caggtattagggcacccccc

SEQ ID NO: 16331 - DNA, 20 bp, Artificial
  CRISPR gRNA sequence
aggtattagggcacccccca

SEQ ID NO: 16332 - DNA, 20 bp, Artificial
  CRISPR gRNA sequence
tagggcaccccccagggaac

SEQ ID NO: 16333 - DNA, 20 bp, Artificial
  CRISPR gRNA sequence
agggcaccccccagggaaca

SEQ ID NO: 16334 - DNA, 20 bp, Artificial
  CRISPR gRNA sequence
gcaccccccagggaacaagg

SEQ ID NO: 16335 - DNA, 20 bp, Artificial
  CRISPR gRNA sequence
caccccccagggaacaaggc

SEQ ID NO: 16336 - DNA, 20 bp, Artificial
  CRISPR gRNA sequence
agggaacaaggcaggaaatg

SEQ ID NO: 16337 - DNA, 20 bp, Artificial
  CRISPR gRNA sequence
gggaacaaggcaggaaatgc

SEQ ID NO: 16338 - DNA, 20 bp, Artificial
  CRISPR gRNA sequence
caaggcaggaaatgcaggct

SEQ ID NO: 16339 - DNA, 20 bp, Artificial
  CRISPR gRNA sequence
caggaaatgcaggctgagcc

SEQ ID NO: 16340 - DNA, 20 bp, Artificial
  CRISPR gRNA sequence
ttactgaaaatgtccttgct

SEQ ID NO: 16341 - DNA, 20 bp, Artificial
  CRISPR gRNA sequence
tactgaaaatgtccttgctc

SEQ ID NO: 16342 - DNA, 20 bp, Artificial
  CRISPR gRNA sequence
atgtccttgctcaggccctc

SEQ ID NO: 16343 - DNA, 20 bp, Artificial
  CRISPR gRNA sequence
ccttgctcaggccctccagc

SEQ ID NO: 16344 - DNA, 20 bp, Artificial
  CRISPR gRNA sequence
cttgctcaggccctccagct

SEQ ID NO: 16345 - DNA, 20 bp, Artificial
  CRISPR gRNA sequence
tgctcaggccctccagctgg

SEQ ID NO: 16346 - DNA, 20 bp, Artificial
  CRISPR gRNA sequence
ggccctccagctgggagtcc

SEQ ID NO: 16347 - DNA, 20 bp, Artificial
  CRISPR gRNA sequence
cctccagctgggagtcctgg

SEQ ID NO: 16348 - DNA, 20 bp, Artificial
  CRISPR gRNA sequence
gggagtcctggaagacatac

SEQ ID NO: 16349 - DNA, 20 bp, Artificial
  CRISPR gRNA sequence
tcctggaagacatactggtc

SEQ ID NO: 16350 - DNA, 20 bp, Artificial
  CRISPR gRNA sequence
actggtccagttccgctgcc

SEQ ID NO: 16351 - DNA, 20 bp, Artificial
  CRISPR gRNA sequence
tccagttccgctgcccagac

SEQ ID NO: 16352 - DNA, 20 bp, Artificial
  CRISPR gRNA sequence
ccagttccgctgcccagaca

SEQ ID NO: 16353 - DNA, 20 bp, Artificial
  CRISPR gRNA sequence
tccgctgcccagacaaggaa

SEQ ID NO: 16354 - DNA, 20 bp, Artificial
  CRISPR gRNA sequence
tgcccagacaaggaaaagcg

SEQ ID NO: 16355 - DNA, 20 bp, Artificial
  CRISPR gRNA sequence
gaaaagcgcagtcaatcaac

SEQ ID NO: 16356 - DNA, 20 bp, Artificial
  CRISPR gRNA sequence
aaaagcgcagtcaatcaaca

SEQ ID NO: 16357 - DNA, 20 bp, Artificial
  CRISPR gRNA sequence
caatcaacaaggtctaactg

SEQ ID NO: 16358 - DNA, 20 bp, Artificial
  CRISPR gRNA sequence
aatcaacaaggtctaactga

SEQ ID NO: 16359 - DNA, 20 bp, Artificial
  CRISPR gRNA sequence
actgaaggcccactgtgtgc

SEQ ID NO: 16360 - DNA, 20 bp, Artificial
  CRISPR gRNA sequence
ctgaaggcccactgtgtgcc

SEQ ID NO: 16361 - DNA, 20 bp, Artificial
  CRISPR gRNA sequence
gcccactgtgtgccaggcct

SEQ ID NO: 16362 - DNA, 20 bp, Artificial
  CRISPR gRNA sequence
cccactgtgtgccaggcctt

SEQ ID NO: 16363 - DNA, 20 bp, Artificial
  CRISPR gRNA sequence
ctgtgtgccaggccttgggc

SEQ ID NO: 16364 - DNA, 20 bp, Artificial
  CRISPR gRNA sequence
tgtgtgccaggccttgggct

SEQ ID NO: 16365 - DNA, 20 bp, Artificial
  CRISPR gRNA sequence
gtgtgccaggccttgggctg

SEQ ID NO: 16366 - DNA, 20 bp, Artificial
  CRISPR gRNA sequence
gccttgggctggggaacctc

SEQ ID NO: 16367 - DNA, 20 bp, Artificial
  CRISPR gRNA sequence
ccttgggctggggaacctct

SEQ ID NO: 16368 - DNA, 20 bp, Artificial
  CRISPR gRNA sequence
ggctggggaacctctgggcc

SEQ ID NO: 16369 - DNA, 20 bp, Artificial
  CRISPR gRNA sequence
gaacctctgggcctggcaca

SEQ ID NO: 16370 - DNA, 20 bp, Artificial
  CRISPR gRNA sequence
cctctgggcctggcacacag

SEQ ID NO: 16371 - DNA, 20 bp, Artificial
  CRISPR gRNA sequence
ctctgggcctggcacacagt

SEQ ID NO: 16372 - DNA, 20 bp, Artificial
  CRISPR gRNA sequence
tctgggcctggcacacagtg

SEQ ID NO: 16373 - DNA, 20 bp, Artificial
  CRISPR gRNA sequence
ctggcacacagtggggactc

SEQ ID NO: 16374 - DNA, 20 bp, Artificial
  CRISPR gRNA sequence
atgaatgaacactgacactc

SEQ ID NO: 16375 - DNA, 20 bp, Artificial
  CRISPR gRNA sequence
tgaatgaacactgacactcc

SEQ ID NO: 16376 - DNA, 20 bp, Artificial
  CRISPR gRNA sequence
gaatgaacactgacactcca

SEQ ID NO: 16377 - DNA, 20 bp, Artificial
  CRISPR gRNA sequence
aatgaacactgacactccag

SEQ ID NO: 16378 - DNA, 20 bp, Artificial
  CRISPR gRNA sequence
ggggcccttaatctaatcaa

SEQ ID NO: 16379 - DNA, 20 bp, Artificial
  CRISPR gRNA sequence
gggcccttaatctaatcaaa

SEQ ID NO: 16380 - DNA, 20 bp, Artificial
  CRISPR gRNA sequence
cttaatctaatcaaaaggat

SEQ ID NO: 16381 - DNA, 20 bp, Artificial
  CRISPR gRNA sequence
ttaatctaatcaaaaggatg

SEQ ID NO: 16382 - DNA, 20 bp, Artificial
  CRISPR gRNA sequence
aaaacttatctactgctaca

SEQ ID NO: 16383 - DNA, 20 bp, Artificial
  CRISPR gRNA sequence
acttatctactgctacaaag

SEQ ID NO: 16384 - DNA, 20 bp, Artificial
  CRISPR gRNA sequence
ttatctactgctacaaagaa

SEQ ID NO: 16385 - DNA, 20 bp, Artificial
  CRISPR gRNA sequence
ctactgctacaaagaagagc

SEQ ID NO: 16386 - DNA, 20 bp, Artificial
  CRISPR gRNA sequence
tactgctacaaagaagagca

SEQ ID NO: 16387 - DNA, 20 bp, Artificial
  CRISPR gRNA sequence
tgctacaaagaagagcaagg

SEQ ID NO: 16388 - DNA, 20 bp, Artificial
  CRISPR gRNA sequence
caaagaagagcaaggcagaa

SEQ ID NO: 16389 - DNA, 20 bp, Artificial
  CRISPR gRNA sequence
agaagagcaaggcagaatgg

SEQ ID NO: 16390 - DNA, 20 bp, Artificial
  CRISPR gRNA sequence
aagagcaaggcagaatggta

SEQ ID NO: 16391 - DNA, 20 bp, Artificial
  CRISPR gRNA sequence
gcagaatggtagagttactg

SEQ ID NO: 16392 - DNA, 20 bp, Artificial
  CRISPR gRNA sequence
cagaatggtagagttactgc

SEQ ID NO: 16393 - DNA, 20 bp, Artificial
  CRISPR gRNA sequence
gtagagttactgcaggattt

SEQ ID NO: 16394 - DNA, 20 bp, Artificial
  CRISPR gRNA sequence
attccacctctactttccac

SEQ ID NO: 16395 - DNA, 20 bp, Artificial
  CRISPR gRNA sequence
ctactttccactagccctac

SEQ ID NO: 16396 - DNA, 20 bp, Artificial
  CRISPR gRNA sequence
ccctactagctgtgcaatct

SEQ ID NO: 16397 - DNA, 20 bp, Artificial
  CRISPR gRNA sequence
cctactagctgtgcaatctt

SEQ ID NO: 16398 - DNA, 20 bp, Artificial
  CRISPR gRNA sequence
ggctacttatttaaccactg

SEQ ID NO: 16399 - DNA, 20 bp, Artificial
  CRISPR gRNA sequence
gctacttatttaaccactgt

SEQ ID NO: 16400 - DNA, 20 bp, Artificial
  CRISPR gRNA sequence
ctccattttctcatctgtgt

SEQ ID NO: 16401 - DNA, 20 bp, Artificial
  CRISPR gRNA sequence
aataaataatgcctactacc

SEQ ID NO: 16402 - DNA, 20 bp, Artificial
  CRISPR gRNA sequence
ataaataatgcctactaccc

SEQ ID NO: 16403 - DNA, 20 bp, Artificial
  CRISPR gRNA sequence
gcctactacccaggaatcga

SEQ ID NO: 16404 - DNA, 20 bp, Artificial
  CRISPR gRNA sequence
caggaatcgatggtgataat

SEQ ID NO: 16405 - DNA, 20 bp, Artificial
  CRISPR gRNA sequence
ggaatcgatggtgataatta

SEQ ID NO: 16406 - DNA, 20 bp, Artificial
  CRISPR gRNA sequence
gaatcgatggtgataattag

SEQ ID NO: 16407 - DNA, 20 bp, Artificial
  CRISPR gRNA sequence
ataattagaggttctacatc

SEQ ID NO: 16408 - DNA, 20 bp, Artificial
  CRISPR gRNA sequence
aattagaggttctacatcta

SEQ ID NO: 16409 - DNA, 20 bp, Artificial
  CRISPR gRNA sequence
tacatctagagcatccaaca

SEQ ID NO: 16410 - DNA, 20 bp, Artificial
  CRISPR gRNA sequence
atctagagcatccaacacag

SEQ ID NO: 16411 - DNA, 20 bp, Artificial
  CRISPR gRNA sequence
agagcatccaacacagtagc

SEQ ID NO: 16412 - DNA, 20 bp, Artificial
  CRISPR gRNA sequence
ccaacacagtagctggtata

SEQ ID NO: 16413 - DNA, 20 bp, Artificial
  CRISPR gRNA sequence
acacagtagctggtatacag

SEQ ID NO: 16414 - DNA, 20 bp, Artificial
  CRISPR gRNA sequence
cacagtagctggtatacagt

SEQ ID NO: 16415 - DNA, 20 bp, Artificial
  CRISPR gRNA sequence
gctggtatacagtaggcact

SEQ ID NO: 16416 - DNA, 20 bp, Artificial
  CRISPR gRNA sequence
tacagtaggcactcagtaaa

SEQ ID NO: 16417 - DNA, 20 bp, Artificial
  CRISPR gRNA sequence
agtaggcactcagtaaatag

SEQ ID NO: 16418 - DNA, 20 bp, Artificial
  CRISPR gRNA sequence
taaatagtggtaactatata

SEQ ID NO: 16419 - DNA, 20 bp, Artificial
  CRISPR gRNA sequence
aaatagtggtaactatataa

SEQ ID NO: 16420 - DNA, 20 bp, Artificial
  CRISPR gRNA sequence
aatagtggtaactatataaa

SEQ ID NO: 16421 - DNA, 20 bp, Artificial
  CRISPR gRNA sequence
atagtggtaactatataaag

SEQ ID NO: 16422 - DNA, 20 bp, Artificial
  CRISPR gRNA sequence
taactatataaaggggtaca

SEQ ID NO: 16423 - DNA, 20 bp, Artificial
  CRISPR gRNA sequence
atataaaggggtacatggct

SEQ ID NO: 16424 - DNA, 20 bp, Artificial
  CRISPR gRNA sequence
ataaaggggtacatggctca

SEQ ID NO: 16425 - DNA, 20 bp, Artificial
  CRISPR gRNA sequence
ggtacatggctcagagccct

SEQ ID NO: 16426 - DNA, 20 bp, Artificial
  CRISPR gRNA sequence
ggctcagagcccttggaata

SEQ ID NO: 16427 - DNA, 20 bp, Artificial
  CRISPR gRNA sequence
gctcagagcccttggaatat

SEQ ID NO: 16428 - DNA, 20 bp, Artificial
  CRISPR gRNA sequence
aatataggcaccatgacatg

SEQ ID NO: 16429 - DNA, 20 bp, Artificial
  CRISPR gRNA sequence
ggcaccatgacatgaagtcc

SEQ ID NO: 16430 - DNA, 20 bp, Artificial
  CRISPR gRNA sequence
tgacatgaagtccgagaaaa

SEQ ID NO: 16431 - DNA, 20 bp, Artificial
  CRISPR gRNA sequence
gacatgaagtccgagaaaaa

SEQ ID NO: 16432 - DNA, 20 bp, Artificial
  CRISPR gRNA sequence
agtccgagaaaaaaggtgta

SEQ ID NO: 16433 - DNA, 20 bp, Artificial
  CRISPR gRNA sequence
ccgagaaaaaaggtgtatgg

SEQ ID NO: 16434 - DNA, 20 bp, Artificial
  CRISPR gRNA sequence
aaaaaaggtgtatggtggaa

SEQ ID NO: 16435 - DNA, 20 bp, Artificial
  CRISPR gRNA sequence
aaaaaggtgtatggtggaat

SEQ ID NO: 16436 - DNA, 20 bp, Artificial
  CRISPR gRNA sequence
aaaaggtgtatggtggaata

SEQ ID NO: 16437 - DNA, 20 bp, Artificial
  CRISPR gRNA sequence
gtatggtggaatagggcaat

SEQ ID NO: 16438 - DNA, 20 bp, Artificial
  CRISPR gRNA sequence
tatggtggaatagggcaatc

SEQ ID NO: 16439 - DNA, 20 bp, Artificial
  CRISPR gRNA sequence
atggtggaatagggcaatca

SEQ ID NO: 16440 - DNA, 20 bp, Artificial
  CRISPR gRNA sequence
gtggaatagggcaatcaggg

SEQ ID NO: 16441 - DNA, 20 bp, Artificial
  CRISPR gRNA sequence
tggaatagggcaatcaggga

SEQ ID NO: 16442 - DNA, 20 bp, Artificial
  CRISPR gRNA sequence
ggcaatcagggaaggcttcc

SEQ ID NO: 16443 - DNA, 20 bp, Artificial
  CRISPR gRNA sequence
caatcagggaaggcttcctg

SEQ ID NO: 16444 - DNA, 20 bp, Artificial
  CRISPR gRNA sequence
aatcagggaaggcttcctgg

SEQ ID NO: 16445 - DNA, 20 bp, Artificial
  CRISPR gRNA sequence
cagggaaggcttcctggagg

SEQ ID NO: 16446 - DNA, 20 bp, Artificial
  CRISPR gRNA sequence
agggaaggcttcctggagga

SEQ ID NO: 16447 - DNA, 20 bp, Artificial
  CRISPR gRNA sequence
gggaaggcttcctggaggaa

SEQ ID NO: 16448 - DNA, 20 bp, Artificial
  CRISPR gRNA sequence
cttcctggaggaagggatcc

SEQ ID NO: 16449 - DNA, 20 bp, Artificial
  CRISPR gRNA sequence
ggaggaagggatcctggaac

SEQ ID NO: 16450 - DNA, 20 bp, Artificial
  CRISPR gRNA sequence
gaggaagggatcctggaacc

SEQ ID NO: 16451 - DNA, 20 bp, Artificial
  CRISPR gRNA sequence
atcctggaaccaggccttga

SEQ ID NO: 16452 - DNA, 20 bp, Artificial
  CRISPR gRNA sequence
ggaaccaggccttgaaagat

SEQ ID NO: 16453 - DNA, 20 bp, Artificial
  CRISPR gRNA sequence
gaaccaggccttgaaagatg

SEQ ID NO: 16454 - DNA, 20 bp, Artificial
  CRISPR gRNA sequence
ccaggccttgaaagatgagg

SEQ ID NO: 16455 - DNA, 20 bp, Artificial
  CRISPR gRNA sequence
aggccttgaaagatgaggca

SEQ ID NO: 16456 - DNA, 20 bp, Artificial
  CRISPR gRNA sequence
ttgaaagatgaggcagagtc

SEQ ID NO: 16457 - DNA, 20 bp, Artificial
  CRISPR gRNA sequence
tgaaagatgaggcagagtct

SEQ ID NO: 16458 - DNA, 20 bp, Artificial
  CRISPR gRNA sequence
aaagatgaggcagagtctgg

SEQ ID NO: 16459 - DNA, 20 bp, Artificial
  CRISPR gRNA sequence
gatgaggcagagtctgggag

SEQ ID NO: 16460 - DNA, 20 bp, Artificial
  CRISPR gRNA sequence
atgaggcagagtctgggaga

SEQ ID NO: 16461 - DNA, 20 bp, Artificial
  CRISPR gRNA sequence
gaggcagagtctgggagaag

SEQ ID NO: 16462 - DNA, 20 bp, Artificial
  CRISPR gRNA sequence
agagtctgggagaaggagaa

SEQ ID NO: 16463 - DNA, 20 bp, Artificial
  CRISPR gRNA sequence
tctgggagaaggagaacaga

SEQ ID NO: 16464 - DNA, 20 bp, Artificial
  CRISPR gRNA sequence
aaggagaacagatagctttc

SEQ ID NO: 16465 - DNA, 20 bp, Artificial
  CRISPR gRNA sequence
aggagaacagatagctttct

SEQ ID NO: 16466 - DNA, 20 bp, Artificial
  CRISPR gRNA sequence
acagatagctttctgggtca

SEQ ID NO: 16467 - DNA, 20 bp, Artificial
  CRISPR gRNA sequence
gatagctttctgggtcacag

SEQ ID NO: 16468 - DNA, 20 bp, Artificial
  CRISPR gRNA sequence
agctttctgggtcacagtgg

SEQ ID NO: 16469 - DNA, 20 bp, Artificial
  CRISPR gRNA sequence
ctttctgggtcacagtggca

SEQ ID NO: 16470 - DNA, 20 bp, Artificial
  CRISPR gRNA sequence
ctgggtcacagtggcagagt

SEQ ID NO: 16471 - DNA, 20 bp, Artificial
  CRISPR gRNA sequence
tgggtcacagtggcagagtg

SEQ ID NO: 16472 - DNA, 20 bp, Artificial
  CRISPR gRNA sequence
gcagagtgaggaaacttgtt

SEQ ID NO: 16473 - DNA, 20 bp, Artificial
  CRISPR gRNA sequence
agagtgaggaaacttgttca

SEQ ID NO: 16474 - DNA, 20 bp, Artificial
  CRISPR gRNA sequence
aaacttgttcagagtatgtt

SEQ ID NO: 16475 - DNA, 20 bp, Artificial
  CRISPR gRNA sequence
aacttgttcagagtatgttt

SEQ ID NO: 16476 - DNA, 20 bp, Artificial
  CRISPR gRNA sequence
gagtatgtttaggaaaccct

SEQ ID NO: 16477 - DNA, 20 bp, Artificial
  CRISPR gRNA sequence
gtatgtttaggaaaccctga

SEQ ID NO: 16478 - DNA, 20 bp, Artificial
  CRISPR gRNA sequence
gtttaggaaaccctgagaga

SEQ ID NO: 16479 - DNA, 20 bp, Artificial
  CRISPR gRNA sequence
tttaggaaaccctgagagat

SEQ ID NO: 16480 - DNA, 20 bp, Artificial
  CRISPR gRNA sequence
aaaccctgagagataggtga

SEQ ID NO: 16481 - DNA, 20 bp, Artificial
  CRISPR gRNA sequence
ccctgagagataggtgacgg

SEQ ID NO: 16482 - DNA, 20 bp, Artificial
  CRISPR gRNA sequence
tgagagataggtgacggtgg

SEQ ID NO: 16483 - DNA, 20 bp, Artificial
  CRISPR gRNA sequence
gagataggtgacggtggtag

SEQ ID NO: 16484 - DNA, 20 bp, Artificial
  CRISPR gRNA sequence
cggtggtagaagtttcatgc

SEQ ID NO: 16485 - DNA, 20 bp, Artificial
  CRISPR gRNA sequence
ggtggtagaagtttcatgct

SEQ ID NO: 16486 - DNA, 20 bp, Artificial
  CRISPR gRNA sequence
gtggtagaagtttcatgctg

SEQ ID NO: 16487 - DNA, 20 bp, Artificial
  CRISPR gRNA sequence
tagaagtttcatgctgggga

SEQ ID NO: 16488 - DNA, 20 bp, Artificial
  CRISPR gRNA sequence
agtttcatgctggggaaagt

SEQ ID NO: 16489 - DNA, 20 bp, Artificial
  CRISPR gRNA sequence
gtttcatgctggggaaagtt

SEQ ID NO: 16490 - DNA, 20 bp, Artificial
  CRISPR gRNA sequence
aagttaggacttgattttat

SEQ ID NO: 16491 - DNA, 20 bp, Artificial
  CRISPR gRNA sequence
ggacttgattttataagcaa

SEQ ID NO: 16492 - DNA, 20 bp, Artificial
  CRISPR gRNA sequence
gacttgattttataagcaat

SEQ ID NO: 16493 - DNA, 20 bp, Artificial
  CRISPR gRNA sequence
acttgattttataagcaatg

SEQ ID NO: 16494 - DNA, 20 bp, Artificial
  CRISPR gRNA sequence
ttgattttataagcaatggg

SEQ ID NO: 16495 - DNA, 20 bp, Artificial
  CRISPR gRNA sequence
ttataagcaatggggagcca

SEQ ID NO: 16496 - DNA, 20 bp, Artificial
  CRISPR gRNA sequence
taagcaatggggagccatag

SEQ ID NO: 16497 - DNA, 20 bp, Artificial
  CRISPR gRNA sequence
aagcaatggggagccataga

SEQ ID NO: 16498 - DNA, 20 bp, Artificial
  CRISPR gRNA sequence
gggagccatagaaggcttct

SEQ ID NO: 16499 - DNA, 20 bp, Artificial
  CRISPR gRNA sequence
ccatagaaggcttctgagct

SEQ ID NO: 16500 - DNA, 20 bp, Artificial
  CRISPR gRNA sequence
catagaaggcttctgagctg

SEQ ID NO: 16501 - DNA, 20 bp, Artificial
  CRISPR gRNA sequence
aaggcttctgagctgaggaa

SEQ ID NO: 16502 - DNA, 20 bp, Artificial
  CRISPR gRNA sequence
tgagctgaggaatggaatga

SEQ ID NO: 16503 - DNA, 20 bp, Artificial
  CRISPR gRNA sequence
atggaatgatggccataatg

SEQ ID NO: 16504 - DNA, 20 bp, Artificial
  CRISPR gRNA sequence
tggaatgatggccataatga

SEQ ID NO: 16505 - DNA, 20 bp, Artificial
  CRISPR gRNA sequence
taatgaaggtgatgaaaatg

SEQ ID NO: 16506 - DNA, 20 bp, Artificial
  CRISPR gRNA sequence
aatgaagatgataataatga

SEQ ID NO: 16507 - DNA, 20 bp, Artificial
  CRISPR gRNA sequence
gatggtgataataatgataa

SEQ ID NO: 16508 - DNA, 20 bp, Artificial
  CRISPR gRNA sequence
ggtgataataatgataacgg

SEQ ID NO: 16509 - DNA, 20 bp, Artificial
  CRISPR gRNA sequence
aataatgataacggtggttg

SEQ ID NO: 16510 - DNA, 20 bp, Artificial
  CRISPR gRNA sequence
ataatgataacggtggttgt

SEQ ID NO: 16511 - DNA, 20 bp, Artificial
  CRISPR gRNA sequence
taatgataacggtggttgtg

SEQ ID NO: 16512 - DNA, 20 bp, Artificial
  CRISPR gRNA sequence
tgataacggtggttgtgggg

SEQ ID NO: 16513 - DNA, 20 bp, Artificial
  CRISPR gRNA sequence
tttacacattgtaacttatt

SEQ ID NO: 16514 - DNA, 20 bp, Artificial
  CRISPR gRNA sequence
gtcttacaaccatcccgtga

SEQ ID NO: 16515 - DNA, 20 bp, Artificial
  CRISPR gRNA sequence
ttacaaccatcccgtgatgg

SEQ ID NO: 16516 - DNA, 20 bp, Artificial
  CRISPR gRNA sequence
tacaaccatcccgtgatggt

SEQ ID NO: 16517 - DNA, 20 bp, Artificial
  CRISPR gRNA sequence
ttatctccattttacacatt

SEQ ID NO: 16518 - DNA, 20 bp, Artificial
  CRISPR gRNA sequence
tctccattttacacatttag

SEQ ID NO: 16519 - DNA, 20 bp, Artificial
  CRISPR gRNA sequence
attttacacatttagaagct

SEQ ID NO: 16520 - DNA, 20 bp, Artificial
  CRISPR gRNA sequence
ttttacacatttagaagcta

SEQ ID NO: 16521 - DNA, 20 bp, Artificial
  CRISPR gRNA sequence
tagaagctaaggtcatattt

SEQ ID NO: 16522 - DNA, 20 bp, Artificial
  CRISPR gRNA sequence
agaagctaaggtcatatttc

SEQ ID NO: 16523 - DNA, 20 bp, Artificial
  CRISPR gRNA sequence
catatttcaggatgctgcaa

SEQ ID NO: 16524 - DNA, 20 bp, Artificial
  CRISPR gRNA sequence
gctgcaaaagaatacttgcc

SEQ ID NO: 16525 - DNA, 20 bp, Artificial
  CRISPR gRNA sequence
ctgcaaaagaatacttgccc

SEQ ID NO: 16526 - DNA, 20 bp, Artificial
  CRISPR gRNA sequence
aaagaatacttgcccaggcc

SEQ ID NO: 16527 - DNA, 20 bp, Artificial
  CRISPR gRNA sequence
aagaatacttgcccaggcct

SEQ ID NO: 16528 - DNA, 20 bp, Artificial
  CRISPR gRNA sequence
caggcctgggcttcaccttc

SEQ ID NO: 16529 - DNA, 20 bp, Artificial
  CRISPR gRNA sequence
gcctgggcttcaccttccag

SEQ ID NO: 16530 - DNA, 20 bp, Artificial
  CRISPR gRNA sequence
tgggcttcaccttccagaag

SEQ ID NO: 16531 - DNA, 20 bp, Artificial
  CRISPR gRNA sequence
ggcttcaccttccagaagca

SEQ ID NO: 16532 - DNA, 20 bp, Artificial
  CRISPR gRNA sequence
cttcaccttccagaagcaga

SEQ ID NO: 16533 - DNA, 20 bp, Artificial
  CRISPR gRNA sequence
agaagcagagagaaaaccca

SEQ ID NO: 16534 - DNA, 20 bp, Artificial
  CRISPR gRNA sequence
gagagaaaacccacagactt

SEQ ID NO: 16535 - DNA, 20 bp, Artificial
  CRISPR gRNA sequence
agagaaaacccacagacttg

SEQ ID NO: 16536 - DNA, 20 bp, Artificial
  CRISPR gRNA sequence
agaaaacccacagacttgag

SEQ ID NO: 16537 - DNA, 20 bp, Artificial
  CRISPR gRNA sequence
aaacccacagacttgaggag

SEQ ID NO: 16538 - DNA, 20 bp, Artificial
  CRISPR gRNA sequence
acagacttgaggagcagact

SEQ ID NO: 16539 - DNA, 20 bp, Artificial
  CRISPR gRNA sequence
cagacttgaggagcagactt

SEQ ID NO: 16540 - DNA, 20 bp, Artificial
  CRISPR gRNA sequence
ttgaggagcagacttgggtg

SEQ ID NO: 16541 - DNA, 20 bp, Artificial
  CRISPR gRNA sequence
tataaatgtaatcccctatg

SEQ ID NO: 16542 - DNA, 20 bp, Artificial
  CRISPR gRNA sequence
aaatgtaatcccctatgtgg

SEQ ID NO: 16543 - DNA, 20 bp, Artificial
  CRISPR gRNA sequence
atcccctatgtggcagtatt

SEQ ID NO: 16544 - DNA, 20 bp, Artificial
  CRISPR gRNA sequence
cccctatgtggcagtattga

SEQ ID NO: 16545 - DNA, 20 bp, Artificial
  CRISPR gRNA sequence
ccctatgtggcagtattgag

SEQ ID NO: 16546 - DNA, 20 bp, Artificial
  CRISPR gRNA sequence
tatgtggcagtattgagagg

SEQ ID NO: 16547 - DNA, 20 bp, Artificial
  CRISPR gRNA sequence
atgtggcagtattgagaggt

SEQ ID NO: 16548 - DNA, 20 bp, Artificial
  CRISPR gRNA sequence
tgtggcagtattgagaggtg

SEQ ID NO: 16549 - DNA, 20 bp, Artificial
  CRISPR gRNA sequence
tattgagaggtggggccttt

SEQ ID NO: 16550 - DNA, 20 bp, Artificial
  CRISPR gRNA sequence
ttgagaggtggggcctttaa

SEQ ID NO: 16551 - DNA, 20 bp, Artificial
  CRISPR gRNA sequence
tgagaggtggggcctttaag

SEQ ID NO: 16552 - DNA, 20 bp, Artificial
  CRISPR gRNA sequence
tggggcctttaagaggtgac

SEQ ID NO: 16553 - DNA, 20 bp, Artificial
  CRISPR gRNA sequence
ggggcctttaagaggtgact

SEQ ID NO: 16554 - DNA, 20 bp, Artificial
  CRISPR gRNA sequence
gggcctttaagaggtgactg

SEQ ID NO: 16555 - DNA, 20 bp, Artificial
  CRISPR gRNA sequence
tggggcttttccttgatgaa

SEQ ID NO: 16556 - DNA, 20 bp, Artificial
  CRISPR gRNA sequence
ggggcttttccttgatgaat

SEQ ID NO: 16557 - DNA, 20 bp, Artificial
  CRISPR gRNA sequence
tgaatgggttaatccgttca

SEQ ID NO: 16558 - DNA, 20 bp, Artificial
  CRISPR gRNA sequence
gggttaatccgttcatggat

SEQ ID NO: 16559 - DNA, 20 bp, Artificial
  CRISPR gRNA sequence
ttaatccgttcatggattag

SEQ ID NO: 16560 - DNA, 20 bp, Artificial
  CRISPR gRNA sequence
ttcatggattagtggataaa

SEQ ID NO: 16561 - DNA, 20 bp, Artificial
  CRISPR gRNA sequence
tcatggattagtggataaac

SEQ ID NO: 16562 - DNA, 20 bp, Artificial
  CRISPR gRNA sequence
tagtggataaacaggttaat

SEQ ID NO: 16563 - DNA, 20 bp, Artificial
  CRISPR gRNA sequence
taaacaggttaataagttaa

SEQ ID NO: 16564 - DNA, 20 bp, Artificial
  CRISPR gRNA sequence
aaacaggttaataagttaat

SEQ ID NO: 16565 - DNA, 20 bp, Artificial
  CRISPR gRNA sequence
aataagttaatgggttgtcg

SEQ ID NO: 16566 - DNA, 20 bp, Artificial
  CRISPR gRNA sequence
ataagttaatgggttgtcgt

SEQ ID NO: 16567 - DNA, 20 bp, Artificial
  CRISPR gRNA sequence
aagttaatgggttgtcgtgg

SEQ ID NO: 16568 - DNA, 20 bp, Artificial
  CRISPR gRNA sequence
taatgggttgtcgtgggagt

SEQ ID NO: 16569 - DNA, 20 bp, Artificial
  CRISPR gRNA sequence
ggttgtcgtgggagtaagac

SEQ ID NO: 16570 - DNA, 20 bp, Artificial
  CRISPR gRNA sequence
tgtcgtgggagtaagactag

SEQ ID NO: 16571 - DNA, 20 bp, Artificial
  CRISPR gRNA sequence
agtaagactagtggttttat

SEQ ID NO: 16572 - DNA, 20 bp, Artificial
  CRISPR gRNA sequence
aagactagtggttttatgag

SEQ ID NO: 16573 - DNA, 20 bp, Artificial
  CRISPR gRNA sequence
gactagtggttttatgagaa

SEQ ID NO: 16574 - DNA, 20 bp, Artificial
  CRISPR gRNA sequence
actagtggttttatgagaag

SEQ ID NO: 16575 - DNA, 20 bp, Artificial
  CRISPR gRNA sequence
agtggttttatgagaagagg

SEQ ID NO: 16576 - DNA, 20 bp, Artificial
  CRISPR gRNA sequence
tggttttatgagaagaggaa

SEQ ID NO: 16577 - DNA, 20 bp, Artificial
  CRISPR gRNA sequence
gttttatgagaagaggaaga

SEQ ID NO: 16578 - DNA, 20 bp, Artificial
  CRISPR gRNA sequence
cgtgatgccccacactgcct

SEQ ID NO: 16579 - DNA, 20 bp, Artificial
  CRISPR gRNA sequence
gtgatgccccacactgcctt

SEQ ID NO: 16580 - DNA, 20 bp, Artificial
  CRISPR gRNA sequence
cacactgccttgggactctg

SEQ ID NO: 16581 - DNA, 20 bp, Artificial
  CRISPR gRNA sequence
cactgccttgggactctgca

SEQ ID NO: 16582 - DNA, 20 bp, Artificial
  CRISPR gRNA sequence
ctgccttgggactctgcaga

SEQ ID NO: 16583 - DNA, 20 bp, Artificial
  CRISPR gRNA sequence
actctgcagagagtcctcac

SEQ ID NO: 16584 - DNA, 20 bp, Artificial
  CRISPR gRNA sequence
tgcagagagtcctcaccagt

SEQ ID NO: 16585 - DNA, 20 bp, Artificial
  CRISPR gRNA sequence
agagagtcctcaccagtaag

SEQ ID NO: 16586 - DNA, 20 bp, Artificial
  CRISPR gRNA sequence
gagagtcctcaccagtaaga

SEQ ID NO: 16587 - DNA, 20 bp, Artificial
  CRISPR gRNA sequence
accagtaagaaggccctcac

SEQ ID NO: 16588 - DNA, 20 bp, Artificial
  CRISPR gRNA sequence
aagaaggccctcaccagatg

SEQ ID NO: 16589 - DNA, 20 bp, Artificial
  CRISPR gRNA sequence
ccagatgcagcccctaacct

SEQ ID NO: 16590 - DNA, 20 bp, Artificial
  CRISPR gRNA sequence
gcccctaaccttggacttct

SEQ ID NO: 16591 - DNA, 20 bp, Artificial
  CRISPR gRNA sequence
ttctcagcctccataactgt

SEQ ID NO: 16592 - DNA, 20 bp, Artificial
  CRISPR gRNA sequence
ttttttctttataaattact

SEQ ID NO: 16593 - DNA, 20 bp, Artificial
  CRISPR gRNA sequence
ctttataaattactcagtgt

SEQ ID NO: 16594 - DNA, 20 bp, Artificial
  CRISPR gRNA sequence
tttataaattactcagtgtc

SEQ ID NO: 16595 - DNA, 20 bp, Artificial
  CRISPR gRNA sequence
agtgtcaggtatgttgtttt

SEQ ID NO: 16596 - DNA, 20 bp, Artificial
  CRISPR gRNA sequence
ttgttttaagcaacaaaaaa

SEQ ID NO: 16597 - DNA, 20 bp, Artificial
  CRISPR gRNA sequence
cactgcctcacctatttgct

SEQ ID NO: 16598 - DNA, 20 bp, Artificial
  CRISPR gRNA sequence
gcctcacctatttgcttaga

SEQ ID NO: 16599 - DNA, 20 bp, Artificial
  CRISPR gRNA sequence
tagacagctttcgctgcctg

SEQ ID NO: 16600 - DNA, 20 bp, Artificial
  CRISPR gRNA sequence
gacagctttcgctgcctgtg

SEQ ID NO: 16601 - DNA, 20 bp, Artificial
  CRISPR gRNA sequence
ctgcctgtggagatgccact

SEQ ID NO: 16602 - DNA, 20 bp, Artificial
  CRISPR gRNA sequence
tgcctgtggagatgccacta

SEQ ID NO: 16603 - DNA, 20 bp, Artificial
  CRISPR gRNA sequence
gcctgtggagatgccactaa

SEQ ID NO: 16604 - DNA, 20 bp, Artificial
  CRISPR gRNA sequence
cctgtggagatgccactaag

SEQ ID NO: 16605 - DNA, 20 bp, Artificial
  CRISPR gRNA sequence
ctgtggagatgccactaagg

SEQ ID NO: 16606 - DNA, 20 bp, Artificial
  CRISPR gRNA sequence
tgtggagatgccactaaggg

SEQ ID NO: 16607 - DNA, 20 bp, Artificial
  CRISPR gRNA sequence
tggagatgccactaaggggg

SEQ ID NO: 16608 - DNA, 20 bp, Artificial
  CRISPR gRNA sequence
aaatccttaatgactgcctc

SEQ ID NO: 16609 - DNA, 20 bp, Artificial
  CRISPR gRNA sequence
taatgactgcctccagttgt

SEQ ID NO: 16610 - DNA, 20 bp, Artificial
  CRISPR gRNA sequence
aatgactgcctccagttgtg

SEQ ID NO: 16611 - DNA, 20 bp, Artificial
  CRISPR gRNA sequence
tgaggaaatgtgaatgtcct

SEQ ID NO: 16612 - DNA, 20 bp, Artificial
  CRISPR gRNA sequence
gcttcccccatgtaaatccc

SEQ ID NO: 16613 - DNA, 20 bp, Artificial
  CRISPR gRNA sequence
cttcccccatgtaaatcccc

SEQ ID NO: 16614 - DNA, 20 bp, Artificial
  CRISPR gRNA sequence
cccccatgtaaatccccagg

SEQ ID NO: 16615 - DNA, 20 bp, Artificial
  CRISPR gRNA sequence
ccccatgtaaatccccagga

SEQ ID NO: 16616 - DNA, 20 bp, Artificial
  CRISPR gRNA sequence
cccatgtaaatccccaggaa

SEQ ID NO: 16617 - DNA, 20 bp, Artificial
  CRISPR gRNA sequence
atgtaaatccccaggaaggg

SEQ ID NO: 16618 - DNA, 20 bp, Artificial
  CRISPR gRNA sequence
tgtaaatccccaggaaggga

SEQ ID NO: 16619 - DNA, 20 bp, Artificial
  CRISPR gRNA sequence
aaatccccaggaagggaagg

SEQ ID NO: 16620 - DNA, 20 bp, Artificial
  CRISPR gRNA sequence
tccccaggaagggaaggaag

SEQ ID NO: 16621 - DNA, 20 bp, Artificial
  CRISPR gRNA sequence
aggaagggaaggaagcagtc

SEQ ID NO: 16622 - DNA, 20 bp, Artificial
  CRISPR gRNA sequence
gaaggaagcagtcaagctct

SEQ ID NO: 16623 - DNA, 20 bp, Artificial
  CRISPR gRNA sequence
tctgaaacatgaacaattac

SEQ ID NO: 16624 - DNA, 20 bp, Artificial
  CRISPR gRNA sequence
gtcccctccattttcttcct

SEQ ID NO: 16625 - DNA, 20 bp, Artificial
  CRISPR gRNA sequence
attttcaatacactgtgctc

SEQ ID NO: 16626 - DNA, 20 bp, Artificial
  CRISPR gRNA sequence
ttttcaatacactgtgctct

SEQ ID NO: 16627 - DNA, 20 bp, Artificial
  CRISPR gRNA sequence
tttcaatacactgtgctctg

SEQ ID NO: 16628 - DNA, 20 bp, Artificial
  CRISPR gRNA sequence
actgtgctctggggaaaaat

SEQ ID NO: 16629 - DNA, 20 bp, Artificial
  CRISPR gRNA sequence
ggggaaaaattggccacatt

SEQ ID NO: 16630 - DNA, 20 bp, Artificial
  CRISPR gRNA sequence
aaattggccacatttggatc

SEQ ID NO: 16631 - DNA, 20 bp, Artificial
  CRISPR gRNA sequence
ggccacatttggatcaagca

SEQ ID NO: 16632 - DNA, 20 bp, Artificial
  CRISPR gRNA sequence
ctgctgaatgctgctgttcc

SEQ ID NO: 16633 - DNA, 20 bp, Artificial
  CRISPR gRNA sequence
tgctgaatgctgctgttcct

SEQ ID NO: 16634 - DNA, 20 bp, Artificial
  CRISPR gRNA sequence
gaatgctgctgttcctgggt

SEQ ID NO: 16635 - DNA, 20 bp, Artificial
  CRISPR gRNA sequence
tgctgctgttcctgggttgg

SEQ ID NO: 16636 - DNA, 20 bp, Artificial
  CRISPR gRNA sequence
gctgctgttcctgggttggc

SEQ ID NO: 16637 - DNA, 20 bp, Artificial
  CRISPR gRNA sequence
gctgttcctgggttggcagg

SEQ ID NO: 16638 - DNA, 20 bp, Artificial
  CRISPR gRNA sequence
gttcctgggttggcaggaag

SEQ ID NO: 16639 - DNA, 20 bp, Artificial
  CRISPR gRNA sequence
ttggcaggaagaagaccact

SEQ ID NO: 16640 - DNA, 20 bp, Artificial
  CRISPR gRNA sequence
gcaggaagaagaccactaag

SEQ ID NO: 16641 - DNA, 20 bp, Artificial
  CRISPR gRNA sequence
aggaagaagaccactaagaa

SEQ ID NO: 16642 - DNA, 20 bp, Artificial
  CRISPR gRNA sequence
gaccactaagaagagttttg

SEQ ID NO: 16643 - DNA, 20 bp, Artificial
  CRISPR gRNA sequence
accactaagaagagttttgc

SEQ ID NO: 16644 - DNA, 20 bp, Artificial
  CRISPR gRNA sequence
tgcaggttgttcactgcaca

SEQ ID NO: 16645 - DNA, 20 bp, Artificial
  CRISPR gRNA sequence
gcaggttgttcactgcacac

SEQ ID NO: 16646 - DNA, 20 bp, Artificial
  CRISPR gRNA sequence
ttcactgcacacaggtgccc

SEQ ID NO: 16647 - DNA, 20 bp, Artificial
  CRISPR gRNA sequence
acacaggtgcccaagccaac

SEQ ID NO: 16648 - DNA, 20 bp, Artificial
  CRISPR gRNA sequence
cacaggtgcccaagccaaca

SEQ ID NO: 16649 - DNA, 20 bp, Artificial
  CRISPR gRNA sequence
gcccaagccaacaaggaaaa

SEQ ID NO: 16650 - DNA, 20 bp, Artificial
  CRISPR gRNA sequence
cccaagccaacaaggaaaat

SEQ ID NO: 16651 - DNA, 20 bp, Artificial
  CRISPR gRNA sequence
ccaagccaacaaggaaaatg

SEQ ID NO: 16652 - DNA, 20 bp, Artificial
  CRISPR gRNA sequence
caagccaacaaggaaaatgg

SEQ ID NO: 16653 - DNA, 20 bp, Artificial
  CRISPR gRNA sequence
gccaacaaggaaaatggggg

SEQ ID NO: 16654 - DNA, 20 bp, Artificial
  CRISPR gRNA sequence
ccaacaaggaaaatgggggc

SEQ ID NO: 16655 - DNA, 20 bp, Artificial
  CRISPR gRNA sequence
ggaaaatgggggcaggactc

SEQ ID NO: 16656 - DNA, 20 bp, Artificial
  CRISPR gRNA sequence
gactccggcttgcactttgc

SEQ ID NO: 16657 - DNA, 20 bp, Artificial
  CRISPR gRNA sequence
cggcttgcactttgctagcc

SEQ ID NO: 16658 - DNA, 20 bp, Artificial
  CRISPR gRNA sequence
cttgcactttgctagccaag

SEQ ID NO: 16659 - DNA, 20 bp, Artificial
  CRISPR gRNA sequence
ctagccaagcagttacttcc

SEQ ID NO: 16660 - DNA, 20 bp, Artificial
  CRISPR gRNA sequence
gccaagcagttacttcctgg

SEQ ID NO: 16661 - DNA, 20 bp, Artificial
  CRISPR gRNA sequence
ccaagcagttacttcctggt

SEQ ID NO: 16662 - DNA, 20 bp, Artificial
  CRISPR gRNA sequence
caagcagttacttcctggta

SEQ ID NO: 16663 - DNA, 20 bp, Artificial
  CRISPR gRNA sequence
aagcagttacttcctggtag

SEQ ID NO: 16664 - DNA, 20 bp, Artificial
  CRISPR gRNA sequence
ctggtaggggctgcatcctc

SEQ ID NO: 16665 - DNA, 20 bp, Artificial
  CRISPR gRNA sequence
ggggctgcatcctccagaaa

SEQ ID NO: 16666 - DNA, 20 bp, Artificial
  CRISPR gRNA sequence
gggctgcatcctccagaaaa

SEQ ID NO: 16667 - DNA, 20 bp, Artificial
  CRISPR gRNA sequence
cacttttttctatttcaaca

SEQ ID NO: 16668 - DNA, 20 bp, Artificial
  CRISPR gRNA sequence
acttttttctatttcaacat

SEQ ID NO: 16669 - DNA, 20 bp, Artificial
  CRISPR gRNA sequence
tttcaacataggctctgtat

SEQ ID NO: 16670 - DNA, 20 bp, Artificial
  CRISPR gRNA sequence
ttcaacataggctctgtatg

SEQ ID NO: 16671 - DNA, 20 bp, Artificial
  CRISPR gRNA sequence
aacataggctctgtatgagg

SEQ ID NO: 16672 - DNA, 20 bp, Artificial
  CRISPR gRNA sequence
ataggctctgtatgaggtgg

SEQ ID NO: 16673 - DNA, 20 bp, Artificial
  CRISPR gRNA sequence
gtatgaggtggtggtgatgc

SEQ ID NO: 16674 - DNA, 20 bp, Artificial
  CRISPR gRNA sequence
gaggtggtggtgatgctggt

SEQ ID NO: 16675 - DNA, 20 bp, Artificial
  CRISPR gRNA sequence
gtggtggtgatgctggtgag

SEQ ID NO: 16676 - DNA, 20 bp, Artificial
  CRISPR gRNA sequence
ggtggtgatgctggtgagaa

SEQ ID NO: 16677 - DNA, 20 bp, Artificial
  CRISPR gRNA sequence
tcccccaaaaaacaaaccac

SEQ ID NO: 16678 - DNA, 20 bp, Artificial
  CRISPR gRNA sequence
cccaaaaaacaaaccactag

SEQ ID NO: 16679 - DNA, 20 bp, Artificial
  CRISPR gRNA sequence
caccaccaccacctctcccc

SEQ ID NO: 16680 - DNA, 20 bp, Artificial
  CRISPR gRNA sequence
ccaccaccacctctccccaa

SEQ ID NO: 16681 - DNA, 20 bp, Artificial
  CRISPR gRNA sequence
agagtcctgcccttgtctga

SEQ ID NO: 16682 - DNA, 20 bp, Artificial
  CRISPR gRNA sequence
ctgcccttgtctgaaagctg

SEQ ID NO: 16683 - DNA, 20 bp, Artificial
  CRISPR gRNA sequence
tgaaagctgtagctcttctt

SEQ ID NO: 16684 - DNA, 20 bp, Artificial
  CRISPR gRNA sequence
gaaagctgtagctcttctta

SEQ ID NO: 16685 - DNA, 20 bp, Artificial
  CRISPR gRNA sequence
ctcttcttaaggctacaaat

SEQ ID NO: 16686 - DNA, 20 bp, Artificial
  CRISPR gRNA sequence
acaaattagcttctctgctt

SEQ ID NO: 16687 - DNA, 20 bp, Artificial
  CRISPR gRNA sequence
tagcttctctgcttaagcct

SEQ ID NO: 16688 - DNA, 20 bp, Artificial
  CRISPR gRNA sequence
cttagcaaatcttccaaccc

SEQ ID NO: 16689 - DNA, 20 bp, Artificial
  CRISPR gRNA sequence
ccagacactttctttttttg

SEQ ID NO: 16690 - DNA, 20 bp, Artificial
  CRISPR gRNA sequence
tctttttttgtggttaaaaa

SEQ ID NO: 16691 - DNA, 20 bp, Artificial
  CRISPR gRNA sequence
tttttttgtggttaaaaatg

SEQ ID NO: 16692 - DNA, 20 bp, Artificial
  CRISPR gRNA sequence
aaaaatggagactttgaaac

SEQ ID NO: 16693 - DNA, 20 bp, Artificial
  CRISPR gRNA sequence
atggagactttgaaacgaga

SEQ ID NO: 16694 - DNA, 20 bp, Artificial
  CRISPR gRNA sequence
actttgaaacgagaaagacc

SEQ ID NO: 16695 - DNA, 20 bp, Artificial
  CRISPR gRNA sequence
ctttgaaacgagaaagacct

SEQ ID NO: 16696 - DNA, 20 bp, Artificial
  CRISPR gRNA sequence
gaaacgagaaagacctaggt

SEQ ID NO: 16697 - DNA, 20 bp, Artificial
  CRISPR gRNA sequence
aaagacctaggttagaattt

SEQ ID NO: 16698 - DNA, 20 bp, Artificial
  CRISPR gRNA sequence
tactatctctaatgcaaact

SEQ ID NO: 16699 - DNA, 20 bp, Artificial
  CRISPR gRNA sequence
actatctctaatgcaaactt

SEQ ID NO: 16700 - DNA, 20 bp, Artificial
  CRISPR gRNA sequence
atctctaatgcaaacttggg

SEQ ID NO: 16701 - DNA, 20 bp, Artificial
  CRISPR gRNA sequence
tctctaatgcaaacttgggt

SEQ ID NO: 16702 - DNA, 20 bp, Artificial
  CRISPR gRNA sequence
ctcaatttcctcatttgtaa

SEQ ID NO: 16703 - DNA, 20 bp, Artificial
  CRISPR gRNA sequence
atttcctcatttgtaaaaga

SEQ ID NO: 16704 - DNA, 20 bp, Artificial
  CRISPR gRNA sequence
tgtatttcctttgttgttgt

SEQ ID NO: 16705 - DNA, 20 bp, Artificial
  CRISPR gRNA sequence
gtatttcctttgttgttgta

SEQ ID NO: 16706 - DNA, 20 bp, Artificial
  CRISPR gRNA sequence
ctttgttgttgtaaggattc

SEQ ID NO: 16707 - DNA, 20 bp, Artificial
  CRISPR gRNA sequence
ggattccagatgataatgta

SEQ ID NO: 16708 - DNA, 20 bp, Artificial
  CRISPR gRNA sequence
tccagatgataatgtatgga

SEQ ID NO: 16709 - DNA, 20 bp, Artificial
  CRISPR gRNA sequence
gataatgtatggacagcaat

SEQ ID NO: 16710 - DNA, 20 bp, Artificial
  CRISPR gRNA sequence
gacagcaatgagcatactat

SEQ ID NO: 16711 - DNA, 20 bp, Artificial
  CRISPR gRNA sequence
atgagcatactatgagtatc

SEQ ID NO: 16712 - DNA, 20 bp, Artificial
  CRISPR gRNA sequence
tatgagtatccagtaaatgc

SEQ ID NO: 16713 - DNA, 20 bp, Artificial
  CRISPR gRNA sequence
atgctagttattacaaatac

SEQ ID NO: 16714 - DNA, 20 bp, Artificial
  CRISPR gRNA sequence
gctagttattacaaatacta

SEQ ID NO: 16715 - DNA, 20 bp, Artificial
  CRISPR gRNA sequence
agttattacaaatactagag

SEQ ID NO: 16716 - DNA, 20 bp, Artificial
  CRISPR gRNA sequence
ttacaaatactagagtagct

SEQ ID NO: 16717 - DNA, 20 bp, Artificial
  CRISPR gRNA sequence
aatactagagtagcttggct

SEQ ID NO: 16718 - DNA, 20 bp, Artificial
  CRISPR gRNA sequence
atactagagtagcttggcta

SEQ ID NO: 16719 - DNA, 20 bp, Artificial
  CRISPR gRNA sequence
actagagtagcttggctaag

SEQ ID NO: 16720 - DNA, 20 bp, Artificial
  CRISPR gRNA sequence
gagtagcttggctaaggagc

SEQ ID NO: 16721 - DNA, 20 bp, Artificial
  CRISPR gRNA sequence
agtagcttggctaaggagct

SEQ ID NO: 16722 - DNA, 20 bp, Artificial
  CRISPR gRNA sequence
tagcttggctaaggagctgg

SEQ ID NO: 16723 - DNA, 20 bp, Artificial
  CRISPR gRNA sequence
agcttggctaaggagctggg

SEQ ID NO: 16724 - DNA, 20 bp, Artificial
  CRISPR gRNA sequence
ggctaaggagctgggaggaa

SEQ ID NO: 16725 - DNA, 20 bp, Artificial
  CRISPR gRNA sequence
gctaaggagctgggaggaaa

SEQ ID NO: 16726 - DNA, 20 bp, Artificial
  CRISPR gRNA sequence
ctaaggagctgggaggaaaa

SEQ ID NO: 16727 - DNA, 20 bp, Artificial
  CRISPR gRNA sequence
ggagctgggaggaaaaggga

SEQ ID NO: 16728 - DNA, 20 bp, Artificial
  CRISPR gRNA sequence
gagctgggaggaaaagggaa

SEQ ID NO: 16729 - DNA, 20 bp, Artificial
  CRISPR gRNA sequence
agctgggaggaaaagggaaa

SEQ ID NO: 16730 - DNA, 20 bp, Artificial
  CRISPR gRNA sequence
gctgggaggaaaagggaaag

SEQ ID NO: 16731 - DNA, 20 bp, Artificial
  CRISPR gRNA sequence
ggaaaagggaaaggggtgta

SEQ ID NO: 16732 - DNA, 20 bp, Artificial
  CRISPR gRNA sequence
agggaaaggggtgtatggta

SEQ ID NO: 16733 - DNA, 20 bp, Artificial
  CRISPR gRNA sequence
gggaaaggggtgtatggtat

SEQ ID NO: 16734 - DNA, 20 bp, Artificial
  CRISPR gRNA sequence
ggtgtatggtatgggctttg

SEQ ID NO: 16735 - DNA, 20 bp, Artificial
  CRISPR gRNA sequence
tatggtatgggctttgtaga

SEQ ID NO: 16736 - DNA, 20 bp, Artificial
  CRISPR gRNA sequence
atggtatgggctttgtagaa

SEQ ID NO: 16737 - DNA, 20 bp, Artificial
  CRISPR gRNA sequence
tatgggctttgtagaaagga

SEQ ID NO: 16738 - DNA, 20 bp, Artificial
  CRISPR gRNA sequence
ggctttgtagaaaggatgga

SEQ ID NO: 16739 - DNA, 20 bp, Artificial
  CRISPR gRNA sequence
tttgtagaaaggatggacag

SEQ ID NO: 16740 - DNA, 20 bp, Artificial
  CRISPR gRNA sequence
tgtagaaaggatggacagaa

SEQ ID NO: 16741 - DNA, 20 bp, Artificial
  CRISPR gRNA sequence
gaaaggatggacagaagagc

SEQ ID NO: 16742 - DNA, 20 bp, Artificial
  CRISPR gRNA sequence
aggatggacagaagagcaag

SEQ ID NO: 16743 - DNA, 20 bp, Artificial
  CRISPR gRNA sequence
atggacagaagagcaagaag

SEQ ID NO: 16744 - DNA, 20 bp, Artificial
  CRISPR gRNA sequence
gcaagaagcagaaatgcgta

SEQ ID NO: 16745 - DNA, 20 bp, Artificial
  CRISPR gRNA sequence
agcagaaatgcgtatagaaa

SEQ ID NO: 16746 - DNA, 20 bp, Artificial
  CRISPR gRNA sequence
cagaaatgcgtatagaaatg

SEQ ID NO: 16747 - DNA, 20 bp, Artificial
  CRISPR gRNA sequence
agaaatgcgtatagaaatgg

SEQ ID NO: 16748 - DNA, 20 bp, Artificial
  CRISPR gRNA sequence
aatgcgtatagaaatggagg

SEQ ID NO: 16749 - DNA, 20 bp, Artificial
  CRISPR gRNA sequence
tgcgtatagaaatggaggtg

SEQ ID NO: 16750 - DNA, 20 bp, Artificial
  CRISPR gRNA sequence
gcgtatagaaatggaggtgg

SEQ ID NO: 16751 - DNA, 20 bp, Artificial
  CRISPR gRNA sequence
gaggtggaggatgtaaacat

SEQ ID NO: 16752 - DNA, 20 bp, Artificial
  CRISPR gRNA sequence
aacatgagattttgttttct

SEQ ID NO: 16753 - DNA, 20 bp, Artificial
  CRISPR gRNA sequence
atgagattttgttttcttgg

SEQ ID NO: 16754 - DNA, 20 bp, Artificial
  CRISPR gRNA sequence
tttgttttcttggtggtcat

SEQ ID NO: 16755 - DNA, 20 bp, Artificial
  CRISPR gRNA sequence
tttcttggtggtcattagtg

SEQ ID NO: 16756 - DNA, 20 bp, Artificial
  CRISPR gRNA sequence
ttcttggtggtcattagtga

SEQ ID NO: 16757 - DNA, 20 bp, Artificial
  CRISPR gRNA sequence
tcttggtggtcattagtgaa

SEQ ID NO: 16758 - DNA, 20 bp, Artificial
  CRISPR gRNA sequence
cttggtggtcattagtgaag

SEQ ID NO: 16759 - DNA, 20 bp, Artificial
  CRISPR gRNA sequence
aaggggcctatttcccccac

SEQ ID NO: 16760 - DNA, 20 bp, Artificial
  CRISPR gRNA sequence
tccatctcccctctcttccc

SEQ ID NO: 16761 - DNA, 20 bp, Artificial
  CRISPR gRNA sequence
catctcccctctcttccctg

SEQ ID NO: 16762 - DNA, 20 bp, Artificial
  CRISPR gRNA sequence
ccctggagtctccgttcctc

SEQ ID NO: 16763 - DNA, 20 bp, Artificial
  CRISPR gRNA sequence
cccccttgcaatgatttctg

SEQ ID NO: 16764 - DNA, 20 bp, Artificial
  CRISPR gRNA sequence
ccccttgcaatgatttctgt

SEQ ID NO: 16765 - DNA, 20 bp, Artificial
  CRISPR gRNA sequence
ccttgcaatgatttctgtgg

SEQ ID NO: 16766 - DNA, 20 bp, Artificial
  CRISPR gRNA sequence
cttgcaatgatttctgtggg

SEQ ID NO: 16767 - DNA, 20 bp, Artificial
  CRISPR gRNA sequence
ttgcaatgatttctgtggga

SEQ ID NO: 16768 - DNA, 20 bp, Artificial
  CRISPR gRNA sequence
tgcaatgatttctgtgggag

SEQ ID NO: 16769 - DNA, 20 bp, Artificial
  CRISPR gRNA sequence
tctgtgggaggggactgacg

SEQ ID NO: 16770 - DNA, 20 bp, Artificial
  CRISPR gRNA sequence
ctgacgtggctcatgatgaa

SEQ ID NO: 16771 - DNA, 20 bp, Artificial
  CRISPR gRNA sequence
tgacgtggctcatgatgaat

SEQ ID NO: 16772 - DNA, 20 bp, Artificial
  CRISPR gRNA sequence
gatgaatgggtgatattgac

SEQ ID NO: 16773 - DNA, 20 bp, Artificial
  CRISPR gRNA sequence
gaatgggtgatattgacaag

SEQ ID NO: 16774 - DNA, 20 bp, Artificial
  CRISPR gRNA sequence
tgggtgatattgacaagtgg

SEQ ID NO: 16775 - DNA, 20 bp, Artificial
  CRISPR gRNA sequence
gatattgacaagtggcagca

SEQ ID NO: 16776 - DNA, 20 bp, Artificial
  CRISPR gRNA sequence
tgcccttgattgtccttttc

SEQ ID NO: 16777 - DNA, 20 bp, Artificial
  CRISPR gRNA sequence
gcccttgattgtccttttct

SEQ ID NO: 16778 - DNA, 20 bp, Artificial
  CRISPR gRNA sequence
tgattgtccttttctgggct

SEQ ID NO: 16779 - DNA, 20 bp, Artificial
  CRISPR gRNA sequence
gattgtccttttctgggctc

SEQ ID NO: 16780 - DNA, 20 bp, Artificial
  CRISPR gRNA sequence
aggtgcttcctcaccgatat

SEQ ID NO: 16781 - DNA, 20 bp, Artificial
  CRISPR gRNA sequence
ttcctcaccgatattggcat

SEQ ID NO: 16782 - DNA, 20 bp, Artificial
  CRISPR gRNA sequence
gatattggcataagcctccc

SEQ ID NO: 16783 - DNA, 20 bp, Artificial
  CRISPR gRNA sequence
tcaccttccatgtcacacaa

SEQ ID NO: 16784 - DNA, 20 bp, Artificial
  CRISPR gRNA sequence
cacacaacagcctgctgaac

SEQ ID NO: 16785 - DNA, 20 bp, Artificial
  CRISPR gRNA sequence
acagcctgctgaactggtcg

SEQ ID NO: 16786 - DNA, 20 bp, Artificial
  CRISPR gRNA sequence
gctgaactggtcgcagttga

SEQ ID NO: 16787 - DNA, 20 bp, Artificial
  CRISPR gRNA sequence
gcagttgatggtgtctgtgt

SEQ ID NO: 16788 - DNA, 20 bp, Artificial
  CRISPR gRNA sequence
cagttgatggtgtctgtgtc

SEQ ID NO: 16789 - DNA, 20 bp, Artificial
  CRISPR gRNA sequence
atggtgtctgtgtcgggttc

SEQ ID NO: 16790 - DNA, 20 bp, Artificial
  CRISPR gRNA sequence
tggtgtctgtgtcgggttct

SEQ ID NO: 16791 - DNA, 20 bp, Artificial
  CRISPR gRNA sequence
gtgtctgtgtcgggttctgg

SEQ ID NO: 16792 - DNA, 20 bp, Artificial
  CRISPR gRNA sequence
tgtctgtgtcgggttctggg

SEQ ID NO: 16793 - DNA, 20 bp, Artificial
  CRISPR gRNA sequence
gtgtcgggttctgggaggaa

SEQ ID NO: 16794 - DNA, 20 bp, Artificial
  CRISPR gRNA sequence
ttctgggaggaaaagtccct

SEQ ID NO: 16795 - DNA, 20 bp, Artificial
  CRISPR gRNA sequence
gaggaaaagtcccttggatg

SEQ ID NO: 16796 - DNA, 20 bp, Artificial
  CRISPR gRNA sequence
gaaaagtcccttggatgaag

SEQ ID NO: 16797 - DNA, 20 bp, Artificial
  CRISPR gRNA sequence
aaaagtcccttggatgaaga

SEQ ID NO: 16798 - DNA, 20 bp, Artificial
  CRISPR gRNA sequence
tggatgaagaaggaaatttc

SEQ ID NO: 16799 - DNA, 20 bp, Artificial
  CRISPR gRNA sequence
tgaagaaggaaatttctgga

SEQ ID NO: 16800 - DNA, 20 bp, Artificial
  CRISPR gRNA sequence
aagaaggaaatttctggaaa

SEQ ID NO: 16801 - DNA, 20 bp, Artificial
  CRISPR gRNA sequence
agaaggaaatttctggaaag

SEQ ID NO: 16802 - DNA, 20 bp, Artificial
  CRISPR gRNA sequence
gaaggaaatttctggaaaga

SEQ ID NO: 16803 - DNA, 20 bp, Artificial
  CRISPR gRNA sequence
gaaatttctggaaagagggc

SEQ ID NO: 16804 - DNA, 20 bp, Artificial
  CRISPR gRNA sequence
atttctggaaagagggctgg

SEQ ID NO: 16805 - DNA, 20 bp, Artificial
  CRISPR gRNA sequence
tttctggaaagagggctggt

SEQ ID NO: 16806 - DNA, 20 bp, Artificial
  CRISPR gRNA sequence
ttctggaaagagggctggtg

SEQ ID NO: 16807 - DNA, 20 bp, Artificial
  CRISPR gRNA sequence
aaagagggctggtggggaac

SEQ ID NO: 16808 - DNA, 20 bp, Artificial
  CRISPR gRNA sequence
aagagggctggtggggaacg

SEQ ID NO: 16809 - DNA, 20 bp, Artificial
  CRISPR gRNA sequence
agagggctggtggggaacga

SEQ ID NO: 16810 - DNA, 20 bp, Artificial
  CRISPR gRNA sequence
agggctggtggggaacgagg

SEQ ID NO: 16811 - DNA, 20 bp, Artificial
  CRISPR gRNA sequence
ggctggtggggaacgaggga

SEQ ID NO: 16812 - DNA, 20 bp, Artificial
  CRISPR gRNA sequence
gctggtggggaacgagggag

SEQ ID NO: 16813 - DNA, 20 bp, Artificial
  CRISPR gRNA sequence
ggtggggaacgagggagagg

SEQ ID NO: 16814 - DNA, 20 bp, Artificial
  CRISPR gRNA sequence
gtggggaacgagggagaggc

SEQ ID NO: 16815 - DNA, 20 bp, Artificial
  CRISPR gRNA sequence
tggggaacgagggagaggcg

SEQ ID NO: 16816 - DNA, 20 bp, Artificial
  CRISPR gRNA sequence
ggaacgagggagaggcgggg

SEQ ID NO: 16817 - DNA, 20 bp, Artificial
  CRISPR gRNA sequence
gaacgagggagaggcggggc

SEQ ID NO: 16818 - DNA, 20 bp, Artificial
  CRISPR gRNA sequence
aacgagggagaggcggggca

SEQ ID NO: 16819 - DNA, 20 bp, Artificial
  CRISPR gRNA sequence
agggagaggcggggcagggc

SEQ ID NO: 16820 - DNA, 20 bp, Artificial
  CRISPR gRNA sequence
gggagaggcggggcagggct

SEQ ID NO: 16821 - DNA, 20 bp, Artificial
  CRISPR gRNA sequence
gagaggcggggcagggctgg

SEQ ID NO: 16822 - DNA, 20 bp, Artificial
  CRISPR gRNA sequence
tgggagatcatccccatctg

SEQ ID NO: 16823 - DNA, 20 bp, Artificial
  CRISPR gRNA sequence
ggagatcatccccatctgca

SEQ ID NO: 16824 - DNA, 20 bp, Artificial
  CRISPR gRNA sequence
agatcatccccatctgcaga

SEQ ID NO: 16825 - DNA, 20 bp, Artificial
  CRISPR gRNA sequence
catctgcagagagcgtccca

SEQ ID NO: 16826 - DNA, 20 bp, Artificial
  CRISPR gRNA sequence
cagagagcgtcccacagacg

SEQ ID NO: 16827 - DNA, 20 bp, Artificial
  CRISPR gRNA sequence
agagagcgtcccacagacgt

SEQ ID NO: 16828 - DNA, 20 bp, Artificial
  CRISPR gRNA sequence
agagcgtcccacagacgtgg

SEQ ID NO: 16829 - DNA, 20 bp, Artificial
  CRISPR gRNA sequence
acagacgtgggagctgtccg

SEQ ID NO: 16830 - DNA, 20 bp, Artificial
  CRISPR gRNA sequence
ggagctgtccgtggtgctga

SEQ ID NO: 16831 - DNA, 20 bp, Artificial
  CRISPR gRNA sequence
gagctgtccgtggtgctgac

SEQ ID NO: 16832 - DNA, 20 bp, Artificial
  CRISPR gRNA sequence
gctgtccgtggtgctgacgg

SEQ ID NO: 16833 - DNA, 20 bp, Artificial
  CRISPR gRNA sequence
ctgtccgtggtgctgacggg

SEQ ID NO: 16834 - DNA, 20 bp, Artificial
  CRISPR gRNA sequence
tgtccgtggtgctgacggga

SEQ ID NO: 16835 - DNA, 20 bp, Artificial
  CRISPR gRNA sequence
ccgtggtgctgacgggaggg

SEQ ID NO: 16836 - DNA, 20 bp, Artificial
  CRISPR gRNA sequence
cgtggtgctgacgggagggc

SEQ ID NO: 16837 - DNA, 20 bp, Artificial
  CRISPR gRNA sequence
gtggtgctgacgggagggca

SEQ ID NO: 16838 - DNA, 20 bp, Artificial
  CRISPR gRNA sequence
gctgacgggagggcagggac

SEQ ID NO: 16839 - DNA, 20 bp, Artificial
  CRISPR gRNA sequence
tcccctgattgccgtctcta

SEQ ID NO: 16840 - DNA, 20 bp, Artificial
  CRISPR gRNA sequence
ctgattgccgtctctacagc

SEQ ID NO: 16841 - DNA, 20 bp, Artificial
  CRISPR gRNA sequence
tgccgtctctacagcaagct

SEQ ID NO: 16842 - DNA, 20 bp, Artificial
  CRISPR gRNA sequence
gccgtctctacagcaagctg

SEQ ID NO: 16843 - DNA, 20 bp, Artificial
  CRISPR gRNA sequence
ccgtctctacagcaagctga

SEQ ID NO: 16844 - DNA, 20 bp, Artificial
  CRISPR gRNA sequence
cgtctctacagcaagctgag

SEQ ID NO: 16845 - DNA, 20 bp, Artificial
  CRISPR gRNA sequence
ctctacagcaagctgagggg

SEQ ID NO: 16846 - DNA, 20 bp, Artificial
  CRISPR gRNA sequence
tctacagcaagctgaggggt

SEQ ID NO: 16847 - DNA, 20 bp, Artificial
  CRISPR gRNA sequence
ctacagcaagctgaggggtg

SEQ ID NO: 16848 - DNA, 20 bp, Artificial
  CRISPR gRNA sequence
tacagcaagctgaggggtgg

SEQ ID NO: 16849 - DNA, 20 bp, Artificial
  CRISPR gRNA sequence
agctgaggggtgggggatac

SEQ ID NO: 16850 - DNA, 20 bp, Artificial
  CRISPR gRNA sequence
tgaggggtgggggataccgg

SEQ ID NO: 16851 - DNA, 20 bp, Artificial
  CRISPR gRNA sequence
aggggtgggggataccggaa

SEQ ID NO: 16852 - DNA, 20 bp, Artificial
  CRISPR gRNA sequence
tgggggataccggaagagac

SEQ ID NO: 16853 - DNA, 20 bp, Artificial
  CRISPR gRNA sequence
ggggataccggaagagacca

SEQ ID NO: 16854 - DNA, 20 bp, Artificial
  CRISPR gRNA sequence
gggataccggaagagaccag

SEQ ID NO: 16855 - DNA, 20 bp, Artificial
  CRISPR gRNA sequence
ggataccggaagagaccaga

SEQ ID NO: 16856 - DNA, 20 bp, Artificial
  CRISPR gRNA sequence
ataccggaagagaccagagg

SEQ ID NO: 16857 - DNA, 20 bp, Artificial
  CRISPR gRNA sequence
taccggaagagaccagaggg

SEQ ID NO: 16858 - DNA, 20 bp, Artificial
  CRISPR gRNA sequence
ccggaagagaccagagggag

SEQ ID NO: 16859 - DNA, 20 bp, Artificial
  CRISPR gRNA sequence
cggaagagaccagagggagg

SEQ ID NO: 16860 - DNA, 20 bp, Artificial
  CRISPR gRNA sequence
ggaagagaccagagggagga

SEQ ID NO: 16861 - DNA, 20 bp, Artificial
  CRISPR gRNA sequence
agagggaggagggcccacct

SEQ ID NO: 16862 - DNA, 20 bp, Artificial
  CRISPR gRNA sequence
gggaggagggcccacctgag

SEQ ID NO: 16863 - DNA, 20 bp, Artificial
  CRISPR gRNA sequence
gaggagggcccacctgagta

SEQ ID NO: 16864 - DNA, 20 bp, Artificial
  CRISPR gRNA sequence
gagctcaatctcttcttctc

SEQ ID NO: 16865 - DNA, 20 bp, Artificial
  CRISPR gRNA sequence
tcaatctcttcttctccagc

SEQ ID NO: 16866 - DNA, 20 bp, Artificial
  CRISPR gRNA sequence
caatctcttcttctccagcc

SEQ ID NO: 16867 - DNA, 20 bp, Artificial
  CRISPR gRNA sequence
cttctccagccaggtccatc

SEQ ID NO: 16868 - DNA, 20 bp, Artificial
  CRISPR gRNA sequence
cagccaggtccatctggtca

SEQ ID NO: 16869 - DNA, 20 bp, Artificial
  CRISPR gRNA sequence
ccaggtccatctggtcatag

SEQ ID NO: 16870 - DNA, 20 bp, Artificial
  CRISPR gRNA sequence
ggtccatctggtcatagaag

SEQ ID NO: 16871 - DNA, 20 bp, Artificial
  CRISPR gRNA sequence
ccatctggtcatagaagtgg

SEQ ID NO: 16872 - DNA, 20 bp, Artificial
  CRISPR gRNA sequence
atctggtcatagaagtggta

SEQ ID NO: 16873 - DNA, 20 bp, Artificial
  CRISPR gRNA sequence
tctggtcatagaagtggtag

SEQ ID NO: 16874 - DNA, 20 bp, Artificial
  CRISPR gRNA sequence
tcatagaagtggtagaggca

SEQ ID NO: 16875 - DNA, 20 bp, Artificial
  CRISPR gRNA sequence
catagaagtggtagaggcac

SEQ ID NO: 16876 - DNA, 20 bp, Artificial
  CRISPR gRNA sequence
atagaagtggtagaggcaca

SEQ ID NO: 16877 - DNA, 20 bp, Artificial
  CRISPR gRNA sequence
tagaagtggtagaggcacag

SEQ ID NO: 16878 - DNA, 20 bp, Artificial
  CRISPR gRNA sequence
agaagtggtagaggcacagg

SEQ ID NO: 16879 - DNA, 20 bp, Artificial
  CRISPR gRNA sequence
gtggtagaggcacagggggt

SEQ ID NO: 16880 - DNA, 20 bp, Artificial
  CRISPR gRNA sequence
agggggtcagcatcgctgtt

SEQ ID NO: 16881 - DNA, 20 bp, Artificial
  CRISPR gRNA sequence
gggtcagcatcgctgttaag

SEQ ID NO: 16882 - DNA, 20 bp, Artificial
  CRISPR gRNA sequence
gcatcgctgttaagaagctc

SEQ ID NO: 16883 - DNA, 20 bp, Artificial
  CRISPR gRNA sequence
catcgctgttaagaagctcc

SEQ ID NO: 16884 - DNA, 20 bp, Artificial
  CRISPR gRNA sequence
cgctgttaagaagctccagg

SEQ ID NO: 16885 - DNA, 20 bp, Artificial
  CRISPR gRNA sequence
agctccaggtagccaccttc

SEQ ID NO: 16886 - DNA, 20 bp, Artificial
  CRISPR gRNA sequence
gctccaggtagccaccttct

SEQ ID NO: 16887 - DNA, 20 bp, Artificial
  CRISPR gRNA sequence
ctccaggtagccaccttcta

SEQ ID NO: 16888 - DNA, 20 bp, Artificial
  CRISPR gRNA sequence
tccaggtagccaccttctag

SEQ ID NO: 16889 - DNA, 20 bp, Artificial
  CRISPR gRNA sequence
ttctaggggccccaactcca

SEQ ID NO: 16890 - DNA, 20 bp, Artificial
  CRISPR gRNA sequence
taggggccccaactccatgg

SEQ ID NO: 16891 - DNA, 20 bp, Artificial
  CRISPR gRNA sequence
actccatggtggcacactgt

SEQ ID NO: 16892 - DNA, 20 bp, Artificial
  CRISPR gRNA sequence
gtggcacactgtgagctgcc

SEQ ID NO: 16893 - DNA, 20 bp, Artificial
  CRISPR gRNA sequence
tggcacactgtgagctgcct

SEQ ID NO: 16894 - DNA, 20 bp, Artificial
  CRISPR gRNA sequence
gcacactgtgagctgcctgg

SEQ ID NO: 16895 - DNA, 20 bp, Artificial
  CRISPR gRNA sequence
cacactgtgagctgcctggg

SEQ ID NO: 16896 - DNA, 20 bp, Artificial
  CRISPR gRNA sequence
acactgtgagctgcctggga

SEQ ID NO: 16897 - DNA, 20 bp, Artificial
  CRISPR gRNA sequence
ctgtgagctgcctgggaggg

SEQ ID NO: 16898 - DNA, 20 bp, Artificial
  CRISPR gRNA sequence
ctgggagggaagacaatgct

SEQ ID NO: 16899 - DNA, 20 bp, Artificial
  CRISPR gRNA sequence
gacaatgctcagtcacctca

SEQ ID NO: 16900 - DNA, 20 bp, Artificial
  CRISPR gRNA sequence
acaatgctcagtcacctcac

SEQ ID NO: 16901 - DNA, 20 bp, Artificial
  CRISPR gRNA sequence
caatgctcagtcacctcaca

SEQ ID NO: 16902 - DNA, 20 bp, Artificial
  CRISPR gRNA sequence
tcagtcacctcacagggtgt

SEQ ID NO: 16903 - DNA, 20 bp, Artificial
  CRISPR gRNA sequence
tcacctcacagggtgttgga

SEQ ID NO: 16904 - DNA, 20 bp, Artificial
  CRISPR gRNA sequence
acctcacagggtgttggaaa

SEQ ID NO: 16905 - DNA, 20 bp, Artificial
  CRISPR gRNA sequence
cctcacagggtgttggaaag

SEQ ID NO: 16906 - DNA, 20 bp, Artificial
  CRISPR gRNA sequence
cacagggtgttggaaagagg

SEQ ID NO: 16907 - DNA, 20 bp, Artificial
  CRISPR gRNA sequence
ttgacacctacaacaactcc

SEQ ID NO: 16908 - DNA, 20 bp, Artificial
  CRISPR gRNA sequence
cacctacaacaactcccagc

SEQ ID NO: 16909 - DNA, 20 bp, Artificial
  CRISPR gRNA sequence
tacaacaactcccagctggt

SEQ ID NO: 16910 - DNA, 20 bp, Artificial
  CRISPR gRNA sequence
acaacaactcccagctggtg

SEQ ID NO: 16911 - DNA, 20 bp, Artificial
  CRISPR gRNA sequence
caacaactcccagctggtga

SEQ ID NO: 16912 - DNA, 20 bp, Artificial
  CRISPR gRNA sequence
aactcccagctggtgagggc

SEQ ID NO: 16913 - DNA, 20 bp, Artificial
  CRISPR gRNA sequence
actcccagctggtgagggct

SEQ ID NO: 16914 - DNA, 20 bp, Artificial
  CRISPR gRNA sequence
ctcccagctggtgagggctg

SEQ ID NO: 16915 - DNA, 20 bp, Artificial
  CRISPR gRNA sequence
agctggtgagggctggggat

SEQ ID NO: 16916 - DNA, 20 bp, Artificial
  CRISPR gRNA sequence
ctggtgagggctggggatga

SEQ ID NO: 16917 - DNA, 20 bp, Artificial
  CRISPR gRNA sequence
tggtgagggctggggatgag

SEQ ID NO: 16918 - DNA, 20 bp, Artificial
  CRISPR gRNA sequence
gtgagggctggggatgagag

SEQ ID NO: 16919 - DNA, 20 bp, Artificial
  CRISPR gRNA sequence
gggatgagaggagtgaataa

SEQ ID NO: 16920 - DNA, 20 bp, Artificial
  CRISPR gRNA sequence
agtgaataaaagcgctcatt

SEQ ID NO: 16921 - DNA, 20 bp, Artificial
  CRISPR gRNA sequence
ttcagcacctcttatatgct

SEQ ID NO: 16922 - DNA, 20 bp, Artificial
  CRISPR gRNA sequence
cacctcttatatgctcagcg

SEQ ID NO: 16923 - DNA, 20 bp, Artificial
  CRISPR gRNA sequence
ctcttatatgctcagcgtgg

SEQ ID NO: 16924 - DNA, 20 bp, Artificial
  CRISPR gRNA sequence
cttatatgctcagcgtggtg

SEQ ID NO: 16925 - DNA, 20 bp, Artificial
  CRISPR gRNA sequence
tatatgctcagcgtggtgga

SEQ ID NO: 16926 - DNA, 20 bp, Artificial
  CRISPR gRNA sequence
tatgctcagcgtggtggaga

SEQ ID NO: 16927 - DNA, 20 bp, Artificial
  CRISPR gRNA sequence
ctcagcgtggtggagagagc

SEQ ID NO: 16928 - DNA, 20 bp, Artificial
  CRISPR gRNA sequence
aagccacattcccttcctcc

SEQ ID NO: 16929 - DNA, 20 bp, Artificial
  CRISPR gRNA sequence
agccacattcccttcctcca

SEQ ID NO: 16930 - DNA, 20 bp, Artificial
  CRISPR gRNA sequence
caaggaacttacaaccatat

SEQ ID NO: 16931 - DNA, 20 bp, Artificial
  CRISPR gRNA sequence
ggaacttacaaccatatgag

SEQ ID NO: 16932 - DNA, 20 bp, Artificial
  CRISPR gRNA sequence
caaccatatgagaagatacc

SEQ ID NO: 16933 - DNA, 20 bp, Artificial
  CRISPR gRNA sequence
aaccatatgagaagataccc

SEQ ID NO: 16934 - DNA, 20 bp, Artificial
  CRISPR gRNA sequence
ccatatgagaagatacccag

SEQ ID NO: 16935 - DNA, 20 bp, Artificial
  CRISPR gRNA sequence
catatgagaagatacccagg

SEQ ID NO: 16936 - DNA, 20 bp, Artificial
  CRISPR gRNA sequence
atgagaagatacccaggagg

SEQ ID NO: 16937 - DNA, 20 bp, Artificial
  CRISPR gRNA sequence
aagatacccaggaggtagaa

SEQ ID NO: 16938 - DNA, 20 bp, Artificial
  CRISPR gRNA sequence
agatacccaggaggtagaaa

SEQ ID NO: 16939 - DNA, 20 bp, Artificial
  CRISPR gRNA sequence
gatacccaggaggtagaaaa

SEQ ID NO: 16940 - DNA, 20 bp, Artificial
  CRISPR gRNA sequence
caggaggtagaaaagggaac

SEQ ID NO: 16941 - DNA, 20 bp, Artificial
  CRISPR gRNA sequence
aggtagaaaagggaactgga

SEQ ID NO: 16942 - DNA, 20 bp, Artificial
  CRISPR gRNA sequence
gaaaagggaactggaaagtg

SEQ ID NO: 16943 - DNA, 20 bp, Artificial
  CRISPR gRNA sequence
ggattccatcaatctcacac

SEQ ID NO: 16944 - DNA, 20 bp, Artificial
  CRISPR gRNA sequence
attccatcaatctcacacca

SEQ ID NO: 16945 - DNA, 20 bp, Artificial
  CRISPR gRNA sequence
tccatcaatctcacaccaga

SEQ ID NO: 16946 - DNA, 20 bp, Artificial
  CRISPR gRNA sequence
tcaatctcacaccagagagt

SEQ ID NO: 16947 - DNA, 20 bp, Artificial
  CRISPR gRNA sequence
caatctcacaccagagagtc

SEQ ID NO: 16948 - DNA, 20 bp, Artificial
  CRISPR gRNA sequence
atctcacaccagagagtcag

SEQ ID NO: 16949 - DNA, 20 bp, Artificial
  CRISPR gRNA sequence
caggagacccgtcccacatt

SEQ ID NO: 16950 - DNA, 20 bp, Artificial
  CRISPR gRNA sequence
cccacatttggcaatgccat

SEQ ID NO: 16951 - DNA, 20 bp, Artificial
  CRISPR gRNA sequence
acatttggcaatgccatgag

SEQ ID NO: 16952 - DNA, 20 bp, Artificial
  CRISPR gRNA sequence
ggcaatgccatgagtggtaa

SEQ ID NO: 16953 - DNA, 20 bp, Artificial
  CRISPR gRNA sequence
tgccatgagtggtaacagct

SEQ ID NO: 16954 - DNA, 20 bp, Artificial
  CRISPR gRNA sequence
gccatgagtggtaacagcta

SEQ ID NO: 16955 - DNA, 20 bp, Artificial
  CRISPR gRNA sequence
ggtaacagctaaggtttata

SEQ ID NO: 16956 - DNA, 20 bp, Artificial
  CRISPR gRNA sequence
ataaagcacctcctatacgc

SEQ ID NO: 16957 - DNA, 20 bp, Artificial
  CRISPR gRNA sequence
taaagcacctcctatacgcc

SEQ ID NO: 16958 - DNA, 20 bp, Artificial
  CRISPR gRNA sequence
ctcctatacgccaggcacat

SEQ ID NO: 16959 - DNA, 20 bp, Artificial
  CRISPR gRNA sequence
tatacgccaggcacatgagc

SEQ ID NO: 16960 - DNA, 20 bp, Artificial
  CRISPR gRNA sequence
ggcacatttaatactcatat

SEQ ID NO: 16961 - DNA, 20 bp, Artificial
  CRISPR gRNA sequence
actcatatcagtaaccatgt

SEQ ID NO: 16962 - DNA, 20 bp, Artificial
  CRISPR gRNA sequence
ctcatatcagtaaccatgta

SEQ ID NO: 16963 - DNA, 20 bp, Artificial
  CRISPR gRNA sequence
atatcagtaaccatgtaagg

SEQ ID NO: 16964 - DNA, 20 bp, Artificial
  CRISPR gRNA sequence
tatcagtaaccatgtaagga

SEQ ID NO: 16965 - DNA, 20 bp, Artificial
  CRISPR gRNA sequence
attatcctcactttgcatat

SEQ ID NO: 16966 - DNA, 20 bp, Artificial
  CRISPR gRNA sequence
actttgcatatgagaaaact

SEQ ID NO: 16967 - DNA, 20 bp, Artificial
  CRISPR gRNA sequence
ctttgcatatgagaaaactg

SEQ ID NO: 16968 - DNA, 20 bp, Artificial
  CRISPR gRNA sequence
catatgagaaaactgaggct

SEQ ID NO: 16969 - DNA, 20 bp, Artificial
  CRISPR gRNA sequence
tatgagaaaactgaggctca

SEQ ID NO: 16970 - DNA, 20 bp, Artificial
  CRISPR gRNA sequence
tgagaaaactgaggctcaga

SEQ ID NO: 16971 - DNA, 20 bp, Artificial
  CRISPR gRNA sequence
gagaaaactgaggctcagag

SEQ ID NO: 16972 - DNA, 20 bp, Artificial
  CRISPR gRNA sequence
aactgaggctcagagaggtg

SEQ ID NO: 16973 - DNA, 20 bp, Artificial
  CRISPR gRNA sequence
agaggtgaagtgatttatgt

SEQ ID NO: 16974 - DNA, 20 bp, Artificial
  CRISPR gRNA sequence
gaggtgaagtgatttatgta

SEQ ID NO: 16975 - DNA, 20 bp, Artificial
  CRISPR gRNA sequence
atgtaaggaaacccatgtcc

SEQ ID NO: 16976 - DNA, 20 bp, Artificial
  CRISPR gRNA sequence
taaggaaacccatgtccaag

SEQ ID NO: 16977 - DNA, 20 bp, Artificial
  CRISPR gRNA sequence
aacccatgtccaagtggaac

SEQ ID NO: 16978 - DNA, 20 bp, Artificial
  CRISPR gRNA sequence
acccatgtccaagtggaacc

SEQ ID NO: 16979 - DNA, 20 bp, Artificial
  CRISPR gRNA sequence
gtggaaccaggatttgaacc

SEQ ID NO: 16980 - DNA, 20 bp, Artificial
  CRISPR gRNA sequence
aaccaggatttgaacccaga

SEQ ID NO: 16981 - DNA, 20 bp, Artificial
  CRISPR gRNA sequence
gaacccagacagtctgactg

SEQ ID NO: 16982 - DNA, 20 bp, Artificial
  CRISPR gRNA sequence
accacaatgctctactgctt

SEQ ID NO: 16983 - DNA, 20 bp, Artificial
  CRISPR gRNA sequence
ccacaatgctctactgcttt

SEQ ID NO: 16984 - DNA, 20 bp, Artificial
  CRISPR gRNA sequence
caatgctctactgctttggg

SEQ ID NO: 16985 - DNA, 20 bp, Artificial
  CRISPR gRNA sequence
ctactgctttgggtggactt

SEQ ID NO: 16986 - DNA, 20 bp, Artificial
  CRISPR gRNA sequence
tgctttgggtggacttgagc

SEQ ID NO: 16987 - DNA, 20 bp, Artificial
  CRISPR gRNA sequence
ctctgctcctttctgtgcct

SEQ ID NO: 16988 - DNA, 20 bp, Artificial
  CRISPR gRNA sequence
gtttcctaatatgtaaactg

SEQ ID NO: 16989 - DNA, 20 bp, Artificial
  CRISPR gRNA sequence
tttcctaatatgtaaactga

SEQ ID NO: 16990 - DNA, 20 bp, Artificial
  CRISPR gRNA sequence
tcctaatatgtaaactgaag

SEQ ID NO: 16991 - DNA, 20 bp, Artificial
  CRISPR gRNA sequence
tatgtaaactgaaggagtct

SEQ ID NO: 16992 - DNA, 20 bp, Artificial
  CRISPR gRNA sequence
gtaaactgaaggagtctgag

SEQ ID NO: 16993 - DNA, 20 bp, Artificial
  CRISPR gRNA sequence
aaggagtctgagcagattct

SEQ ID NO: 16994 - DNA, 20 bp, Artificial
  CRISPR gRNA sequence
gatttcctcatcatttgttg

SEQ ID NO: 16995 - DNA, 20 bp, Artificial
  CRISPR gRNA sequence
atttcctcatcatttgttga

SEQ ID NO: 16996 - DNA, 20 bp, Artificial
  CRISPR gRNA sequence
tttcctcatcatttgttgaa

SEQ ID NO: 16997 - DNA, 20 bp, Artificial
  CRISPR gRNA sequence
tctttaaacaatcccaaatg

SEQ ID NO: 16998 - DNA, 20 bp, Artificial
  CRISPR gRNA sequence
attatgtattaataaaacaa

SEQ ID NO: 16999 - DNA, 20 bp, Artificial
  CRISPR gRNA sequence
ttaataaaacaaaagaaaac

SEQ ID NO: 17000 - DNA, 20 bp, Artificial
  CRISPR gRNA sequence
caaaagaaaacaagaaaaac

SEQ ID NO: 17001 - DNA, 20 bp, Artificial
  CRISPR gRNA sequence
aacctatacacgaatgttca

SEQ ID NO: 17002 - DNA, 20 bp, Artificial
  CRISPR gRNA sequence
ctatacacgaatgttcacag

SEQ ID NO: 17003 - DNA, 20 bp, Artificial
  CRISPR gRNA sequence
tatacacgaatgttcacaga

SEQ ID NO: 17004 - DNA, 20 bp, Artificial
  CRISPR gRNA sequence
cacagaaggataattcaaaa

SEQ ID NO: 17005 - DNA, 20 bp, Artificial
  CRISPR gRNA sequence
aaatagccaaaatataaaaa

SEQ ID NO: 17006 - DNA, 20 bp, Artificial
  CRISPR gRNA sequence
aatatccaccaaaaaataaa

SEQ ID NO: 17007 - DNA, 20 bp, Artificial
  CRISPR gRNA sequence
tgttgcttatctatacaata

SEQ ID NO: 17008 - DNA, 20 bp, Artificial
  CRISPR gRNA sequence
aataaagtattccaccatta

SEQ ID NO: 17009 - DNA, 20 bp, Artificial
  CRISPR gRNA sequence
ataaagtattccaccattaa

SEQ ID NO: 17010 - DNA, 20 bp, Artificial
  CRISPR gRNA sequence
taaagtattccaccattaaa

SEQ ID NO: 17011 - DNA, 20 bp, Artificial
  CRISPR gRNA sequence
aagtattccaccattaaagg

SEQ ID NO: 17012 - DNA, 20 bp, Artificial
  CRISPR gRNA sequence
attccaccattaaagggaga

SEQ ID NO: 17013 - DNA, 20 bp, Artificial
  CRISPR gRNA sequence
gagaaagcactgatacatgc

SEQ ID NO: 17014 - DNA, 20 bp, Artificial
  CRISPR gRNA sequence
cactgatacatgctggaaca

SEQ ID NO: 17015 - DNA, 20 bp, Artificial
  CRISPR gRNA sequence
tgaaccttaaaaaaaatgct

SEQ ID NO: 17016 - DNA, 20 bp, Artificial
  CRISPR gRNA sequence
cttaaaaaaaatgctaagtg

SEQ ID NO: 17017 - DNA, 20 bp, Artificial
  CRISPR gRNA sequence
aaaaaaaatgctaagtgaag

SEQ ID NO: 17018 - DNA, 20 bp, Artificial
  CRISPR gRNA sequence
aaaatgctaagtgaagaagc

SEQ ID NO: 17019 - DNA, 20 bp, Artificial
  CRISPR gRNA sequence
aagtgaagaagccggacaca

SEQ ID NO: 17020 - DNA, 20 bp, Artificial
  CRISPR gRNA sequence
agtgaagaagccggacacaa

SEQ ID NO: 17021 - DNA, 20 bp, Artificial
  CRISPR gRNA sequence
gtgaagaagccggacacaaa

SEQ ID NO: 17022 - DNA, 20 bp, Artificial
  CRISPR gRNA sequence
tttatttgaaatgaccaaaa

SEQ ID NO: 17023 - DNA, 20 bp, Artificial
  CRISPR gRNA sequence
ttatttgaaatgaccaaaac

SEQ ID NO: 17024 - DNA, 20 bp, Artificial
  CRISPR gRNA sequence
gaccaaaacaggcaaatcca

SEQ ID NO: 17025 - DNA, 20 bp, Artificial
  CRISPR gRNA sequence
ccaaaacaggcaaatccatg

SEQ ID NO: 17026 - DNA, 20 bp, Artificial
  CRISPR gRNA sequence
ggcaaatccatggagacata

SEQ ID NO: 17027 - DNA, 20 bp, Artificial
  CRISPR gRNA sequence
aaatccatggagacataaag

SEQ ID NO: 17028 - DNA, 20 bp, Artificial
  CRISPR gRNA sequence
aatccatggagacataaagt

SEQ ID NO: 17029 - DNA, 20 bp, Artificial
  CRISPR gRNA sequence
tccatggagacataaagtag

SEQ ID NO: 17030 - DNA, 20 bp, Artificial
  CRISPR gRNA sequence
ccatggagacataaagtagg

SEQ ID NO: 17031 - DNA, 20 bp, Artificial
  CRISPR gRNA sequence
catggagacataaagtagga

SEQ ID NO: 17032 - DNA, 20 bp, Artificial
  CRISPR gRNA sequence
atggagacataaagtaggag

SEQ ID NO: 17033 - DNA, 20 bp, Artificial
  CRISPR gRNA sequence
gagacataaagtaggagggg

SEQ ID NO: 17034 - DNA, 20 bp, Artificial
  CRISPR gRNA sequence
agacataaagtaggaggggt

SEQ ID NO: 17035 - DNA, 20 bp, Artificial
  CRISPR gRNA sequence
gacataaagtaggaggggtg

SEQ ID NO: 17036 - DNA, 20 bp, Artificial
  CRISPR gRNA sequence
aaagtaggaggggtggggcg

SEQ ID NO: 17037 - DNA, 20 bp, Artificial
  CRISPR gRNA sequence
gtaggaggggtggggcgtgg

SEQ ID NO: 17038 - DNA, 20 bp, Artificial
  CRISPR gRNA sequence
gtggctcatgcctgaaatcc

SEQ ID NO: 17039 - DNA, 20 bp, Artificial
  CRISPR gRNA sequence
tgcctgaaatcccagcactt

SEQ ID NO: 17040 - DNA, 20 bp, Artificial
  CRISPR gRNA sequence
gcctgaaatcccagcacttt

SEQ ID NO: 17041 - DNA, 20 bp, Artificial
  CRISPR gRNA sequence
ctgaaatcccagcactttgg

SEQ ID NO: 17042 - DNA, 20 bp, Artificial
  CRISPR gRNA sequence
tgaaatcccagcactttggg

SEQ ID NO: 17043 - DNA, 20 bp, Artificial
  CRISPR gRNA sequence
tcccagcactttgggaggct

SEQ ID NO: 17044 - DNA, 20 bp, Artificial
  CRISPR gRNA sequence
agcactttgggaggctgaga

SEQ ID NO: 17045 - DNA, 20 bp, Artificial
  CRISPR gRNA sequence
gcactttgggaggctgagac

SEQ ID NO: 17046 - DNA, 20 bp, Artificial
  CRISPR gRNA sequence
actttgggaggctgagacag

SEQ ID NO: 17047 - DNA, 20 bp, Artificial
  CRISPR gRNA sequence
ctgagacaggagaatcgctt

SEQ ID NO: 17048 - DNA, 20 bp, Artificial
  CRISPR gRNA sequence
acaggagaatcgcttgagcc

SEQ ID NO: 17049 - DNA, 20 bp, Artificial
  CRISPR gRNA sequence
caggagaatcgcttgagccc

SEQ ID NO: 17050 - DNA, 20 bp, Artificial
  CRISPR gRNA sequence
tcgcttgagcccaggtgttc

SEQ ID NO: 17051 - DNA, 20 bp, Artificial
  CRISPR gRNA sequence
tgagcccaggtgttcaagac

SEQ ID NO: 17052 - DNA, 20 bp, Artificial
  CRISPR gRNA sequence
ccaggtgttcaagaccagcc

SEQ ID NO: 17053 - DNA, 20 bp, Artificial
  CRISPR gRNA sequence
caggtgttcaagaccagcct

SEQ ID NO: 17054 - DNA, 20 bp, Artificial
  CRISPR gRNA sequence
caagaccagcctgggcaaca

SEQ ID NO: 17055 - DNA, 20 bp, Artificial
  CRISPR gRNA sequence
cagcctgggcaacatagcaa

SEQ ID NO: 17056 - DNA, 20 bp, Artificial
  CRISPR gRNA sequence
atctctattaattttttttt

SEQ ID NO: 17057 - DNA, 20 bp, Artificial
  CRISPR gRNA sequence
ctattaatttttttttaaga

SEQ ID NO: 17058 - DNA, 20 bp, Artificial
  CRISPR gRNA sequence
taatttttttttaagaaaga

SEQ ID NO: 17059 - DNA, 20 bp, Artificial
  CRISPR gRNA sequence
ttttaagaaagaaagcatat

SEQ ID NO: 17060 - DNA, 20 bp, Artificial
  CRISPR gRNA sequence
taagaaagaaagcatattag

SEQ ID NO: 17061 - DNA, 20 bp, Artificial
  CRISPR gRNA sequence
aaagcatattagtggttgcc

SEQ ID NO: 17062 - DNA, 20 bp, Artificial
  CRISPR gRNA sequence
aagcatattagtggttgcct

SEQ ID NO: 17063 - DNA, 20 bp, Artificial
  CRISPR gRNA sequence
agcatattagtggttgccta

SEQ ID NO: 17064 - DNA, 20 bp, Artificial
  CRISPR gRNA sequence
attagtggttgcctagggct

SEQ ID NO: 17065 - DNA, 20 bp, Artificial
  CRISPR gRNA sequence
agtggttgcctagggcttgg

SEQ ID NO: 17066 - DNA, 20 bp, Artificial
  CRISPR gRNA sequence
tggttgcctagggcttggca

SEQ ID NO: 17067 - DNA, 20 bp, Artificial
  CRISPR gRNA sequence
gttgcctagggcttggcaga

SEQ ID NO: 17068 - DNA, 20 bp, Artificial
  CRISPR gRNA sequence
ttgcctagggcttggcagag

SEQ ID NO: 17069 - DNA, 20 bp, Artificial
  CRISPR gRNA sequence
tgcctagggcttggcagaga

SEQ ID NO: 17070 - DNA, 20 bp, Artificial
  CRISPR gRNA sequence
ggcttggcagagagggattt

SEQ ID NO: 17071 - DNA, 20 bp, Artificial
  CRISPR gRNA sequence
ttggcagagagggattttgg

SEQ ID NO: 17072 - DNA, 20 bp, Artificial
  CRISPR gRNA sequence
tggcagagagggattttgga

SEQ ID NO: 17073 - DNA, 20 bp, Artificial
  CRISPR gRNA sequence
agagggattttggaaggaaa

SEQ ID NO: 17074 - DNA, 20 bp, Artificial
  CRISPR gRNA sequence
gagggattttggaaggaaat

SEQ ID NO: 17075 - DNA, 20 bp, Artificial
  CRISPR gRNA sequence
agggattttggaaggaaatg

SEQ ID NO: 17076 - DNA, 20 bp, Artificial
  CRISPR gRNA sequence
aaatggggaacaactgctga

SEQ ID NO: 17077 - DNA, 20 bp, Artificial
  CRISPR gRNA sequence
aatggggaacaactgctgat

SEQ ID NO: 17078 - DNA, 20 bp, Artificial
  CRISPR gRNA sequence
ggaacaactgctgatgggtc

SEQ ID NO: 17079 - DNA, 20 bp, Artificial
  CRISPR gRNA sequence
aacaactgctgatgggtctg

SEQ ID NO: 17080 - DNA, 20 bp, Artificial
  CRISPR gRNA sequence
tgatgggtctggagtttctt

SEQ ID NO: 17081 - DNA, 20 bp, Artificial
  CRISPR gRNA sequence
gatgggtctggagtttcttt

SEQ ID NO: 17082 - DNA, 20 bp, Artificial
  CRISPR gRNA sequence
atgggtctggagtttcttta

SEQ ID NO: 17083 - DNA, 20 bp, Artificial
  CRISPR gRNA sequence
tgggtctggagtttctttag

SEQ ID NO: 17084 - DNA, 20 bp, Artificial
  CRISPR gRNA sequence
gggtctggagtttctttagg

SEQ ID NO: 17085 - DNA, 20 bp, Artificial
  CRISPR gRNA sequence
aaatgtgctaaaattgactg

SEQ ID NO: 17086 - DNA, 20 bp, Artificial
  CRISPR gRNA sequence
aatgtgctaaaattgactgt

SEQ ID NO: 17087 - DNA, 20 bp, Artificial
  CRISPR gRNA sequence
atgtgctaaaattgactgtg

SEQ ID NO: 17088 - DNA, 20 bp, Artificial
  CRISPR gRNA sequence
gctaaaattgactgtgggga

SEQ ID NO: 17089 - DNA, 20 bp, Artificial
  CRISPR gRNA sequence
ctaaaattgactgtggggat

SEQ ID NO: 17090 - DNA, 20 bp, Artificial
  CRISPR gRNA sequence
aaaattgactgtggggatgg

SEQ ID NO: 17091 - DNA, 20 bp, Artificial
  CRISPR gRNA sequence
ttgactgtggggatgggaga

SEQ ID NO: 17092 - DNA, 20 bp, Artificial
  CRISPR gRNA sequence
agatggtcacacaactctct

SEQ ID NO: 17093 - DNA, 20 bp, Artificial
  CRISPR gRNA sequence
aactctctgagtattcccaa

SEQ ID NO: 17094 - DNA, 20 bp, Artificial
  CRISPR gRNA sequence
tttttttttttttttttttt

SEQ ID NO: 17095 - DNA, 20 bp, Artificial
  CRISPR gRNA sequence
ttttttttttttttttaaga

SEQ ID NO: 17096 - DNA, 20 bp, Artificial
  CRISPR gRNA sequence
ttttttttttttttaagacg

SEQ ID NO: 17097 - DNA, 20 bp, Artificial
  CRISPR gRNA sequence
aagacggagtctctgtcacc

SEQ ID NO: 17098 - DNA, 20 bp, Artificial
  CRISPR gRNA sequence
agacggagtctctgtcaccc

SEQ ID NO: 17099 - DNA, 20 bp, Artificial
  CRISPR gRNA sequence
ggagtctctgtcacccaggc

SEQ ID NO: 17100 - DNA, 20 bp, Artificial
  CRISPR gRNA sequence
agtctctgtcacccaggctg

SEQ ID NO: 17101 - DNA, 20 bp, Artificial
  CRISPR gRNA sequence
ctgtcacccaggctggagtg

SEQ ID NO: 17102 - DNA, 20 bp, Artificial
  CRISPR gRNA sequence
tgtcacccaggctggagtgc

SEQ ID NO: 17103 - DNA, 20 bp, Artificial
  CRISPR gRNA sequence
gtcacccaggctggagtgca

SEQ ID NO: 17104 - DNA, 20 bp, Artificial
  CRISPR gRNA sequence
tcacccaggctggagtgcag

SEQ ID NO: 17105 - DNA, 20 bp, Artificial
  CRISPR gRNA sequence
ggagtgcaggggtgcaatct

SEQ ID NO: 17106 - DNA, 20 bp, Artificial
  CRISPR gRNA sequence
tcactgcaacgtctgcctcc

SEQ ID NO: 17107 - DNA, 20 bp, Artificial
  CRISPR gRNA sequence
cactgcaacgtctgcctccc

SEQ ID NO: 17108 - DNA, 20 bp, Artificial
  CRISPR gRNA sequence
aacgtctgcctcccaggttc

SEQ ID NO: 17109 - DNA, 20 bp, Artificial
  CRISPR gRNA sequence
ttcaagccattcttctgcct

SEQ ID NO: 17110 - DNA, 20 bp, Artificial
  CRISPR gRNA sequence
ttcttctgcctcagcctcct

SEQ ID NO: 17111 - DNA, 20 bp, Artificial
  CRISPR gRNA sequence
ttctgcctcagcctcctgag

SEQ ID NO: 17112 - DNA, 20 bp, Artificial
  CRISPR gRNA sequence
gcctcagcctcctgagcagc

SEQ ID NO: 17113 - DNA, 20 bp, Artificial
  CRISPR gRNA sequence
cctcagcctcctgagcagct

SEQ ID NO: 17114 - DNA, 20 bp, Artificial
  CRISPR gRNA sequence
ctcctgagcagctgggatta

SEQ ID NO: 17115 - DNA, 20 bp, Artificial
  CRISPR gRNA sequence
tcctgagcagctgggattac

SEQ ID NO: 17116 - DNA, 20 bp, Artificial
  CRISPR gRNA sequence
caggcacccaccaccacacc

SEQ ID NO: 17117 - DNA, 20 bp, Artificial
  CRISPR gRNA sequence
ccggctaatttttgcatttt

SEQ ID NO: 17118 - DNA, 20 bp, Artificial
  CRISPR gRNA sequence
gctaatttttgcatttttag

SEQ ID NO: 17119 - DNA, 20 bp, Artificial
  CRISPR gRNA sequence
taatttttgcatttttagta

SEQ ID NO: 17120 - DNA, 20 bp, Artificial
  CRISPR gRNA sequence
ttttgcatttttagtagaga

SEQ ID NO: 17121 - DNA, 20 bp, Artificial
  CRISPR gRNA sequence
gagacagtgtttcaccattt

SEQ ID NO: 17122 - DNA, 20 bp, Artificial
  CRISPR gRNA sequence
cagtgtttcaccattttggc

SEQ ID NO: 17123 - DNA, 20 bp, Artificial
  CRISPR gRNA sequence
agtgtttcaccattttggcc

SEQ ID NO: 17124 - DNA, 20 bp, Artificial
  CRISPR gRNA sequence
gttctcaaactcctgacctc

SEQ ID NO: 17125 - DNA, 20 bp, Artificial
  CRISPR gRNA sequence
aagtgatccgcctgtctcct

SEQ ID NO: 17126 - DNA, 20 bp, Artificial
  CRISPR gRNA sequence
cctgtctcctcggcctccca

SEQ ID NO: 17127 - DNA, 20 bp, Artificial
  CRISPR gRNA sequence
tcctcggcctcccaaagtgt

SEQ ID NO: 17128 - DNA, 20 bp, Artificial
  CRISPR gRNA sequence
cctcggcctcccaaagtgtt

SEQ ID NO: 17129 - DNA, 20 bp, Artificial
  CRISPR gRNA sequence
ctcccaaagtgttgggatta

SEQ ID NO: 17130 - DNA, 20 bp, Artificial
  CRISPR gRNA sequence
tcccaaagtgttgggattac

SEQ ID NO: 17131 - DNA, 20 bp, Artificial
  CRISPR gRNA sequence
aggcatgaactgtacttttt

SEQ ID NO: 17132 - DNA, 20 bp, Artificial
  CRISPR gRNA sequence
catgaactgtactttttaag

SEQ ID NO: 17133 - DNA, 20 bp, Artificial
  CRISPR gRNA sequence
atgaactgtactttttaagt

SEQ ID NO: 17134 - DNA, 20 bp, Artificial
  CRISPR gRNA sequence
atgtgaattacatctcaata

SEQ ID NO: 17135 - DNA, 20 bp, Artificial
  CRISPR gRNA sequence
tcaataaagctgttaaaacc

SEQ ID NO: 17136 - DNA, 20 bp, Artificial
  CRISPR gRNA sequence
caataaagctgttaaaacct

SEQ ID NO: 17137 - DNA, 20 bp, Artificial
  CRISPR gRNA sequence
taaagctgttaaaacctagg

SEQ ID NO: 17138 - DNA, 20 bp, Artificial
  CRISPR gRNA sequence
gctgttaaaacctaggaagt

SEQ ID NO: 17139 - DNA, 20 bp, Artificial
  CRISPR gRNA sequence
gtaagcattattgtctccat

SEQ ID NO: 17140 - DNA, 20 bp, Artificial
  CRISPR gRNA sequence
agcattattgtctccattgg

SEQ ID NO: 17141 - DNA, 20 bp, Artificial
  CRISPR gRNA sequence
attgtctccattggcagatg

SEQ ID NO: 17142 - DNA, 20 bp, Artificial
  CRISPR gRNA sequence
cattggcagatgaagaactt

SEQ ID NO: 17143 - DNA, 20 bp, Artificial
  CRISPR gRNA sequence
cagatgaagaacttgagacc

SEQ ID NO: 17144 - DNA, 20 bp, Artificial
  CRISPR gRNA sequence
gatgaagaacttgagaccca

SEQ ID NO: 17145 - DNA, 20 bp, Artificial
  CRISPR gRNA sequence
gaagaacttgagacccagag

SEQ ID NO: 17146 - DNA, 20 bp, Artificial
  CRISPR gRNA sequence
acttgagacccagagaagac

SEQ ID NO: 17147 - DNA, 20 bp, Artificial
  CRISPR gRNA sequence
tgagacccagagaagacaag

SEQ ID NO: 17148 - DNA, 20 bp, Artificial
  CRISPR gRNA sequence
agaagacaagcagcttcctc

SEQ ID NO: 17149 - DNA, 20 bp, Artificial
  CRISPR gRNA sequence
gcagcttcctcaagatcatg

SEQ ID NO: 17150 - DNA, 20 bp, Artificial
  CRISPR gRNA sequence
caagatcatgtagctcttgc

SEQ ID NO: 17151 - DNA, 20 bp, Artificial
  CRISPR gRNA sequence
aagatcatgtagctcttgct

SEQ ID NO: 17152 - DNA, 20 bp, Artificial
  CRISPR gRNA sequence
agatcatgtagctcttgctg

SEQ ID NO: 17153 - DNA, 20 bp, Artificial
  CRISPR gRNA sequence
catgtagctcttgctgggga

SEQ ID NO: 17154 - DNA, 20 bp, Artificial
  CRISPR gRNA sequence
agctcttgctggggaaagcc

SEQ ID NO: 17155 - DNA, 20 bp, Artificial
  CRISPR gRNA sequence
tgctggggaaagccaagctg

SEQ ID NO: 17156 - DNA, 20 bp, Artificial
  CRISPR gRNA sequence
gctggggaaagccaagctga

SEQ ID NO: 17157 - DNA, 20 bp, Artificial
  CRISPR gRNA sequence
aagctgaaggctcatctgtg

SEQ ID NO: 17158 - DNA, 20 bp, Artificial
  CRISPR gRNA sequence
aggctcatctgtgtggctct

SEQ ID NO: 17159 - DNA, 20 bp, Artificial
  CRISPR gRNA sequence
ggctcatctgtgtggctcta

SEQ ID NO: 17160 - DNA, 20 bp, Artificial
  CRISPR gRNA sequence
tgtggctctaaggctcctgc

SEQ ID NO: 17161 - DNA, 20 bp, Artificial
  CRISPR gRNA sequence
gtggctctaaggctcctgcc

SEQ ID NO: 17162 - DNA, 20 bp, Artificial
  CRISPR gRNA sequence
aaggctcctgccaggatccg

SEQ ID NO: 17163 - DNA, 20 bp, Artificial
  CRISPR gRNA sequence
tcctgccaggatccgtggtt

SEQ ID NO: 17164 - DNA, 20 bp, Artificial
  CRISPR gRNA sequence
cctgccaggatccgtggttc

SEQ ID NO: 17165 - DNA, 20 bp, Artificial
  CRISPR gRNA sequence
ggttcaggtccatgtttcca

SEQ ID NO: 17166 - DNA, 20 bp, Artificial
  CRISPR gRNA sequence
tccatggtatattcatttcc

SEQ ID NO: 17167 - DNA, 20 bp, Artificial
  CRISPR gRNA sequence
ccatggtatattcatttccc

SEQ ID NO: 17168 - DNA, 20 bp, Artificial
  CRISPR gRNA sequence
catggtatattcatttccca

SEQ ID NO: 17169 - DNA, 20 bp, Artificial
  CRISPR gRNA sequence
tttcccagggctgctgaaac

SEQ ID NO: 17170 - DNA, 20 bp, Artificial
  CRISPR gRNA sequence
ttcccagggctgctgaaaca

SEQ ID NO: 17171 - DNA, 20 bp, Artificial
  CRISPR gRNA sequence
gggctgctgaaacaaggtac

SEQ ID NO: 17172 - DNA, 20 bp, Artificial
  CRISPR gRNA sequence
tgaaacaaggtaccagcatc

SEQ ID NO: 17173 - DNA, 20 bp, Artificial
  CRISPR gRNA sequence
gaaacaaggtaccagcatcc

SEQ ID NO: 17174 - DNA, 20 bp, Artificial
  CRISPR gRNA sequence
acaaggtaccagcatccagg

SEQ ID NO: 17175 - DNA, 20 bp, Artificial
  CRISPR gRNA sequence
gtaccagcatccaggtagct

SEQ ID NO: 17176 - DNA, 20 bp, Artificial
  CRISPR gRNA sequence
atccaggtagctcagaacaa

SEQ ID NO: 17177 - DNA, 20 bp, Artificial
  CRISPR gRNA sequence
aacagcactttattctctca

SEQ ID NO: 17178 - DNA, 20 bp, Artificial
  CRISPR gRNA sequence
actttattctctcatggttc

SEQ ID NO: 17179 - DNA, 20 bp, Artificial
  CRISPR gRNA sequence
tttattctctcatggttctg

SEQ ID NO: 17180 - DNA, 20 bp, Artificial
  CRISPR gRNA sequence
ttattctctcatggttctgg

SEQ ID NO: 17181 - DNA, 20 bp, Artificial
  CRISPR gRNA sequence
tctctcatggttctggaggc

SEQ ID NO: 17182 - DNA, 20 bp, Artificial
  CRISPR gRNA sequence
ctcatggttctggaggccag

SEQ ID NO: 17183 - DNA, 20 bp, Artificial
  CRISPR gRNA sequence
gttctggaggccagaagttg

SEQ ID NO: 17184 - DNA, 20 bp, Artificial
  CRISPR gRNA sequence
ggaggccagaagttgaagcc

SEQ ID NO: 17185 - DNA, 20 bp, Artificial
  CRISPR gRNA sequence
gaggccagaagttgaagcca

SEQ ID NO: 17186 - DNA, 20 bp, Artificial
  CRISPR gRNA sequence
agaagttgaagccaaggtgt

SEQ ID NO: 17187 - DNA, 20 bp, Artificial
  CRISPR gRNA sequence
agttgaagccaaggtgtcag

SEQ ID NO: 17188 - DNA, 20 bp, Artificial
  CRISPR gRNA sequence
gttgaagccaaggtgtcagc

SEQ ID NO: 17189 - DNA, 20 bp, Artificial
  CRISPR gRNA sequence
ttgaagccaaggtgtcagca

SEQ ID NO: 17190 - DNA, 20 bp, Artificial
  CRISPR gRNA sequence
cagcagggccacgctgcctc

SEQ ID NO: 17191 - DNA, 20 bp, Artificial
  CRISPR gRNA sequence
gcagggccacgctgcctctg

SEQ ID NO: 17192 - DNA, 20 bp, Artificial
  CRISPR gRNA sequence
cagggccacgctgcctctgg

SEQ ID NO: 17193 - DNA, 20 bp, Artificial
  CRISPR gRNA sequence
cacgctgcctctggaggctc

SEQ ID NO: 17194 - DNA, 20 bp, Artificial
  CRISPR gRNA sequence
acgctgcctctggaggctcg

SEQ ID NO: 17195 - DNA, 20 bp, Artificial
  CRISPR gRNA sequence
cgctgcctctggaggctcga

SEQ ID NO: 17196 - DNA, 20 bp, Artificial
  CRISPR gRNA sequence
gctgcctctggaggctcgag

SEQ ID NO: 17197 - DNA, 20 bp, Artificial
  CRISPR gRNA sequence
tgcctctggaggctcgaggg

SEQ ID NO: 17198 - DNA, 20 bp, Artificial
  CRISPR gRNA sequence
gaatgcttccttgcctcctc

SEQ ID NO: 17199 - DNA, 20 bp, Artificial
  CRISPR gRNA sequence
tccttgcctcctctagctgc

SEQ ID NO: 17200 - DNA, 20 bp, Artificial
  CRISPR gRNA sequence
ccttgcctcctctagctgct

SEQ ID NO: 17201 - DNA, 20 bp, Artificial
  CRISPR gRNA sequence
ctctagctgctgggaactac

SEQ ID NO: 17202 - DNA, 20 bp, Artificial
  CRISPR gRNA sequence
tactggtgatccttgacttg

SEQ ID NO: 17203 - DNA, 20 bp, Artificial
  CRISPR gRNA sequence
atccttgacttgtggtcttg

SEQ ID NO: 17204 - DNA, 20 bp, Artificial
  CRISPR gRNA sequence
tggctgcatcactctaaact

SEQ ID NO: 17205 - DNA, 20 bp, Artificial
  CRISPR gRNA sequence
catcactctaaactcagctt

SEQ ID NO: 17206 - DNA, 20 bp, Artificial
  CRISPR gRNA sequence
cactctaaactcagctttag

SEQ ID NO: 17207 - DNA, 20 bp, Artificial
  CRISPR gRNA sequence
cacatcacctactcctcatg

SEQ ID NO: 17208 - DNA, 20 bp, Artificial
  CRISPR gRNA sequence
tcacctactcctcatgtagc

SEQ ID NO: 17209 - DNA, 20 bp, Artificial
  CRISPR gRNA sequence
gcaagtctctttctcttata

SEQ ID NO: 17210 - DNA, 20 bp, Artificial
  CRISPR gRNA sequence
cttataaagacacttgtcat

SEQ ID NO: 17211 - DNA, 20 bp, Artificial
  CRISPR gRNA sequence
aagacacttgtcattggatt

SEQ ID NO: 17212 - DNA, 20 bp, Artificial
  CRISPR gRNA sequence
agacacttgtcattggattt

SEQ ID NO: 17213 - DNA, 20 bp, Artificial
  CRISPR gRNA sequence
cattggatttaggacccacc

SEQ ID NO: 17214 - DNA, 20 bp, Artificial
  CRISPR gRNA sequence
taggacccacctagataatc

SEQ ID NO: 17215 - DNA, 20 bp, Artificial
  CRISPR gRNA sequence
aggacccacctagataatcc

SEQ ID NO: 17216 - DNA, 20 bp, Artificial
  CRISPR gRNA sequence
atccaggatgatgtcatttc

SEQ ID NO: 17217 - DNA, 20 bp, Artificial
  CRISPR gRNA sequence
ttctttttttgccttctttt

SEQ ID NO: 17218 - DNA, 20 bp, Artificial
  CRISPR gRNA sequence
ttttttgccttcttttgaga

SEQ ID NO: 17219 - DNA, 20 bp, Artificial
  CRISPR gRNA sequence
ttttgccttcttttgagaca

SEQ ID NO: 17220 - DNA, 20 bp, Artificial
  CRISPR gRNA sequence
tttgccttcttttgagacag

SEQ ID NO: 17221 - DNA, 20 bp, Artificial
  CRISPR gRNA sequence
cagaggcttgctctgttgcc

SEQ ID NO: 17222 - DNA, 20 bp, Artificial
  CRISPR gRNA sequence
agaggcttgctctgttgccc

SEQ ID NO: 17223 - DNA, 20 bp, Artificial
  CRISPR gRNA sequence
gcttgctctgttgcccaggc

SEQ ID NO: 17224 - DNA, 20 bp, Artificial
  CRISPR gRNA sequence
ctgttgcccaggctggaatg

SEQ ID NO: 17225 - DNA, 20 bp, Artificial
  CRISPR gRNA sequence
ttgcccaggctggaatgcag

SEQ ID NO: 17226 - DNA, 20 bp, Artificial
  CRISPR gRNA sequence
ggaatgcagtggcgctgtat

SEQ ID NO: 17227 - DNA, 20 bp, Artificial
  CRISPR gRNA sequence
tcactgcaacctccacctcc

SEQ ID NO: 17228 - DNA, 20 bp, Artificial
  CRISPR gRNA sequence
caacctccacctcccagttc

SEQ ID NO: 17229 - DNA, 20 bp, Artificial
  CRISPR gRNA sequence
ttcaagcgattctcctgccc

SEQ ID NO: 17230 - DNA, 20 bp, Artificial
  CRISPR gRNA sequence
ttctcctgccccagtctcct

SEQ ID NO: 17231 - DNA, 20 bp, Artificial
  CRISPR gRNA sequence
tcctgccccagtctcctgag

SEQ ID NO: 17232 - DNA, 20 bp, Artificial
  CRISPR gRNA sequence
gccccagtctcctgagtagc

SEQ ID NO: 17233 - DNA, 20 bp, Artificial
  CRISPR gRNA sequence
ccccagtctcctgagtagct

SEQ ID NO: 17234 - DNA, 20 bp, Artificial
  CRISPR gRNA sequence
ctcctgagtagctgggatta

SEQ ID NO: 17235 - DNA, 20 bp, Artificial
  CRISPR gRNA sequence
tcctgagtagctgggattac

SEQ ID NO: 17236 - DNA, 20 bp, Artificial
  CRISPR gRNA sequence
caggtgctcaccaccatgac

SEQ ID NO: 17237 - DNA, 20 bp, Artificial
  CRISPR gRNA sequence
ccagctaatttttgtatttt

SEQ ID NO: 17238 - DNA, 20 bp, Artificial
  CRISPR gRNA sequence
gctaatttttgtatttttag

SEQ ID NO: 17239 - DNA, 20 bp, Artificial
  CRISPR gRNA sequence
ttttgtatttttagtagaaa

SEQ ID NO: 17240 - DNA, 20 bp, Artificial
  CRISPR gRNA sequence
tttgtatttttagtagaaat

SEQ ID NO: 17241 - DNA, 20 bp, Artificial
  CRISPR gRNA sequence
ttgtatttttagtagaaatg

SEQ ID NO: 17242 - DNA, 20 bp, Artificial
  CRISPR gRNA sequence
gaaatggggttttgccatgt

SEQ ID NO: 17243 - DNA, 20 bp, Artificial
  CRISPR gRNA sequence
ttttgccatgttggccacgc

SEQ ID NO: 17244 - DNA, 20 bp, Artificial
  CRISPR gRNA sequence
tggtcttgaactcctgacct

SEQ ID NO: 17245 - DNA, 20 bp, Artificial
  CRISPR gRNA sequence
ggtcttgaactcctgacctc

SEQ ID NO: 17246 - DNA, 20 bp, Artificial
  CRISPR gRNA sequence
ctcaggtgatcctccaatct

SEQ ID NO: 17247 - DNA, 20 bp, Artificial
  CRISPR gRNA sequence
cctccaatctcagcttccca

SEQ ID NO: 17248 - DNA, 20 bp, Artificial
  CRISPR gRNA sequence
atctcagcttcccaaagtgc

SEQ ID NO: 17249 - DNA, 20 bp, Artificial
  CRISPR gRNA sequence
tctcagcttcccaaagtgct

SEQ ID NO: 17250 - DNA, 20 bp, Artificial
  CRISPR gRNA sequence
ttcccaaagtgctgggatta

SEQ ID NO: 17251 - DNA, 20 bp, Artificial
  CRISPR gRNA sequence
tcccaaagtgctgggattac

SEQ ID NO: 17252 - DNA, 20 bp, Artificial
  CRISPR gRNA sequence
agtgctgggattacaggcat

SEQ ID NO: 17253 - DNA, 20 bp, Artificial
  CRISPR gRNA sequence
caggcatgagccactgcacc

SEQ ID NO: 17254 - DNA, 20 bp, Artificial
  CRISPR gRNA sequence
ttaacttaattctatctgca

SEQ ID NO: 17255 - DNA, 20 bp, Artificial
  CRISPR gRNA sequence
aaagacccttttcccaaata

SEQ ID NO: 17256 - DNA, 20 bp, Artificial
  CRISPR gRNA sequence
cccaaataaagtcacactga

SEQ ID NO: 17257 - DNA, 20 bp, Artificial
  CRISPR gRNA sequence
ccaaataaagtcacactgac

SEQ ID NO: 17258 - DNA, 20 bp, Artificial
  CRISPR gRNA sequence
aaagtcacactgacaggttc

SEQ ID NO: 17259 - DNA, 20 bp, Artificial
  CRISPR gRNA sequence
aagtcacactgacaggttcc

SEQ ID NO: 17260 - DNA, 20 bp, Artificial
  CRISPR gRNA sequence
agtcacactgacaggttcca

SEQ ID NO: 17261 - DNA, 20 bp, Artificial
  CRISPR gRNA sequence
caggttccagggatttgaca

SEQ ID NO: 17262 - DNA, 20 bp, Artificial
  CRISPR gRNA sequence
tttgacatggacatatcttt

SEQ ID NO: 17263 - DNA, 20 bp, Artificial
  CRISPR gRNA sequence
ttgacatggacatatctttt

SEQ ID NO: 17264 - DNA, 20 bp, Artificial
  CRISPR gRNA sequence
tgacatggacatatcttttg

SEQ ID NO: 17265 - DNA, 20 bp, Artificial
  CRISPR gRNA sequence
gacatggacatatcttttgg

SEQ ID NO: 17266 - DNA, 20 bp, Artificial
  CRISPR gRNA sequence
acatggacatatcttttggg

SEQ ID NO: 17267 - DNA, 20 bp, Artificial
  CRISPR gRNA sequence
aacccaccacacatgacatg

SEQ ID NO: 17268 - DNA, 20 bp, Artificial
  CRISPR gRNA sequence
ccacacatgacatgcagatg

SEQ ID NO: 17269 - DNA, 20 bp, Artificial
  CRISPR gRNA sequence
cacacatgacatgcagatga

SEQ ID NO: 17270 - DNA, 20 bp, Artificial
  CRISPR gRNA sequence
catgacatgcagatgaaggc

SEQ ID NO: 17271 - DNA, 20 bp, Artificial
  CRISPR gRNA sequence
acatgcagatgaaggctgga

SEQ ID NO: 17272 - DNA, 20 bp, Artificial
  CRISPR gRNA sequence
agatgaaggctggaaagaaa

SEQ ID NO: 17273 - DNA, 20 bp, Artificial
  CRISPR gRNA sequence
atgaaggctggaaagaaaca

SEQ ID NO: 17274 - DNA, 20 bp, Artificial
  CRISPR gRNA sequence
tgaaggctggaaagaaacag

SEQ ID NO: 17275 - DNA, 20 bp, Artificial
  CRISPR gRNA sequence
gaaggctggaaagaaacaga

SEQ ID NO: 17276 - DNA, 20 bp, Artificial
  CRISPR gRNA sequence
aggctggaaagaaacagagg

SEQ ID NO: 17277 - DNA, 20 bp, Artificial
  CRISPR gRNA sequence
aagaaacagagggagcttcc

SEQ ID NO: 17278 - DNA, 20 bp, Artificial
  CRISPR gRNA sequence
gaaacagagggagcttcctg

SEQ ID NO: 17279 - DNA, 20 bp, Artificial
  CRISPR gRNA sequence
aaacagagggagcttcctgg

SEQ ID NO: 17280 - DNA, 20 bp, Artificial
  CRISPR gRNA sequence
acagagggagcttcctggag

SEQ ID NO: 17281 - DNA, 20 bp, Artificial
  CRISPR gRNA sequence
cagagggagcttcctggagg

SEQ ID NO: 17282 - DNA, 20 bp, Artificial
  CRISPR gRNA sequence
gggagcttcctggaggaggt

SEQ ID NO: 17283 - DNA, 20 bp, Artificial
  CRISPR gRNA sequence
gagcttcctggaggaggtaa

SEQ ID NO: 17284 - DNA, 20 bp, Artificial
  CRISPR gRNA sequence
agcttcctggaggaggtaag

SEQ ID NO: 17285 - DNA, 20 bp, Artificial
  CRISPR gRNA sequence
cttcctggaggaggtaagag

SEQ ID NO: 17286 - DNA, 20 bp, Artificial
  CRISPR gRNA sequence
tcctggaggaggtaagagga

SEQ ID NO: 17287 - DNA, 20 bp, Artificial
  CRISPR gRNA sequence
ggaggaggtaagaggagagc

SEQ ID NO: 17288 - DNA, 20 bp, Artificial
  CRISPR gRNA sequence
taagaggagagctggccctg

SEQ ID NO: 17289 - DNA, 20 bp, Artificial
  CRISPR gRNA sequence
aggagagctggccctgaagc

SEQ ID NO: 17290 - DNA, 20 bp, Artificial
  CRISPR gRNA sequence
agagctggccctgaagctgg

SEQ ID NO: 17291 - DNA, 20 bp, Artificial
  CRISPR gRNA sequence
tggccctgaagctggaagac

SEQ ID NO: 17292 - DNA, 20 bp, Artificial
  CRISPR gRNA sequence
gccctgaagctggaagacca

SEQ ID NO: 17293 - DNA, 20 bp, Artificial
  CRISPR gRNA sequence
ccctgaagctggaagaccag

SEQ ID NO: 17294 - DNA, 20 bp, Artificial
  CRISPR gRNA sequence
cctgaagctggaagaccaga

SEQ ID NO: 17295 - DNA, 20 bp, Artificial
  CRISPR gRNA sequence
tgaagctggaagaccagagg

SEQ ID NO: 17296 - DNA, 20 bp, Artificial
  CRISPR gRNA sequence
gaagctggaagaccagaggg

SEQ ID NO: 17297 - DNA, 20 bp, Artificial
  CRISPR gRNA sequence
aggctcctactgccctgttc

SEQ ID NO: 17298 - DNA, 20 bp, Artificial
  CRISPR gRNA sequence
ggctcctactgccctgttct

SEQ ID NO: 17299 - DNA, 20 bp, Artificial
  CRISPR gRNA sequence
ctactgccctgttctgggcc

SEQ ID NO: 17300 - DNA, 20 bp, Artificial
  CRISPR gRNA sequence
ctgccctgttctgggcccag

SEQ ID NO: 17301 - DNA, 20 bp, Artificial
  CRISPR gRNA sequence
gccctgttctgggcccagaa

SEQ ID NO: 17302 - DNA, 20 bp, Artificial
  CRISPR gRNA sequence
gcccagaagagaatacattg

SEQ ID NO: 17303 - DNA, 20 bp, Artificial
  CRISPR gRNA sequence
ccagaagagaatacattgaa

SEQ ID NO: 17304 - DNA, 20 bp, Artificial
  CRISPR gRNA sequence
aagagaatacattgaagagt

SEQ ID NO: 17305 - DNA, 20 bp, Artificial
  CRISPR gRNA sequence
acattgaagagtaagctcat

SEQ ID NO: 17306 - DNA, 20 bp, Artificial
  CRISPR gRNA sequence
caacttgccaccccattcct

SEQ ID NO: 17307 - DNA, 20 bp, Artificial
  CRISPR gRNA sequence
ttctttttcttttttttttt

SEQ ID NO: 17308 - DNA, 20 bp, Artificial
  CRISPR gRNA sequence
ttttctttttttttttgaga

SEQ ID NO: 17309 - DNA, 20 bp, Artificial
  CRISPR gRNA sequence
ttctttttttttttgagaca

SEQ ID NO: 17310 - DNA, 20 bp, Artificial
  CRISPR gRNA sequence
cagagtctcactctgtcgcc

SEQ ID NO: 17311 - DNA, 20 bp, Artificial
  CRISPR gRNA sequence
agagtctcactctgtcgccc

SEQ ID NO: 17312 - DNA, 20 bp, Artificial
  CRISPR gRNA sequence
tctcactctgtcgcccaggc

SEQ ID NO: 17313 - DNA, 20 bp, Artificial
  CRISPR gRNA sequence
tcactctgtcgcccaggctg

SEQ ID NO: 17314 - DNA, 20 bp, Artificial
  CRISPR gRNA sequence
ctgtcgcccaggctggagtg

SEQ ID NO: 17315 - DNA, 20 bp, Artificial
  CRISPR gRNA sequence
tcgcccaggctggagtgcag

SEQ ID NO: 17316 - DNA, 20 bp, Artificial
  CRISPR gRNA sequence
ggagtgcagtggtgcaatct

SEQ ID NO: 17317 - DNA, 20 bp, Artificial
  CRISPR gRNA sequence
tcactgcaacctctgcctcc

SEQ ID NO: 17318 - DNA, 20 bp, Artificial
  CRISPR gRNA sequence
aacctctgcctcccggattc

SEQ ID NO: 17319 - DNA, 20 bp, Artificial
  CRISPR gRNA sequence
ttctcctgcttcaacctccc

SEQ ID NO: 17320 - DNA, 20 bp, Artificial
  CRISPR gRNA sequence
tcctgcttcaacctcccaag

SEQ ID NO: 17321 - DNA, 20 bp, Artificial
  CRISPR gRNA sequence
gcttcaacctcccaagtagc

SEQ ID NO: 17322 - DNA, 20 bp, Artificial
  CRISPR gRNA sequence
ctcccaagtagctggcatta

SEQ ID NO: 17323 - DNA, 20 bp, Artificial
  CRISPR gRNA sequence
tcccaagtagctggcattac

SEQ ID NO: 17324 - DNA, 20 bp, Artificial
  CRISPR gRNA sequence
caggcacccgccaccatgcc

SEQ ID NO: 17325 - DNA, 20 bp, Artificial
  CRISPR gRNA sequence
ctggctaatttttttatttt

SEQ ID NO: 17326 - DNA, 20 bp, Artificial
  CRISPR gRNA sequence
taatttttttatttttagta

SEQ ID NO: 17327 - DNA, 20 bp, Artificial
  CRISPR gRNA sequence
ttttttatttttagtaaaga

SEQ ID NO: 17328 - DNA, 20 bp, Artificial
  CRISPR gRNA sequence
tttttatttttagtaaagat

SEQ ID NO: 17329 - DNA, 20 bp, Artificial
  CRISPR gRNA sequence
ttttatttttagtaaagatg

SEQ ID NO: 17330 - DNA, 20 bp, Artificial
  CRISPR gRNA sequence
aagatggggtttcaccatgt

SEQ ID NO: 17331 - DNA, 20 bp, Artificial
  CRISPR gRNA sequence
tggggtttcaccatgttggt

SEQ ID NO: 17332 - DNA, 20 bp, Artificial
  CRISPR gRNA sequence
ggggtttcaccatgttggtc

SEQ ID NO: 17333 - DNA, 20 bp, Artificial
  CRISPR gRNA sequence
tttcaccatgttggtcaggc

SEQ ID NO: 17334 - DNA, 20 bp, Artificial
  CRISPR gRNA sequence
tggtttcgaactcccgacct

SEQ ID NO: 17335 - DNA, 20 bp, Artificial
  CRISPR gRNA sequence
ggtttcgaactcccgacctc

SEQ ID NO: 17336 - DNA, 20 bp, Artificial
  CRISPR gRNA sequence
ctcaggtgatccacccgcct

SEQ ID NO: 17337 - DNA, 20 bp, Artificial
  CRISPR gRNA sequence
ccacccgccttggcctccca

SEQ ID NO: 17338 - DNA, 20 bp, Artificial
  CRISPR gRNA sequence
gccttggcctcccaaagtgc

SEQ ID NO: 17339 - DNA, 20 bp, Artificial
  CRISPR gRNA sequence
ccttggcctcccaaagtgct

SEQ ID NO: 17340 - DNA, 20 bp, Artificial
  CRISPR gRNA sequence
ctcccaaagtgctgggatta

SEQ ID NO: 17341 - DNA, 20 bp, Artificial
  CRISPR gRNA sequence
tcccaaagtgctgggattac

SEQ ID NO: 17342 - DNA, 20 bp, Artificial
  CRISPR gRNA sequence
agtgctgggattacaggtgt

SEQ ID NO: 17343 - DNA, 20 bp, Artificial
  CRISPR gRNA sequence
caggtgtgagccaccacacc

SEQ ID NO: 17344 - DNA, 20 bp, Artificial
  CRISPR gRNA sequence
gtgagccaccacacccggcc

SEQ ID NO: 17345 - DNA, 20 bp, Artificial
  CRISPR gRNA sequence
gagccaccacacccggccca

SEQ ID NO: 17346 - DNA, 20 bp, Artificial
  CRISPR gRNA sequence
cattttctttcacgcatcca

SEQ ID NO: 17347 - DNA, 20 bp, Artificial
  CRISPR gRNA sequence
catccacagctttcactgcc

SEQ ID NO: 17348 - DNA, 20 bp, Artificial
  CRISPR gRNA sequence
atccacagctttcactgcct

SEQ ID NO: 17349 - DNA, 20 bp, Artificial
  CRISPR gRNA sequence
tccacagctttcactgcctg

SEQ ID NO: 17350 - DNA, 20 bp, Artificial
  CRISPR gRNA sequence
cacagctttcactgcctggg

SEQ ID NO: 17351 - DNA, 20 bp, Artificial
  CRISPR gRNA sequence
cagctttcactgcctgggga

SEQ ID NO: 17352 - DNA, 20 bp, Artificial
  CRISPR gRNA sequence
agctttcactgcctggggag

SEQ ID NO: 17353 - DNA, 20 bp, Artificial
  CRISPR gRNA sequence
tcactgcctggggagaggct

SEQ ID NO: 17354 - DNA, 20 bp, Artificial
  CRISPR gRNA sequence
gcctggggagaggctcagca

SEQ ID NO: 17355 - DNA, 20 bp, Artificial
  CRISPR gRNA sequence
agaggctcagcacagacccc

SEQ ID NO: 17356 - DNA, 20 bp, Artificial
  CRISPR gRNA sequence
gcacagacccccggatgtca

SEQ ID NO: 17357 - DNA, 20 bp, Artificial
  CRISPR gRNA sequence
acagacccccggatgtcaca

SEQ ID NO: 17358 - DNA, 20 bp, Artificial
  CRISPR gRNA sequence
gtcacagagaatgatctttc

SEQ ID NO: 17359 - DNA, 20 bp, Artificial
  CRISPR gRNA sequence
gagaatgatctttccagtcc

SEQ ID NO: 17360 - DNA, 20 bp, Artificial
  CRISPR gRNA sequence
atgatctttccagtccaagc

SEQ ID NO: 17361 - DNA, 20 bp, Artificial
  CRISPR gRNA sequence
tgatctttccagtccaagct

SEQ ID NO: 17362 - DNA, 20 bp, Artificial
  CRISPR gRNA sequence
gatctttccagtccaagctg

SEQ ID NO: 17363 - DNA, 20 bp, Artificial
  CRISPR gRNA sequence
tccagtccaagctggggcac

SEQ ID NO: 17364 - DNA, 20 bp, Artificial
  CRISPR gRNA sequence
gtccaagctggggcactggc

SEQ ID NO: 17365 - DNA, 20 bp, Artificial
  CRISPR gRNA sequence
tccaagctggggcactggct

SEQ ID NO: 17366 - DNA, 20 bp, Artificial
  CRISPR gRNA sequence
ctgggcccacttgttcatga

SEQ ID NO: 17367 - DNA, 20 bp, Artificial
  CRISPR gRNA sequence
cccacttgttcatgacggtt

SEQ ID NO: 17368 - DNA, 20 bp, Artificial
  CRISPR gRNA sequence
acttgttcatgacggttgag

SEQ ID NO: 17369 - DNA, 20 bp, Artificial
  CRISPR gRNA sequence
cttgttcatgacggttgagc

SEQ ID NO: 17370 - DNA, 20 bp, Artificial
  CRISPR gRNA sequence
ttgttcatgacggttgagcg

SEQ ID NO: 17371 - DNA, 20 bp, Artificial
  CRISPR gRNA sequence
tgttcatgacggttgagcgg

SEQ ID NO: 17372 - DNA, 20 bp, Artificial
  CRISPR gRNA sequence
tgacggttgagcgggggctg

SEQ ID NO: 17373 - DNA, 20 bp, Artificial
  CRISPR gRNA sequence
gacggttgagcgggggctgc

SEQ ID NO: 17374 - DNA, 20 bp, Artificial
  CRISPR gRNA sequence
tgcaggaacccaaacataac

SEQ ID NO: 17375 - DNA, 20 bp, Artificial
  CRISPR gRNA sequence
acccaaacataaccggcttg

SEQ ID NO: 17376 - DNA, 20 bp, Artificial
  CRISPR gRNA sequence
aaacataaccggcttgcagc

SEQ ID NO: 17377 - DNA, 20 bp, Artificial
  CRISPR gRNA sequence
accggcttgcagcgagatcc

SEQ ID NO: 17378 - DNA, 20 bp, Artificial
  CRISPR gRNA sequence
agatcccagccaaccatgac

SEQ ID NO: 17379 - DNA, 20 bp, Artificial
  CRISPR gRNA sequence
atcccagccaaccatgacta

SEQ ID NO: 17380 - DNA, 20 bp, Artificial
  CRISPR gRNA sequence
tcccagccaaccatgactag

SEQ ID NO: 17381 - DNA, 20 bp, Artificial
  CRISPR gRNA sequence
cagccaaccatgactagagg

SEQ ID NO: 17382 - DNA, 20 bp, Artificial
  CRISPR gRNA sequence
ccaaccatgactagaggaag

SEQ ID NO: 17383 - DNA, 20 bp, Artificial
  CRISPR gRNA sequence
actagaggaagcagaactga

SEQ ID NO: 17384 - DNA, 20 bp, Artificial
  CRISPR gRNA sequence
gaggaagcagaactgaaaga

SEQ ID NO: 17385 - DNA, 20 bp, Artificial
  CRISPR gRNA sequence
aggaagcagaactgaaagat

SEQ ID NO: 17386 - DNA, 20 bp, Artificial
  CRISPR gRNA sequence
ggaagcagaactgaaagatg

SEQ ID NO: 17387 - DNA, 20 bp, Artificial
  CRISPR gRNA sequence
tggggccaccgcccttttcc

SEQ ID NO: 17388 - DNA, 20 bp, Artificial
  CRISPR gRNA sequence
gggccaccgcccttttcctg

SEQ ID NO: 17389 - DNA, 20 bp, Artificial
  CRISPR gRNA sequence
ccaccgcccttttcctggag

SEQ ID NO: 17390 - DNA, 20 bp, Artificial
  CRISPR gRNA sequence
caccgcccttttcctggagc

SEQ ID NO: 17391 - DNA, 20 bp, Artificial
  CRISPR gRNA sequence
accgcccttttcctggagca

SEQ ID NO: 17392 - DNA, 20 bp, Artificial
  CRISPR gRNA sequence
cttttcctggagcagggcca

SEQ ID NO: 17393 - DNA, 20 bp, Artificial
  CRISPR gRNA sequence
tcctggagcagggccaaagc

SEQ ID NO: 17394 - DNA, 20 bp, Artificial
  CRISPR gRNA sequence
cctggagcagggccaaagct

SEQ ID NO: 17395 - DNA, 20 bp, Artificial
  CRISPR gRNA sequence
tggagcagggccaaagctgg

SEQ ID NO: 17396 - DNA, 20 bp, Artificial
  CRISPR gRNA sequence
gcagggccaaagctgggaga

SEQ ID NO: 17397 - DNA, 20 bp, Artificial
  CRISPR gRNA sequence
ggccaaagctgggagatggt

SEQ ID NO: 17398 - DNA, 20 bp, Artificial
  CRISPR gRNA sequence
gccaaagctgggagatggtt

SEQ ID NO: 17399 - DNA, 20 bp, Artificial
  CRISPR gRNA sequence
ccaaagctgggagatggttg

SEQ ID NO: 17400 - DNA, 20 bp, Artificial
  CRISPR gRNA sequence
caaagctgggagatggttgg

SEQ ID NO: 17401 - DNA, 20 bp, Artificial
  CRISPR gRNA sequence
gctgggagatggttgggggt

SEQ ID NO: 17402 - DNA, 20 bp, Artificial
  CRISPR gRNA sequence
gtgagatgctccacctctcc

SEQ ID NO: 17403 - DNA, 20 bp, Artificial
  CRISPR gRNA sequence
ctccacctctcccagcccct

SEQ ID NO: 17404 - DNA, 20 bp, Artificial
  CRISPR gRNA sequence
acctctcccagccccttggt

SEQ ID NO: 17405 - DNA, 20 bp, Artificial
  CRISPR gRNA sequence
cctctcccagccccttggtc

SEQ ID NO: 17406 - DNA, 20 bp, Artificial
  CRISPR gRNA sequence
ctctcccagccccttggtca

SEQ ID NO: 17407 - DNA, 20 bp, Artificial
  CRISPR gRNA sequence
cagccccttggtcagggaca

SEQ ID NO: 17408 - DNA, 20 bp, Artificial
  CRISPR gRNA sequence
agccccttggtcagggacac

SEQ ID NO: 17409 - DNA, 20 bp, Artificial
  CRISPR gRNA sequence
aggcacaaaatctgttctct

SEQ ID NO: 17410 - DNA, 20 bp, Artificial
  CRISPR gRNA sequence
gcacaaaatctgttctctca

SEQ ID NO: 17411 - DNA, 20 bp, Artificial
  CRISPR gRNA sequence
caaaatctgttctctcagag

SEQ ID NO: 17412 - DNA, 20 bp, Artificial
  CRISPR gRNA sequence
atctgttctctcagagcagt

SEQ ID NO: 17413 - DNA, 20 bp, Artificial
  CRISPR gRNA sequence
ttctctcagagcagtgagaa

SEQ ID NO: 17414 - DNA, 20 bp, Artificial
  CRISPR gRNA sequence
gagaaaagacacctttgccc

SEQ ID NO: 17415 - DNA, 20 bp, Artificial
  CRISPR gRNA sequence
ttccacccatgctctttatt

SEQ ID NO: 17416 - DNA, 20 bp, Artificial
  CRISPR gRNA sequence
tttattaagaacctacattg

SEQ ID NO: 17417 - DNA, 20 bp, Artificial
  CRISPR gRNA sequence
cagcaatctgcctcctcttt

SEQ ID NO: 17418 - DNA, 20 bp, Artificial
  CRISPR gRNA sequence
agcaatctgcctcctctttg

SEQ ID NO: 17419 - DNA, 20 bp, Artificial
  CRISPR gRNA sequence
aatctgcctcctctttgagg

SEQ ID NO: 17420 - DNA, 20 bp, Artificial
  CRISPR gRNA sequence
aggcagtgtgatctcgtgac

SEQ ID NO: 17421 - DNA, 20 bp, Artificial
  CRISPR gRNA sequence
gcagtgtgatctcgtgacaa

SEQ ID NO: 17422 - DNA, 20 bp, Artificial
  CRISPR gRNA sequence
tgatctcgtgacaagagctc

SEQ ID NO: 17423 - DNA, 20 bp, Artificial
  CRISPR gRNA sequence
caagagctccagactgatcc

SEQ ID NO: 17424 - DNA, 20 bp, Artificial
  CRISPR gRNA sequence
atcctagcaactccgtgaat

SEQ ID NO: 17425 - DNA, 20 bp, Artificial
  CRISPR gRNA sequence
gtgaatgagttgtgtgactt

SEQ ID NO: 17426 - DNA, 20 bp, Artificial
  CRISPR gRNA sequence
agttgtgtgactttggactt

SEQ ID NO: 17427 - DNA, 20 bp, Artificial
  CRISPR gRNA sequence
gttgtgtgactttggacttt

SEQ ID NO: 17428 - DNA, 20 bp, Artificial
  CRISPR gRNA sequence
catatctataacatttctat

SEQ ID NO: 17429 - DNA, 20 bp, Artificial
  CRISPR gRNA sequence
ttccatatctataaaataat

SEQ ID NO: 17430 - DNA, 20 bp, Artificial
  CRISPR gRNA sequence
aataataagttacccaaact

SEQ ID NO: 17431 - DNA, 20 bp, Artificial
  CRISPR gRNA sequence
acccaaactcagttttctca

SEQ ID NO: 17432 - DNA, 20 bp, Artificial
  CRISPR gRNA sequence
cccaaactcagttttctcac

SEQ ID NO: 17433 - DNA, 20 bp, Artificial
  CRISPR gRNA sequence
ccaaactcagttttctcaca

SEQ ID NO: 17434 - DNA, 20 bp, Artificial
  CRISPR gRNA sequence
tcagttttctcacagggcat

SEQ ID NO: 17435 - DNA, 20 bp, Artificial
  CRISPR gRNA sequence
cagttttctcacagggcatt

SEQ ID NO: 17436 - DNA, 20 bp, Artificial
  CRISPR gRNA sequence
tcacagggcattgggtctgc

SEQ ID NO: 17437 - DNA, 20 bp, Artificial
  CRISPR gRNA sequence
cacagggcattgggtctgcc

SEQ ID NO: 17438 - DNA, 20 bp, Artificial
  CRISPR gRNA sequence
acagggcattgggtctgcca

SEQ ID NO: 17439 - DNA, 20 bp, Artificial
  CRISPR gRNA sequence
tgggtctgccagggaccttc

SEQ ID NO: 17440 - DNA, 20 bp, Artificial
  CRISPR gRNA sequence
gacctctttccttcactctg

SEQ ID NO: 17441 - DNA, 20 bp, Artificial
  CRISPR gRNA sequence
tccttcactctgcagatgac

SEQ ID NO: 17442 - DNA, 20 bp, Artificial
  CRISPR gRNA sequence
actctgcagatgacaagact

SEQ ID NO: 17443 - DNA, 20 bp, Artificial
  CRISPR gRNA sequence
agatgacaagactgagaccc

SEQ ID NO: 17444 - DNA, 20 bp, Artificial
  CRISPR gRNA sequence
gatgacaagactgagacccc

SEQ ID NO: 17445 - DNA, 20 bp, Artificial
  CRISPR gRNA sequence
gacaagactgagaccccggg

SEQ ID NO: 17446 - DNA, 20 bp, Artificial
  CRISPR gRNA sequence
acaagactgagaccccggga

SEQ ID NO: 17447 - DNA, 20 bp, Artificial
  CRISPR gRNA sequence
gggaaggacgtgacttgcac

SEQ ID NO: 17448 - DNA, 20 bp, Artificial
  CRISPR gRNA sequence
gtgacttgcacaagacctca

SEQ ID NO: 17449 - DNA, 20 bp, Artificial
  CRISPR gRNA sequence
cacaagacctcatagcctgt

SEQ ID NO: 17450 - DNA, 20 bp, Artificial
  CRISPR gRNA sequence
aagacctcatagcctgtcgg

SEQ ID NO: 17451 - DNA, 20 bp, Artificial
  CRISPR gRNA sequence
tctcccccactccccctgcc

SEQ ID NO: 17452 - DNA, 20 bp, Artificial
  CRISPR gRNA sequence
actccccctgccaagactcc

SEQ ID NO: 17453 - DNA, 20 bp, Artificial
  CRISPR gRNA sequence
ctccccctgccaagactccc

SEQ ID NO: 17454 - DNA, 20 bp, Artificial
  CRISPR gRNA sequence
ccctgccaagactcccaggc

SEQ ID NO: 17455 - DNA, 20 bp, Artificial
  CRISPR gRNA sequence
aggctggtgctctttccccc

SEQ ID NO: 17456 - DNA, 20 bp, Artificial
  CRISPR gRNA sequence
atgatcacccttgtcctgtc

SEQ ID NO: 17457 - DNA, 20 bp, Artificial
  CRISPR gRNA sequence
tgatcacccttgtcctgtct

SEQ ID NO: 17458 - DNA, 20 bp, Artificial
  CRISPR gRNA sequence
cccttgtcctgtctgggctc

SEQ ID NO: 17459 - DNA, 20 bp, Artificial
  CRISPR gRNA sequence
gtcctgtctgggctcaagca

SEQ ID NO: 17460 - DNA, 20 bp, Artificial
  CRISPR gRNA sequence
cctgtctgggctcaagcata

SEQ ID NO: 17461 - DNA, 20 bp, Artificial
  CRISPR gRNA sequence
tgggctcaagcatagagaca

SEQ ID NO: 17462 - DNA, 20 bp, Artificial
  CRISPR gRNA sequence
gggctcaagcatagagacac

SEQ ID NO: 17463 - DNA, 20 bp, Artificial
  CRISPR gRNA sequence
ctcaagcatagagacacagg

SEQ ID NO: 17464 - DNA, 20 bp, Artificial
  CRISPR gRNA sequence
tagagacacaggtggtatca

SEQ ID NO: 17465 - DNA, 20 bp, Artificial
  CRISPR gRNA sequence
gacacaggtggtatcacaga

SEQ ID NO: 17466 - DNA, 20 bp, Artificial
  CRISPR gRNA sequence
acacaggtggtatcacagat

SEQ ID NO: 17467 - DNA, 20 bp, Artificial
  CRISPR gRNA sequence
cacaggtggtatcacagatg

SEQ ID NO: 17468 - DNA, 20 bp, Artificial
  CRISPR gRNA sequence
acaggtggtatcacagatgg

SEQ ID NO: 17469 - DNA, 20 bp, Artificial
  CRISPR gRNA sequence
gtggtatcacagatggggga

SEQ ID NO: 17470 - DNA, 20 bp, Artificial
  CRISPR gRNA sequence
gtatcacagatgggggatgg

SEQ ID NO: 17471 - DNA, 20 bp, Artificial
  CRISPR gRNA sequence
tatcacagatgggggatggt

SEQ ID NO: 17472 - DNA, 20 bp, Artificial
  CRISPR gRNA sequence
tcacagatgggggatggtgg

SEQ ID NO: 17473 - DNA, 20 bp, Artificial
  CRISPR gRNA sequence
cacagatgggggatggtggg

SEQ ID NO: 17474 - DNA, 20 bp, Artificial
  CRISPR gRNA sequence
acagatgggggatggtggga

SEQ ID NO: 17475 - DNA, 20 bp, Artificial
  CRISPR gRNA sequence
ggggatggtgggagggaccg

SEQ ID NO: 17476 - DNA, 20 bp, Artificial
  CRISPR gRNA sequence
gggatggtgggagggaccgc

SEQ ID NO: 17477 - DNA, 20 bp, Artificial
  CRISPR gRNA sequence
ggatggtgggagggaccgca

SEQ ID NO: 17478 - DNA, 20 bp, Artificial
  CRISPR gRNA sequence
atggtgggagggaccgcagg

SEQ ID NO: 17479 - DNA, 20 bp, Artificial
  CRISPR gRNA sequence
tggtgggagggaccgcaggg

SEQ ID NO: 17480 - DNA, 20 bp, Artificial
  CRISPR gRNA sequence
gtgggagggaccgcagggag

SEQ ID NO: 17481 - DNA, 20 bp, Artificial
  CRISPR gRNA sequence
agggaccgcagggaggagcc

SEQ ID NO: 17482 - DNA, 20 bp, Artificial
  CRISPR gRNA sequence
ggaccgcagggaggagcctg

SEQ ID NO: 17483 - DNA, 20 bp, Artificial
  CRISPR gRNA sequence
gggaggagcctggagacatt

SEQ ID NO: 17484 - DNA, 20 bp, Artificial
  CRISPR gRNA sequence
gcccacccccacttattgat

SEQ ID NO: 17485 - DNA, 20 bp, Artificial
  CRISPR gRNA sequence
atgagctctgcttcaaactc

SEQ ID NO: 17486 - DNA, 20 bp, Artificial
  CRISPR gRNA sequence
ctctggatgacactgctgtg

SEQ ID NO: 17487 - DNA, 20 bp, Artificial
  CRISPR gRNA sequence
gatgacactgctgtgtggtt

SEQ ID NO: 17488 - DNA, 20 bp, Artificial
  CRISPR gRNA sequence
ctgctgtgtggttaagcaca

SEQ ID NO: 17489 - DNA, 20 bp, Artificial
  CRISPR gRNA sequence
tgtgtggttaagcacacagt

SEQ ID NO: 17490 - DNA, 20 bp, Artificial
  CRISPR gRNA sequence
tgtggttaagcacacagtca

SEQ ID NO: 17491 - DNA, 20 bp, Artificial
  CRISPR gRNA sequence
cacagtcagagaaataaatt

SEQ ID NO: 17492 - DNA, 20 bp, Artificial
  CRISPR gRNA sequence
agtcagagaaataaattgag

SEQ ID NO: 17493 - DNA, 20 bp, Artificial
  CRISPR gRNA sequence
gtcagagaaataaattgaga

SEQ ID NO: 17494 - DNA, 20 bp, Artificial
  CRISPR gRNA sequence
tcagagaaataaattgagaa

SEQ ID NO: 17495 - DNA, 20 bp, Artificial
  CRISPR gRNA sequence
agaaataaattgagaaggga

SEQ ID NO: 17496 - DNA, 20 bp, Artificial
  CRISPR gRNA sequence
aataaattgagaagggaaag

SEQ ID NO: 17497 - DNA, 20 bp, Artificial
  CRISPR gRNA sequence
ataaattgagaagggaaaga

SEQ ID NO: 17498 - DNA, 20 bp, Artificial
  CRISPR gRNA sequence
attgagaagggaaagaaggc

SEQ ID NO: 17499 - DNA, 20 bp, Artificial
  CRISPR gRNA sequence
ggaaagaaggcaagtatcgt

SEQ ID NO: 17500 - DNA, 20 bp, Artificial
  CRISPR gRNA sequence
aaggcaagtatcgtgagctt

SEQ ID NO: 17501 - DNA, 20 bp, Artificial
  CRISPR gRNA sequence
gcgtaaaatttaccaacttt

SEQ ID NO: 17502 - DNA, 20 bp, Artificial
  CRISPR gRNA sequence
cctaccaacacactgtaacc

SEQ ID NO: 17503 - DNA, 20 bp, Artificial
  CRISPR gRNA sequence
ctaccaacacactgtaacct

SEQ ID NO: 17504 - DNA, 20 bp, Artificial
  CRISPR gRNA sequence
caacacactgtaacctgggc

SEQ ID NO: 17505 - DNA, 20 bp, Artificial
  CRISPR gRNA sequence
agttcattttttaaaccact

SEQ ID NO: 17506 - DNA, 20 bp, Artificial
  CRISPR gRNA sequence
ttcattttttaaaccacttg

SEQ ID NO: 17507 - DNA, 20 bp, Artificial
  CRISPR gRNA sequence
ttttaaaccacttggagcct

SEQ ID NO: 17508 - DNA, 20 bp, Artificial
  CRISPR gRNA sequence
tataaaatgcgaataataat

SEQ ID NO: 17509 - DNA, 20 bp, Artificial
  CRISPR gRNA sequence
aataataattggcaactcac

SEQ ID NO: 17510 - DNA, 20 bp, Artificial
  CRISPR gRNA sequence
ataataattggcaactcaca

SEQ ID NO: 17511 - DNA, 20 bp, Artificial
  CRISPR gRNA sequence
aattggcaactcacaaggat

SEQ ID NO: 17512 - DNA, 20 bp, Artificial
  CRISPR gRNA sequence
attggcaactcacaaggatt

SEQ ID NO: 17513 - DNA, 20 bp, Artificial
  CRISPR gRNA sequence
ttggcaactcacaaggatta

SEQ ID NO: 17514 - DNA, 20 bp, Artificial
  CRISPR gRNA sequence
tggcaactcacaaggattag

SEQ ID NO: 17515 - DNA, 20 bp, Artificial
  CRISPR gRNA sequence
gcaactcacaaggattaggg

SEQ ID NO: 17516 - DNA, 20 bp, Artificial
  CRISPR gRNA sequence
tcacaaggattaggggagtt

SEQ ID NO: 17517 - DNA, 20 bp, Artificial
  CRISPR gRNA sequence
attaggggagttaagtcacg

SEQ ID NO: 17518 - DNA, 20 bp, Artificial
  CRISPR gRNA sequence
taggggagttaagtcacgcg

SEQ ID NO: 17519 - DNA, 20 bp, Artificial
  CRISPR gRNA sequence
gttaagtcacgcggagccct

SEQ ID NO: 17520 - DNA, 20 bp, Artificial
  CRISPR gRNA sequence
tcacgcggagcccttagcaa

SEQ ID NO: 17521 - DNA, 20 bp, Artificial
  CRISPR gRNA sequence
cacgcggagcccttagcaat

SEQ ID NO: 17522 - DNA, 20 bp, Artificial
  CRISPR gRNA sequence
ggagcccttagcaatgggac

SEQ ID NO: 17523 - DNA, 20 bp, Artificial
  CRISPR gRNA sequence
ttagcaatgggactggcaat

SEQ ID NO: 17524 - DNA, 20 bp, Artificial
  CRISPR gRNA sequence
caatgggactggcaatcagt

SEQ ID NO: 17525 - DNA, 20 bp, Artificial
  CRISPR gRNA sequence
atcagtaagtgctgaatgaa

SEQ ID NO: 17526 - DNA, 20 bp, Artificial
  CRISPR gRNA sequence
agtaagtgctgaatgaacag

SEQ ID NO: 17527 - DNA, 20 bp, Artificial
  CRISPR gRNA sequence
tgctgaatgaacagaagttt

SEQ ID NO: 17528 - DNA, 20 bp, Artificial
  CRISPR gRNA sequence
gctgaatgaacagaagttta

SEQ ID NO: 17529 - DNA, 20 bp, Artificial
  CRISPR gRNA sequence
gaatgaacagaagtttaagg

SEQ ID NO: 17530 - DNA, 20 bp, Artificial
  CRISPR gRNA sequence
aacagaagtttaaggcagca

SEQ ID NO: 17531 - DNA, 20 bp, Artificial
  CRISPR gRNA sequence
aaggcagcacagcttctaca

SEQ ID NO: 17532 - DNA, 20 bp, Artificial
  CRISPR gRNA sequence
cagcacagcttctacatggt

SEQ ID NO: 17533 - DNA, 20 bp, Artificial
  CRISPR gRNA sequence
ggtgagtataatatgtgtga

SEQ ID NO: 17534 - DNA, 20 bp, Artificial
  CRISPR gRNA sequence
tgtgtgatggccatcattat

SEQ ID NO: 17535 - DNA, 20 bp, Artificial
  CRISPR gRNA sequence
agtttgcttcttacgtttgt

SEQ ID NO: 17536 - DNA, 20 bp, Artificial
  CRISPR gRNA sequence
tttgcttcttacgtttgtga

SEQ ID NO: 17537 - DNA, 20 bp, Artificial
  CRISPR gRNA sequence
ttacgtttgtgagagtgaca

SEQ ID NO: 17538 - DNA, 20 bp, Artificial
  CRISPR gRNA sequence
tacgtttgtgagagtgacaa

SEQ ID NO: 17539 - DNA, 20 bp, Artificial
  CRISPR gRNA sequence
acgtttgtgagagtgacaaa

SEQ ID NO: 17540 - DNA, 20 bp, Artificial
  CRISPR gRNA sequence
ctttcccttccatttcttcc

SEQ ID NO: 17541 - DNA, 20 bp, Artificial
  CRISPR gRNA sequence
tttcccttccatttcttccg

SEQ ID NO: 17542 - DNA, 20 bp, Artificial
  CRISPR gRNA sequence
ttccgaggtcaaactttgtg

SEQ ID NO: 17543 - DNA, 20 bp, Artificial
  CRISPR gRNA sequence
aggtcaaactttgtgaagcc

SEQ ID NO: 17544 - DNA, 20 bp, Artificial
  CRISPR gRNA sequence
agctttctgttcttttgcat

SEQ ID NO: 17545 - DNA, 20 bp, Artificial
  CRISPR gRNA sequence
gctttctgttcttttgcata

SEQ ID NO: 17546 - DNA, 20 bp, Artificial
  CRISPR gRNA sequence
ctttctgttcttttgcataa

SEQ ID NO: 17547 - DNA, 20 bp, Artificial
  CRISPR gRNA sequence
tttctgttcttttgcataag

SEQ ID NO: 17548 - DNA, 20 bp, Artificial
  CRISPR gRNA sequence
ttttgcataaggggaccctg

SEQ ID NO: 17549 - DNA, 20 bp, Artificial
  CRISPR gRNA sequence
aggggaccctgcagacttca

SEQ ID NO: 17550 - DNA, 20 bp, Artificial
  CRISPR gRNA sequence
ggggaccctgcagacttcat

SEQ ID NO: 17551 - DNA, 20 bp, Artificial
  CRISPR gRNA sequence
cctgcagacttcataggaac

SEQ ID NO: 17552 - DNA, 20 bp, Artificial
  CRISPR gRNA sequence
gcagacttcataggaacaag

SEQ ID NO: 17553 - DNA, 20 bp, Artificial
  CRISPR gRNA sequence
cagacttcataggaacaaga

SEQ ID NO: 17554 - DNA, 20 bp, Artificial
  CRISPR gRNA sequence
agacttcataggaacaagaa

SEQ ID NO: 17555 - DNA, 20 bp, Artificial
  CRISPR gRNA sequence
taggaacaagaagggcccca

SEQ ID NO: 17556 - DNA, 20 bp, Artificial
  CRISPR gRNA sequence
aggaacaagaagggccccat

SEQ ID NO: 17557 - DNA, 20 bp, Artificial
  CRISPR gRNA sequence
acaagaagggccccataggc

SEQ ID NO: 17558 - DNA, 20 bp, Artificial
  CRISPR gRNA sequence
caagaagggccccataggcc

SEQ ID NO: 17559 - DNA, 20 bp, Artificial
  CRISPR gRNA sequence
agggccccataggccgggca

SEQ ID NO: 17560 - DNA, 20 bp, Artificial
  CRISPR gRNA sequence
gccccataggccgggcatgg

SEQ ID NO: 17561 - DNA, 20 bp, Artificial
  CRISPR gRNA sequence
ggcatggtggctcacatctg

SEQ ID NO: 17562 - DNA, 20 bp, Artificial
  CRISPR gRNA sequence
gctcacatctgtagaaattc

SEQ ID NO: 17563 - DNA, 20 bp, Artificial
  CRISPR gRNA sequence
ctgtagaaattccagcactt

SEQ ID NO: 17564 - DNA, 20 bp, Artificial
  CRISPR gRNA sequence
tgtagaaattccagcacttt

SEQ ID NO: 17565 - DNA, 20 bp, Artificial
  CRISPR gRNA sequence
tagaaattccagcactttgg

SEQ ID NO: 17566 - DNA, 20 bp, Artificial
  CRISPR gRNA sequence
ttccagcactttgggagtcc

SEQ ID NO: 17567 - DNA, 20 bp, Artificial
  CRISPR gRNA sequence
tccagcactttgggagtcca

SEQ ID NO: 17568 - DNA, 20 bp, Artificial
  CRISPR gRNA sequence
agcactttgggagtccaagg

SEQ ID NO: 17569 - DNA, 20 bp, Artificial
  CRISPR gRNA sequence
gcactttgggagtccaaggc

SEQ ID NO: 17570 - DNA, 20 bp, Artificial
  CRISPR gRNA sequence
actttgggagtccaaggcag

SEQ ID NO: 17571 - DNA, 20 bp, Artificial
  CRISPR gRNA sequence
ccaaggcaggagtatcacct

SEQ ID NO: 17572 - DNA, 20 bp, Artificial
  CRISPR gRNA sequence
gcaggagtatcacctcagtc

SEQ ID NO: 17573 - DNA, 20 bp, Artificial
  CRISPR gRNA sequence
caggagtatcacctcagtcc

SEQ ID NO: 17574 - DNA, 20 bp, Artificial
  CRISPR gRNA sequence
ggagtatcacctcagtccag

SEQ ID NO: 17575 - DNA, 20 bp, Artificial
  CRISPR gRNA sequence
tcacctcagtccaggagttt

SEQ ID NO: 17576 - DNA, 20 bp, Artificial
  CRISPR gRNA sequence
tcagtccaggagtttgagac

SEQ ID NO: 17577 - DNA, 20 bp, Artificial
  CRISPR gRNA sequence
ccaggagtttgagaccagcc

SEQ ID NO: 17578 - DNA, 20 bp, Artificial
  CRISPR gRNA sequence
caggagtttgagaccagcct

SEQ ID NO: 17579 - DNA, 20 bp, Artificial
  CRISPR gRNA sequence
tgagaccagcctgggcaaca

SEQ ID NO: 17580 - DNA, 20 bp, Artificial
  CRISPR gRNA sequence
ccagcctgggcaacatggtg

SEQ ID NO: 17581 - DNA, 20 bp, Artificial
  CRISPR gRNA sequence
tctacaaataacacaaaact

SEQ ID NO: 17582 - DNA, 20 bp, Artificial
  CRISPR gRNA sequence
caaataacacaaaacttagc

SEQ ID NO: 17583 - DNA, 20 bp, Artificial
  CRISPR gRNA sequence
aaataacacaaaacttagct

SEQ ID NO: 17584 - DNA, 20 bp, Artificial
  CRISPR gRNA sequence
acacaaaacttagctgggcg

SEQ ID NO: 17585 - DNA, 20 bp, Artificial
  CRISPR gRNA sequence
ggcgtggtgatgtgcatctg

SEQ ID NO: 17586 - DNA, 20 bp, Artificial
  CRISPR gRNA sequence
gtgatgtgcatctgtagaac

SEQ ID NO: 17587 - DNA, 20 bp, Artificial
  CRISPR gRNA sequence
catctgtagaaccagctact

SEQ ID NO: 17588 - DNA, 20 bp, Artificial
  CRISPR gRNA sequence
atctgtagaaccagctactc

SEQ ID NO: 17589 - DNA, 20 bp, Artificial
  CRISPR gRNA sequence
ctgtagaaccagctactcag

SEQ ID NO: 17590 - DNA, 20 bp, Artificial
  CRISPR gRNA sequence
tgtagaaccagctactcagg

SEQ ID NO: 17591 - DNA, 20 bp, Artificial
  CRISPR gRNA sequence
aaccagctactcaggaggct

SEQ ID NO: 17592 - DNA, 20 bp, Artificial
  CRISPR gRNA sequence
accagctactcaggaggctg

SEQ ID NO: 17593 - DNA, 20 bp, Artificial
  CRISPR gRNA sequence
agctactcaggaggctgagg

SEQ ID NO: 17594 - DNA, 20 bp, Artificial
  CRISPR gRNA sequence
gctactcaggaggctgaggt

SEQ ID NO: 17595 - DNA, 20 bp, Artificial
  CRISPR gRNA sequence
tactcaggaggctgaggtgg

SEQ ID NO: 17596 - DNA, 20 bp, Artificial
  CRISPR gRNA sequence
actcaggaggctgaggtggg

SEQ ID NO: 17597 - DNA, 20 bp, Artificial
  CRISPR gRNA sequence
aggaggctgaggtgggagga

SEQ ID NO: 17598 - DNA, 20 bp, Artificial
  CRISPR gRNA sequence
ctgaggtgggaggatagctt

SEQ ID NO: 17599 - DNA, 20 bp, Artificial
  CRISPR gRNA sequence
gtgggaggatagcttgagcc

SEQ ID NO: 17600 - DNA, 20 bp, Artificial
  CRISPR gRNA sequence
tgggaggatagcttgagcct

SEQ ID NO: 17601 - DNA, 20 bp, Artificial
  CRISPR gRNA sequence
gggaggatagcttgagcctg

SEQ ID NO: 17602 - DNA, 20 bp, Artificial
  CRISPR gRNA sequence
gaggatagcttgagcctggg

SEQ ID NO: 17603 - DNA, 20 bp, Artificial
  CRISPR gRNA sequence
aggatagcttgagcctgggg

SEQ ID NO: 17604 - DNA, 20 bp, Artificial
  CRISPR gRNA sequence
cttgagcctggggaggtgtc

SEQ ID NO: 17605 - DNA, 20 bp, Artificial
  CRISPR gRNA sequence
ttgagcctggggaggtgtca

SEQ ID NO: 17606 - DNA, 20 bp, Artificial
  CRISPR gRNA sequence
ctggggaggtgtcaaggctg

SEQ ID NO: 17607 - DNA, 20 bp, Artificial
  CRISPR gRNA sequence
tgtcaaggctgcagtgaact

SEQ ID NO: 17608 - DNA, 20 bp, Artificial
  CRISPR gRNA sequence
gagattgcaccactgcactc

SEQ ID NO: 17609 - DNA, 20 bp, Artificial
  CRISPR gRNA sequence
tgcaccactgcactccagcc

SEQ ID NO: 17610 - DNA, 20 bp, Artificial
  CRISPR gRNA sequence
gcaccactgcactccagcct

SEQ ID NO: 17611 - DNA, 20 bp, Artificial
  CRISPR gRNA sequence
ctgcactccagcctgggtga

SEQ ID NO: 17612 - DNA, 20 bp, Artificial
  CRISPR gRNA sequence
gcactccagcctgggtgata

SEQ ID NO: 17613 - DNA, 20 bp, Artificial
  CRISPR gRNA sequence
tccagcctgggtgatagagc

SEQ ID NO: 17614 - DNA, 20 bp, Artificial
  CRISPR gRNA sequence
gatagagccagactgtgtct

SEQ ID NO: 17615 - DNA, 20 bp, Artificial
  CRISPR gRNA sequence
tgtgtctcagaaaaaaaaaa

SEQ ID NO: 17616 - DNA, 20 bp, Artificial
  CRISPR gRNA sequence
gtgtctcagaaaaaaaaaaa

SEQ ID NO: 17617 - DNA, 20 bp, Artificial
  CRISPR gRNA sequence
aaaaaaaaaaaaggccccca

SEQ ID NO: 17618 - DNA, 20 bp, Artificial
  CRISPR gRNA sequence
aaaaaaaaggcccccacagc

SEQ ID NO: 17619 - DNA, 20 bp, Artificial
  CRISPR gRNA sequence
aaaaaggcccccacagccag

SEQ ID NO: 17620 - DNA, 20 bp, Artificial
  CRISPR gRNA sequence
aaaaggcccccacagccagc

SEQ ID NO: 17621 - DNA, 20 bp, Artificial
  CRISPR gRNA sequence
aaaggcccccacagccagca

SEQ ID NO: 17622 - DNA, 20 bp, Artificial
  CRISPR gRNA sequence
ggcccccacagccagcaggg

SEQ ID NO: 17623 - DNA, 20 bp, Artificial
  CRISPR gRNA sequence
ccacagccagcagggcagct

SEQ ID NO: 17624 - DNA, 20 bp, Artificial
  CRISPR gRNA sequence
agccagcagggcagcttgga

SEQ ID NO: 17625 - DNA, 20 bp, Artificial
  CRISPR gRNA sequence
gcagggcagcttggatggtc

SEQ ID NO: 17626 - DNA, 20 bp, Artificial
  CRISPR gRNA sequence
cgctccccatcaccaccact

SEQ ID NO: 17627 - DNA, 20 bp, Artificial
  CRISPR gRNA sequence
tccccatcaccaccactgag

SEQ ID NO: 17628 - DNA, 20 bp, Artificial
  CRISPR gRNA sequence
accaccactgagaagttgcc

SEQ ID NO: 17629 - DNA, 20 bp, Artificial
  CRISPR gRNA sequence
ccaccactgagaagttgcct

SEQ ID NO: 17630 - DNA, 20 bp, Artificial
  CRISPR gRNA sequence
tgagaagttgcctgggcaaa

SEQ ID NO: 17631 - DNA, 20 bp, Artificial
  CRISPR gRNA sequence
ttgcctgggcaaaaagtcac

SEQ ID NO: 17632 - DNA, 20 bp, Artificial
  CRISPR gRNA sequence
gcctgggcaaaaagtcacca

SEQ ID NO: 17633 - DNA, 20 bp, Artificial
  CRISPR gRNA sequence
cctgggcaaaaagtcaccag

SEQ ID NO: 17634 - DNA, 20 bp, Artificial
  CRISPR gRNA sequence
ctgggcaaaaagtcaccaga

SEQ ID NO: 17635 - DNA, 20 bp, Artificial
  CRISPR gRNA sequence
aaaaagtcaccagagggcct

SEQ ID NO: 17636 - DNA, 20 bp, Artificial
  CRISPR gRNA sequence
gggcctaagatctgcgtcat

SEQ ID NO: 17637 - DNA, 20 bp, Artificial
  CRISPR gRNA sequence
tctgcgtcattggctcaacc

SEQ ID NO: 17638 - DNA, 20 bp, Artificial
  CRISPR gRNA sequence
gtcattggctcaacctggac

SEQ ID NO: 17639 - DNA, 20 bp, Artificial
  CRISPR gRNA sequence
attggctcaacctggacaag

SEQ ID NO: 17640 - DNA, 20 bp, Artificial
  CRISPR gRNA sequence
gacaagaagaaaccccctcc

SEQ ID NO: 17641 - DNA, 20 bp, Artificial
  CRISPR gRNA sequence
aagaagaaaccccctcccag

SEQ ID NO: 17642 - DNA, 20 bp, Artificial
  CRISPR gRNA sequence
gaagcccccaatacacattt

SEQ ID NO: 17643 - DNA, 20 bp, Artificial
  CRISPR gRNA sequence
gccccacttcctgcttccct

SEQ ID NO: 17644 - DNA, 20 bp, Artificial
  CRISPR gRNA sequence
ttcctgcttccctaagactg

SEQ ID NO: 17645 - DNA, 20 bp, Artificial
  CRISPR gRNA sequence
aagactgaagcctgcacctt

SEQ ID NO: 17646 - DNA, 20 bp, Artificial
  CRISPR gRNA sequence
gcaccttaagcacttcctct

SEQ ID NO: 17647 - DNA, 20 bp, Artificial
  CRISPR gRNA sequence
caccttaagcacttcctctt

SEQ ID NO: 17648 - DNA, 20 bp, Artificial
  CRISPR gRNA sequence
gcacttcctcttgggtgatc

SEQ ID NO: 17649 - DNA, 20 bp, Artificial
  CRISPR gRNA sequence
cacttcctcttgggtgatca

SEQ ID NO: 17650 - DNA, 20 bp, Artificial
  CRISPR gRNA sequence
cttgggtgatcaaggatttg

SEQ ID NO: 17651 - DNA, 20 bp, Artificial
  CRISPR gRNA sequence
gatcaaggatttgcagctca

SEQ ID NO: 17652 - DNA, 20 bp, Artificial
  CRISPR gRNA sequence
caaggatttgcagctcacag

SEQ ID NO: 17653 - DNA, 20 bp, Artificial
  CRISPR gRNA sequence
ctccatcctccacaccatct

SEQ ID NO: 17654 - DNA, 20 bp, Artificial
  CRISPR gRNA sequence
acaccatctgagttcccaaa

SEQ ID NO: 17655 - DNA, 20 bp, Artificial
  CRISPR gRNA sequence
tctgagttcccaaaaagctc

SEQ ID NO: 17656 - DNA, 20 bp, Artificial
  CRISPR gRNA sequence
ctgagttcccaaaaagctct

SEQ ID NO: 17657 - DNA, 20 bp, Artificial
  CRISPR gRNA sequence
tgagttcccaaaaagctctg

SEQ ID NO: 17658 - DNA, 20 bp, Artificial
  CRISPR gRNA sequence
tcccaaaaagctctggggaa

SEQ ID NO: 17659 - DNA, 20 bp, Artificial
  CRISPR gRNA sequence
cccaaaaagctctggggaaa

SEQ ID NO: 17660 - DNA, 20 bp, Artificial
  CRISPR gRNA sequence
aaaaagctctggggaaaagg

SEQ ID NO: 17661 - DNA, 20 bp, Artificial
  CRISPR gRNA sequence
aaaagctctggggaaaaggc

SEQ ID NO: 17662 - DNA, 20 bp, Artificial
  CRISPR gRNA sequence
aaagctctggggaaaaggca

SEQ ID NO: 17663 - DNA, 20 bp, Artificial
  CRISPR gRNA sequence
gctctggggaaaaggcaggg

SEQ ID NO: 17664 - DNA, 20 bp, Artificial
  CRISPR gRNA sequence
tctggggaaaaggcagggta

SEQ ID NO: 17665 - DNA, 20 bp, Artificial
  CRISPR gRNA sequence
gtagagtgttatgcccattt

SEQ ID NO: 17666 - DNA, 20 bp, Artificial
  CRISPR gRNA sequence
gtgttatgcccatttgagct

SEQ ID NO: 17667 - DNA, 20 bp, Artificial
  CRISPR gRNA sequence
gttatgcccatttgagctta

SEQ ID NO: 17668 - DNA, 20 bp, Artificial
  CRISPR gRNA sequence
ttatgcccatttgagcttag

SEQ ID NO: 17669 - DNA, 20 bp, Artificial
  CRISPR gRNA sequence
atgcccatttgagcttagag

SEQ ID NO: 17670 - DNA, 20 bp, Artificial
  CRISPR gRNA sequence
tgcccatttgagcttagagg

SEQ ID NO: 17671 - DNA, 20 bp, Artificial
  CRISPR gRNA sequence
tagaggaggttcacacgcct

SEQ ID NO: 17672 - DNA, 20 bp, Artificial
  CRISPR gRNA sequence
gttcacacgcctcagtgaaa

SEQ ID NO: 17673 - DNA, 20 bp, Artificial
  CRISPR gRNA sequence
ctcagtgaaatggcttgtcc

SEQ ID NO: 17674 - DNA, 20 bp, Artificial
  CRISPR gRNA sequence
tcagtgaaatggcttgtcca

SEQ ID NO: 17675 - DNA, 20 bp, Artificial
  CRISPR gRNA sequence
atggcttgtccaaggtcatg

SEQ ID NO: 17676 - DNA, 20 bp, Artificial
  CRISPR gRNA sequence
ttgtccaaggtcatgtggtt

SEQ ID NO: 17677 - DNA, 20 bp, Artificial
  CRISPR gRNA sequence
tgtccaaggtcatgtggttt

SEQ ID NO: 17678 - DNA, 20 bp, Artificial
  CRISPR gRNA sequence
tccaaggtcatgtggtttag

SEQ ID NO: 17679 - DNA, 20 bp, Artificial
  CRISPR gRNA sequence
aggagcttgcatctgaattc

SEQ ID NO: 17680 - DNA, 20 bp, Artificial
  CRISPR gRNA sequence
gaattctggctgtgatgcct

SEQ ID NO: 17681 - DNA, 20 bp, Artificial
  CRISPR gRNA sequence
ctggctgtgatgccttagcc

SEQ ID NO: 17682 - DNA, 20 bp, Artificial
  CRISPR gRNA sequence
cacttgacctctctgaacat

SEQ ID NO: 17683 - DNA, 20 bp, Artificial
  CRISPR gRNA sequence
aacatcagttttcccaatat

SEQ ID NO: 17684 - DNA, 20 bp, Artificial
  CRISPR gRNA sequence
agttttcccaatattagttc

SEQ ID NO: 17685 - DNA, 20 bp, Artificial
  CRISPR gRNA sequence
ttttcccaatattagttctg

SEQ ID NO: 17686 - DNA, 20 bp, Artificial
  CRISPR gRNA sequence
aatattagttctggagaatg

SEQ ID NO: 17687 - DNA, 20 bp, Artificial
  CRISPR gRNA sequence
ggagaatgaagattgccttg

SEQ ID NO: 17688 - DNA, 20 bp, Artificial
  CRISPR gRNA sequence
tgccttgcagcccaccactg

SEQ ID NO: 17689 - DNA, 20 bp, Artificial
  CRISPR gRNA sequence
gccttgcagcccaccactgt

SEQ ID NO: 17690 - DNA, 20 bp, Artificial
  CRISPR gRNA sequence
cttgcagcccaccactgtgg

SEQ ID NO: 17691 - DNA, 20 bp, Artificial
  CRISPR gRNA sequence
ttgcagcccaccactgtggg

SEQ ID NO: 17692 - DNA, 20 bp, Artificial
  CRISPR gRNA sequence
gcccaccactgtgggaggcc

SEQ ID NO: 17693 - DNA, 20 bp, Artificial
  CRISPR gRNA sequence
cccaccactgtgggaggccg

SEQ ID NO: 17694 - DNA, 20 bp, Artificial
  CRISPR gRNA sequence
accactgtgggaggccgagg

SEQ ID NO: 17695 - DNA, 20 bp, Artificial
  CRISPR gRNA sequence
ccactgtgggaggccgaggc

SEQ ID NO: 17696 - DNA, 20 bp, Artificial
  CRISPR gRNA sequence
ctgtgggaggccgaggcagg

SEQ ID NO: 17697 - DNA, 20 bp, Artificial
  CRISPR gRNA sequence
ccgaggcaggcagatcactt

SEQ ID NO: 17698 - DNA, 20 bp, Artificial
  CRISPR gRNA sequence
cgaggcaggcagatcacttg

SEQ ID NO: 17699 - DNA, 20 bp, Artificial
  CRISPR gRNA sequence
gcaggcagatcacttgaggt

SEQ ID NO: 17700 - DNA, 20 bp, Artificial
  CRISPR gRNA sequence
caggcagatcacttgaggtc

SEQ ID NO: 17701 - DNA, 20 bp, Artificial
  CRISPR gRNA sequence
ggcagatcacttgaggtcag

SEQ ID NO: 17702 - DNA, 20 bp, Artificial
  CRISPR gRNA sequence
tcacttgaggtcaggagttt

SEQ ID NO: 17703 - DNA, 20 bp, Artificial
  CRISPR gRNA sequence
tgaggtcaggagtttgagac

SEQ ID NO: 17704 - DNA, 20 bp, Artificial
  CRISPR gRNA sequence
tcaggagtttgagaccagcc

SEQ ID NO: 17705 - DNA, 20 bp, Artificial
  CRISPR gRNA sequence
caggagtttgagaccagccc

SEQ ID NO: 17706 - DNA, 20 bp, Artificial
  CRISPR gRNA sequence
tgagaccagcccgggcaaca

SEQ ID NO: 17707 - DNA, 20 bp, Artificial
  CRISPR gRNA sequence
ctctactaaaaatacaaaat

SEQ ID NO: 17708 - DNA, 20 bp, Artificial
  CRISPR gRNA sequence
actaaaaatacaaaattagc

SEQ ID NO: 17709 - DNA, 20 bp, Artificial
  CRISPR gRNA sequence
ctaaaaatacaaaattagcc

SEQ ID NO: 17710 - DNA, 20 bp, Artificial
  CRISPR gRNA sequence
aatacaaaattagccaggca

SEQ ID NO: 17711 - DNA, 20 bp, Artificial
  CRISPR gRNA sequence
acaaaattagccaggcatgg

SEQ ID NO: 17712 - DNA, 20 bp, Artificial
  CRISPR gRNA sequence
gtggcgtgcttctgtaatcc

SEQ ID NO: 17713 - DNA, 20 bp, Artificial
  CRISPR gRNA sequence
cttctgtaatcccagctact

SEQ ID NO: 17714 - DNA, 20 bp, Artificial
  CRISPR gRNA sequence
ttctgtaatcccagctactt

SEQ ID NO: 17715 - DNA, 20 bp, Artificial
  CRISPR gRNA sequence
ctgtaatcccagctacttgg

SEQ ID NO: 17716 - DNA, 20 bp, Artificial
  CRISPR gRNA sequence
tgtaatcccagctacttggg

SEQ ID NO: 17717 - DNA, 20 bp, Artificial
  CRISPR gRNA sequence
tcccagctacttgggaggct

SEQ ID NO: 17718 - DNA, 20 bp, Artificial
  CRISPR gRNA sequence
cccagctacttgggaggctg

SEQ ID NO: 17719 - DNA, 20 bp, Artificial
  CRISPR gRNA sequence
agctacttgggaggctgagg

SEQ ID NO: 17720 - DNA, 20 bp, Artificial
  CRISPR gRNA sequence
gctacttgggaggctgaggc

SEQ ID NO: 17721 - DNA, 20 bp, Artificial
  CRISPR gRNA sequence
tacttgggaggctgaggcag

SEQ ID NO: 17722 - DNA, 20 bp, Artificial
  CRISPR gRNA sequence
gcaggagaatcgcttgaacc

SEQ ID NO: 17723 - DNA, 20 bp, Artificial
  CRISPR gRNA sequence
caggagaatcgcttgaacct

SEQ ID NO: 17724 - DNA, 20 bp, Artificial
  CRISPR gRNA sequence
ggagaatcgcttgaacctgg

SEQ ID NO: 17725 - DNA, 20 bp, Artificial
  CRISPR gRNA sequence
gagaatcgcttgaacctggg

SEQ ID NO: 17726 - DNA, 20 bp, Artificial
  CRISPR gRNA sequence
aatcgcttgaacctgggagg

SEQ ID NO: 17727 - DNA, 20 bp, Artificial
  CRISPR gRNA sequence
tcgcttgaacctgggaggca

SEQ ID NO: 17728 - DNA, 20 bp, Artificial
  CRISPR gRNA sequence
cgcttgaacctgggaggcag

SEQ ID NO: 17729 - DNA, 20 bp, Artificial
  CRISPR gRNA sequence
aacctgggaggcagaggctg

SEQ ID NO: 17730 - DNA, 20 bp, Artificial
  CRISPR gRNA sequence
ggcagaggctgcagtgaacc

SEQ ID NO: 17731 - DNA, 20 bp, Artificial
  CRISPR gRNA sequence
aagactgcgccactgcactc

SEQ ID NO: 17732 - DNA, 20 bp, Artificial
  CRISPR gRNA sequence
tgcgccactgcactccagcc

SEQ ID NO: 17733 - DNA, 20 bp, Artificial
  CRISPR gRNA sequence
gcgccactgcactccagcct

SEQ ID NO: 17734 - DNA, 20 bp, Artificial
  CRISPR gRNA sequence
gcactccagcctgggcgaca

SEQ ID NO: 17735 - DNA, 20 bp, Artificial
  CRISPR gRNA sequence
tccagcctgggcgacaaagt

SEQ ID NO: 17736 - DNA, 20 bp, Artificial
  CRISPR gRNA sequence
acaaaaaacaaaaaacaaaa

SEQ ID NO: 17737 - DNA, 20 bp, Artificial
  CRISPR gRNA sequence
aaacaaaaaagattgtcctg

SEQ ID NO: 17738 - DNA, 20 bp, Artificial
  CRISPR gRNA sequence
aacaaaaaagattgtcctgc

SEQ ID NO: 17739 - DNA, 20 bp, Artificial
  CRISPR gRNA sequence
agattgtcctgcaggatcat

SEQ ID NO: 17740 - DNA, 20 bp, Artificial
  CRISPR gRNA sequence
ttgtcctgcaggatcatcag

SEQ ID NO: 17741 - DNA, 20 bp, Artificial
  CRISPR gRNA sequence
tgtcctgcaggatcatcaga

SEQ ID NO: 17742 - DNA, 20 bp, Artificial
  CRISPR gRNA sequence
tgcaggatcatcagaaggcc

SEQ ID NO: 17743 - DNA, 20 bp, Artificial
  CRISPR gRNA sequence
gcaggatcatcagaaggcca

SEQ ID NO: 17744 - DNA, 20 bp, Artificial
  CRISPR gRNA sequence
caggatcatcagaaggccaa

SEQ ID NO: 17745 - DNA, 20 bp, Artificial
  CRISPR gRNA sequence
ggatcatcagaaggccaagg

SEQ ID NO: 17746 - DNA, 20 bp, Artificial
  CRISPR gRNA sequence
aaggccaagggagttctgtg

SEQ ID NO: 17747 - DNA, 20 bp, Artificial
  CRISPR gRNA sequence
aggccaagggagttctgtgt

SEQ ID NO: 17748 - DNA, 20 bp, Artificial
  CRISPR gRNA sequence
ggccaagggagttctgtgtg

SEQ ID NO: 17749 - DNA, 20 bp, Artificial
  CRISPR gRNA sequence
gggagttctgtgtggggtgc

SEQ ID NO: 17750 - DNA, 20 bp, Artificial
  CRISPR gRNA sequence
tgtgtggggtgccagctatg

SEQ ID NO: 17751 - DNA, 20 bp, Artificial
  CRISPR gRNA sequence
gtgtggggtgccagctatgt

SEQ ID NO: 17752 - DNA, 20 bp, Artificial
  CRISPR gRNA sequence
tggggtgccagctatgtggg

SEQ ID NO: 17753 - DNA, 20 bp, Artificial
  CRISPR gRNA sequence
ccagctatgtgggaagccta

SEQ ID NO: 17754 - DNA, 20 bp, Artificial
  CRISPR gRNA sequence
atgtgggaagcctacagtca

SEQ ID NO: 17755 - DNA, 20 bp, Artificial
  CRISPR gRNA sequence
tgtgggaagcctacagtcaa

SEQ ID NO: 17756 - DNA, 20 bp, Artificial
  CRISPR gRNA sequence
gggaagcctacagtcaaagg

SEQ ID NO: 17757 - DNA, 20 bp, Artificial
  CRISPR gRNA sequence
tcaaaggaagcccattacat

SEQ ID NO: 17758 - DNA, 20 bp, Artificial
  CRISPR gRNA sequence
aaaggaagcccattacatta

SEQ ID NO: 17759 - DNA, 20 bp, Artificial
  CRISPR gRNA sequence
aaggaagcccattacattag

SEQ ID NO: 17760 - DNA, 20 bp, Artificial
  CRISPR gRNA sequence
aggaagcccattacattaga

SEQ ID NO: 17761 - DNA, 20 bp, Artificial
  CRISPR gRNA sequence
cattacattagagggtgtca

SEQ ID NO: 17762 - DNA, 20 bp, Artificial
  CRISPR gRNA sequence
agggtgtcaaagctgaaatt

SEQ ID NO: 17763 - DNA, 20 bp, Artificial
  CRISPR gRNA sequence
gggtgtcaaagctgaaattc

SEQ ID NO: 17764 - DNA, 20 bp, Artificial
  CRISPR gRNA sequence
caaagctgaaattcaggccc

SEQ ID NO: 17765 - DNA, 20 bp, Artificial
  CRISPR gRNA sequence
gaaattcaggcccaagactc

SEQ ID NO: 17766 - DNA, 20 bp, Artificial
  CRISPR gRNA sequence
aaattcaggcccaagactct

SEQ ID NO: 17767 - DNA, 20 bp, Artificial
  CRISPR gRNA sequence
taggtttccccacaacgcca

SEQ ID NO: 17768 - DNA, 20 bp, Artificial
  CRISPR gRNA sequence
acaacgccacagctgcctcc

SEQ ID NO: 17769 - DNA, 20 bp, Artificial
  CRISPR gRNA sequence
agctgcctcccagtcacacc

SEQ ID NO: 17770 - DNA, 20 bp, Artificial
  CRISPR gRNA sequence
accaagatctacttgaatct

SEQ ID NO: 17771 - DNA, 20 bp, Artificial
  CRISPR gRNA sequence
gatctacttgaatcttggca

SEQ ID NO: 17772 - DNA, 20 bp, Artificial
  CRISPR gRNA sequence
atctacttgaatcttggcat

SEQ ID NO: 17773 - DNA, 20 bp, Artificial
  CRISPR gRNA sequence
atgggaccttcctctatccc

SEQ ID NO: 17774 - DNA, 20 bp, Artificial
  CRISPR gRNA sequence
gggaccttcctctatcccca

SEQ ID NO: 17775 - DNA, 20 bp, Artificial
  CRISPR gRNA sequence
cttcctctatccccagagcc

SEQ ID NO: 17776 - DNA, 20 bp, Artificial
  CRISPR gRNA sequence
agccaagtttcctatgtcta

SEQ ID NO: 17777 - DNA, 20 bp, Artificial
  CRISPR gRNA sequence
ttcctatgtctatagatgct

SEQ ID NO: 17778 - DNA, 20 bp, Artificial
  CRISPR gRNA sequence
tcctatgtctatagatgctt

SEQ ID NO: 17779 - DNA, 20 bp, Artificial
  CRISPR gRNA sequence
tatgtctatagatgcttagg

SEQ ID NO: 17780 - DNA, 20 bp, Artificial
  CRISPR gRNA sequence
gatgcttaggaagtgcttca

SEQ ID NO: 17781 - DNA, 20 bp, Artificial
  CRISPR gRNA sequence
atgcttaggaagtgcttcaa

SEQ ID NO: 17782 - DNA, 20 bp, Artificial
  CRISPR gRNA sequence
tgcttcaaaggccccttcat

SEQ ID NO: 17783 - DNA, 20 bp, Artificial
  CRISPR gRNA sequence
gtttctccaaaccacattgc

SEQ ID NO: 17784 - DNA, 20 bp, Artificial
  CRISPR gRNA sequence
ttctccaaaccacattgcca

SEQ ID NO: 17785 - DNA, 20 bp, Artificial
  CRISPR gRNA sequence
tccaaaccacattgccagag

SEQ ID NO: 17786 - DNA, 20 bp, Artificial
  CRISPR gRNA sequence
ccaaaccacattgccagagc

SEQ ID NO: 17787 - DNA, 20 bp, Artificial
  CRISPR gRNA sequence
accacattgccagagcggga

SEQ ID NO: 17788 - DNA, 20 bp, Artificial
  CRISPR gRNA sequence
cacattgccagagcgggatg

SEQ ID NO: 17789 - DNA, 20 bp, Artificial
  CRISPR gRNA sequence
acattgccagagcgggatgg

SEQ ID NO: 17790 - DNA, 20 bp, Artificial
  CRISPR gRNA sequence
cattgccagagcgggatgga

SEQ ID NO: 17791 - DNA, 20 bp, Artificial
  CRISPR gRNA sequence
ccagagcgggatggagggaa

SEQ ID NO: 17792 - DNA, 20 bp, Artificial
  CRISPR gRNA sequence
agcgggatggagggaaaaga

SEQ ID NO: 17793 - DNA, 20 bp, Artificial
  CRISPR gRNA sequence
agatggccctgatcatcccg

SEQ ID NO: 17794 - DNA, 20 bp, Artificial
  CRISPR gRNA sequence
tggccctgatcatcccgtgg

SEQ ID NO: 17795 - DNA, 20 bp, Artificial
  CRISPR gRNA sequence
ggccctgatcatcccgtggc

SEQ ID NO: 17796 - DNA, 20 bp, Artificial
  CRISPR gRNA sequence
ccctgatcatcccgtggcag

SEQ ID NO: 17797 - DNA, 20 bp, Artificial
  CRISPR gRNA sequence
ctgatcatcccgtggcagga

SEQ ID NO: 17798 - DNA, 20 bp, Artificial
  CRISPR gRNA sequence
gatcatcccgtggcaggaga

SEQ ID NO: 17799 - DNA, 20 bp, Artificial
  CRISPR gRNA sequence
tcatcccgtggcaggagaga

SEQ ID NO: 17800 - DNA, 20 bp, Artificial
  CRISPR gRNA sequence
tggcaggagagagagccctt

SEQ ID NO: 17801 - DNA, 20 bp, Artificial
  CRISPR gRNA sequence
agagcccttcagctctccct

SEQ ID NO: 17802 - DNA, 20 bp, Artificial
  CRISPR gRNA sequence
gagcccttcagctctccctg

SEQ ID NO: 17803 - DNA, 20 bp, Artificial
  CRISPR gRNA sequence
agcccttcagctctccctga

SEQ ID NO: 17804 - DNA, 20 bp, Artificial
  CRISPR gRNA sequence
ccttcagctctccctgaggg

SEQ ID NO: 17805 - DNA, 20 bp, Artificial
  CRISPR gRNA sequence
cttcagctctccctgagggc

SEQ ID NO: 17806 - DNA, 20 bp, Artificial
  CRISPR gRNA sequence
ttcagctctccctgagggca

SEQ ID NO: 17807 - DNA, 20 bp, Artificial
  CRISPR gRNA sequence
gggcagggactgtatccctc

SEQ ID NO: 17808 - DNA, 20 bp, Artificial
  CRISPR gRNA sequence
ccctctagctcaccttctcc

SEQ ID NO: 17809 - DNA, 20 bp, Artificial
  CRISPR gRNA sequence
gctcaccttctcccagctct

SEQ ID NO: 17810 - DNA, 20 bp, Artificial
  CRISPR gRNA sequence
tctcagcatgtttctgcgca

SEQ ID NO: 17811 - DNA, 20 bp, Artificial
  CRISPR gRNA sequence
cagcatgtttctgcgcatgg

SEQ ID NO: 17812 - DNA, 20 bp, Artificial
  CRISPR gRNA sequence
tggcagcctctcttcatccg

SEQ ID NO: 17813 - DNA, 20 bp, Artificial
  CRISPR gRNA sequence
cttcatccgtggcaatgata

SEQ ID NO: 17814 - DNA, 20 bp, Artificial
  CRISPR gRNA sequence
ccgtggcaatgatatagaac

SEQ ID NO: 17815 - DNA, 20 bp, Artificial
  CRISPR gRNA sequence
tgatatagaactagaattca

SEQ ID NO: 17816 - DNA, 20 bp, Artificial
  CRISPR gRNA sequence
gaactagaattcacagtgtc

SEQ ID NO: 17817 - DNA, 20 bp, Artificial
  CRISPR gRNA sequence
tagaattcacagtgtccagc

SEQ ID NO: 17818 - DNA, 20 bp, Artificial
  CRISPR gRNA sequence
tcacagtgtccagcaagtgc

SEQ ID NO: 17819 - DNA, 20 bp, Artificial
  CRISPR gRNA sequence
cacagtgtccagcaagtgcc

SEQ ID NO: 17820 - DNA, 20 bp, Artificial
  CRISPR gRNA sequence
gtaccaaatgacatgactcg

SEQ ID NO: 17821 - DNA, 20 bp, Artificial
  CRISPR gRNA sequence
taccaaatgacatgactcgt

SEQ ID NO: 17822 - DNA, 20 bp, Artificial
  CRISPR gRNA sequence
ctcgtaggcattaccccatt

SEQ ID NO: 17823 - DNA, 20 bp, Artificial
  CRISPR gRNA sequence
atttggtctaacttacacat

SEQ ID NO: 17824 - DNA, 20 bp, Artificial
  CRISPR gRNA sequence
ctatttgtattcctgttttt

SEQ ID NO: 17825 - DNA, 20 bp, Artificial
  CRISPR gRNA sequence
gtattcctgtttttcagatg

SEQ ID NO: 17826 - DNA, 20 bp, Artificial
  CRISPR gRNA sequence
attcctgtttttcagatgaa

SEQ ID NO: 17827 - DNA, 20 bp, Artificial
  CRISPR gRNA sequence
ctgtttttcagatgaagaga

SEQ ID NO: 17828 - DNA, 20 bp, Artificial
  CRISPR gRNA sequence
tgtttttcagatgaagagac

SEQ ID NO: 17829 - DNA, 20 bp, Artificial
  CRISPR gRNA sequence
ttcagatgaagagacaggct

SEQ ID NO: 17830 - DNA, 20 bp, Artificial
  CRISPR gRNA sequence
cagatgaagagacaggctca

SEQ ID NO: 17831 - DNA, 20 bp, Artificial
  CRISPR gRNA sequence
agatgaagagacaggctcag

SEQ ID NO: 17832 - DNA, 20 bp, Artificial
  CRISPR gRNA sequence
gatgaagagacaggctcaga

SEQ ID NO: 17833 - DNA, 20 bp, Artificial
  CRISPR gRNA sequence
agagacaggctcagagggat

SEQ ID NO: 17834 - DNA, 20 bp, Artificial
  CRISPR gRNA sequence
gacaggctcagagggattag

SEQ ID NO: 17835 - DNA, 20 bp, Artificial
  CRISPR gRNA sequence
acaggctcagagggattagt

SEQ ID NO: 17836 - DNA, 20 bp, Artificial
  CRISPR gRNA sequence
ctcagagggattagtgggct

SEQ ID NO: 17837 - DNA, 20 bp, Artificial
  CRISPR gRNA sequence
aaccaaactacccatctcca

SEQ ID NO: 17838 - DNA, 20 bp, Artificial
  CRISPR gRNA sequence
actacccatctccaaagtct

SEQ ID NO: 17839 - DNA, 20 bp, Artificial
  CRISPR gRNA sequence
caaagtctcagcccactcta

SEQ ID NO: 17840 - DNA, 20 bp, Artificial
  CRISPR gRNA sequence
tagcctttttgaattgctgt

SEQ ID NO: 17841 - DNA, 20 bp, Artificial
  CRISPR gRNA sequence
ttgaattgctgttggccccc

SEQ ID NO: 17842 - DNA, 20 bp, Artificial
  CRISPR gRNA sequence
ctgttggccccccagcaccc

SEQ ID NO: 17843 - DNA, 20 bp, Artificial
  CRISPR gRNA sequence
tggccccccagcaccccggc

SEQ ID NO: 17844 - DNA, 20 bp, Artificial
  CRISPR gRNA sequence
ggccccccagcaccccggcg

SEQ ID NO: 17845 - DNA, 20 bp, Artificial
  CRISPR gRNA sequence
gccccccagcaccccggcga

SEQ ID NO: 17846 - DNA, 20 bp, Artificial
  CRISPR gRNA sequence
ccccagcaccccggcgaggg

SEQ ID NO: 17847 - DNA, 20 bp, Artificial
  CRISPR gRNA sequence
cccagcaccccggcgaggga

SEQ ID NO: 17848 - DNA, 20 bp, Artificial
  CRISPR gRNA sequence
caccccggcgagggaaggcg

SEQ ID NO: 17849 - DNA, 20 bp, Artificial
  CRISPR gRNA sequence
accccggcgagggaaggcgt

SEQ ID NO: 17850 - DNA, 20 bp, Artificial
  CRISPR gRNA sequence
ccggcgagggaaggcgtggg

SEQ ID NO: 17851 - DNA, 20 bp, Artificial
  CRISPR gRNA sequence
cgagggaaggcgtgggtggc

SEQ ID NO: 17852 - DNA, 20 bp, Artificial
  CRISPR gRNA sequence
gcaagacaatttctcctttt

SEQ ID NO: 17853 - DNA, 20 bp, Artificial
  CRISPR gRNA sequence
caagacaatttctccttttg

SEQ ID NO: 17854 - DNA, 20 bp, Artificial
  CRISPR gRNA sequence
agacaatttctccttttgag

SEQ ID NO: 17855 - DNA, 20 bp, Artificial
  CRISPR gRNA sequence
tctccttttgaggagccatg

SEQ ID NO: 17856 - DNA, 20 bp, Artificial
  CRISPR gRNA sequence
ctccttttgaggagccatgt

SEQ ID NO: 17857 - DNA, 20 bp, Artificial
  CRISPR gRNA sequence
tccttttgaggagccatgtg

SEQ ID NO: 17858 - DNA, 20 bp, Artificial
  CRISPR gRNA sequence
ccttttgaggagccatgtgg

SEQ ID NO: 17859 - DNA, 20 bp, Artificial
  CRISPR gRNA sequence
tttgaggagccatgtggggg

SEQ ID NO: 17860 - DNA, 20 bp, Artificial
  CRISPR gRNA sequence
ttgaggagccatgtgggggc

SEQ ID NO: 17861 - DNA, 20 bp, Artificial
  CRISPR gRNA sequence
tgaggagccatgtgggggca

SEQ ID NO: 17862 - DNA, 20 bp, Artificial
  CRISPR gRNA sequence
ggagccatgtgggggcaggg

SEQ ID NO: 17863 - DNA, 20 bp, Artificial
  CRISPR gRNA sequence
agccatgtgggggcagggca

SEQ ID NO: 17864 - DNA, 20 bp, Artificial
  CRISPR gRNA sequence
gccatgtgggggcagggcag

SEQ ID NO: 17865 - DNA, 20 bp, Artificial
  CRISPR gRNA sequence
gtgggggcagggcagaggcg

SEQ ID NO: 17866 - DNA, 20 bp, Artificial
  CRISPR gRNA sequence
aggcgcggtctgtgtctttt

SEQ ID NO: 17867 - DNA, 20 bp, Artificial
  CRISPR gRNA sequence
gtctgtgtctttttggtaaa

SEQ ID NO: 17868 - DNA, 20 bp, Artificial
  CRISPR gRNA sequence
tctgtgtctttttggtaaat

SEQ ID NO: 17869 - DNA, 20 bp, Artificial
  CRISPR gRNA sequence
gtgtctttttggtaaatggg

SEQ ID NO: 17870 - DNA, 20 bp, Artificial
  CRISPR gRNA sequence
tggtaaatgggcagtatttt

SEQ ID NO: 17871 - DNA, 20 bp, Artificial
  CRISPR gRNA sequence
taaatgggcagtatttttag

SEQ ID NO: 17872 - DNA, 20 bp, Artificial
  CRISPR gRNA sequence
aaatgggcagtatttttaga

SEQ ID NO: 17873 - DNA, 20 bp, Artificial
  CRISPR gRNA sequence
tttgaaactgtgcttccccc

SEQ ID NO: 17874 - DNA, 20 bp, Artificial
  CRISPR gRNA sequence
ttgaaactgtgcttccccct

SEQ ID NO: 17875 - DNA, 20 bp, Artificial
  CRISPR gRNA sequence
ccaccttccacatccaactc

SEQ ID NO: 17876 - DNA, 20 bp, Artificial
  CRISPR gRNA sequence
cctgatctttttgccatcaa

SEQ ID NO: 17877 - DNA, 20 bp, Artificial
  CRISPR gRNA sequence
ttgccatcaaaagtcctttt

SEQ ID NO: 17878 - DNA, 20 bp, Artificial
  CRISPR gRNA sequence
tgccatcaaaagtccttttt

SEQ ID NO: 17879 - DNA, 20 bp, Artificial
  CRISPR gRNA sequence
gccatcaaaagtcctttttg

SEQ ID NO: 17880 - DNA, 20 bp, Artificial
  CRISPR gRNA sequence
tccccacttcacactgcatg

SEQ ID NO: 17881 - DNA, 20 bp, Artificial
  CRISPR gRNA sequence
ccccacttcacactgcatgc

SEQ ID NO: 17882 - DNA, 20 bp, Artificial
  CRISPR gRNA sequence
acactgcatgcaggatttga

SEQ ID NO: 17883 - DNA, 20 bp, Artificial
  CRISPR gRNA sequence
cactgcatgcaggatttgaa

SEQ ID NO: 17884 - DNA, 20 bp, Artificial
  CRISPR gRNA sequence
catgcaggatttgaaaggct

SEQ ID NO: 17885 - DNA, 20 bp, Artificial
  CRISPR gRNA sequence
aggatttgaaaggctaagtg

SEQ ID NO: 17886 - DNA, 20 bp, Artificial
  CRISPR gRNA sequence
ggctaagtgtagacactaaa

SEQ ID NO: 17887 - DNA, 20 bp, Artificial
  CRISPR gRNA sequence
gctaagtgtagacactaaac

SEQ ID NO: 17888 - DNA, 20 bp, Artificial
  CRISPR gRNA sequence
aattcacctctctctccccc

SEQ ID NO: 17889 - DNA, 20 bp, Artificial
  CRISPR gRNA sequence
attcacctctctctcccccg

SEQ ID NO: 17890 - DNA, 20 bp, Artificial
  CRISPR gRNA sequence
ttcacctctctctcccccga

SEQ ID NO: 17891 - DNA, 20 bp, Artificial
  CRISPR gRNA sequence
ctctctcccccgagggaaat

SEQ ID NO: 17892 - DNA, 20 bp, Artificial
  CRISPR gRNA sequence
tctctcccccgagggaaatc

SEQ ID NO: 17893 - DNA, 20 bp, Artificial
  CRISPR gRNA sequence
gtcgccacaatgttctaact

SEQ ID NO: 17894 - DNA, 20 bp, Artificial
  CRISPR gRNA sequence
actcagacttaaactatctg

SEQ ID NO: 17895 - DNA, 20 bp, Artificial
  CRISPR gRNA sequence
gacttaaactatctgaagat

SEQ ID NO: 17896 - DNA, 20 bp, Artificial
  CRISPR gRNA sequence
atcagtgcatgcatctcttc

SEQ ID NO: 17897 - DNA, 20 bp, Artificial
  CRISPR gRNA sequence
tcagtgcatgcatctcttct

SEQ ID NO: 17898 - DNA, 20 bp, Artificial
  CRISPR gRNA sequence
gcatgcatctcttctgggaa

SEQ ID NO: 17899 - DNA, 20 bp, Artificial
  CRISPR gRNA sequence
aacagcataacgttccatct

SEQ ID NO: 17900 - DNA, 20 bp, Artificial
  CRISPR gRNA sequence
gcataacgttccatctcagc

SEQ ID NO: 17901 - DNA, 20 bp, Artificial
  CRISPR gRNA sequence
taacgttccatctcagctgg

SEQ ID NO: 17902 - DNA, 20 bp, Artificial
  CRISPR gRNA sequence
aacgttccatctcagctggt

SEQ ID NO: 17903 - DNA, 20 bp, Artificial
  CRISPR gRNA sequence
cgttccatctcagctggtgg

SEQ ID NO: 17904 - DNA, 20 bp, Artificial
  CRISPR gRNA sequence
ctcagctggtgggagatgaa

SEQ ID NO: 17905 - DNA, 20 bp, Artificial
  CRISPR gRNA sequence
cagctggtgggagatgaatg

SEQ ID NO: 17906 - DNA, 20 bp, Artificial
  CRISPR gRNA sequence
ggtgggagatgaatggagct

SEQ ID NO: 17907 - DNA, 20 bp, Artificial
  CRISPR gRNA sequence
ggagatgaatggagctcaga

SEQ ID NO: 17908 - DNA, 20 bp, Artificial
  CRISPR gRNA sequence
atgaatggagctcagatggt

SEQ ID NO: 17909 - DNA, 20 bp, Artificial
  CRISPR gRNA sequence
ggagctcagatggtgagctt

SEQ ID NO: 17910 - DNA, 20 bp, Artificial
  CRISPR gRNA sequence
gagctcagatggtgagcttt

SEQ ID NO: 17911 - DNA, 20 bp, Artificial
  CRISPR gRNA sequence
agctcagatggtgagctttg

SEQ ID NO: 17912 - DNA, 20 bp, Artificial
  CRISPR gRNA sequence
gggtgaaatttcccaacttt

SEQ ID NO: 17913 - DNA, 20 bp, Artificial
  CRISPR gRNA sequence
ggtgaaatttcccaactttc

SEQ ID NO: 17914 - DNA, 20 bp, Artificial
  CRISPR gRNA sequence
cctaccaacgcactacaatc

SEQ ID NO: 17915 - DNA, 20 bp, Artificial
  CRISPR gRNA sequence
ctaccaacgcactacaatct

SEQ ID NO: 17916 - DNA, 20 bp, Artificial
  CRISPR gRNA sequence
caacgcactacaatctgggt

SEQ ID NO: 17917 - DNA, 20 bp, Artificial
  CRISPR gRNA sequence
agttcattttttaaaccact

SEQ ID NO: 17918 - DNA, 20 bp, Artificial
  CRISPR gRNA sequence
ttcattttttaaaccacttg

SEQ ID NO: 17919 - DNA, 20 bp, Artificial
  CRISPR gRNA sequence
ttttaaaccacttggagcct

SEQ ID NO: 17920 - DNA, 20 bp, Artificial
  CRISPR gRNA sequence
cctcagtttccttatctgta

SEQ ID NO: 17921 - DNA, 20 bp, Artificial
  CRISPR gRNA sequence
cagtttccttatctgtaaag

SEQ ID NO: 17922 - DNA, 20 bp, Artificial
  CRISPR gRNA sequence
agtttccttatctgtaaagt

SEQ ID NO: 17923 - DNA, 20 bp, Artificial
  CRISPR gRNA sequence
gtttccttatctgtaaagtg

SEQ ID NO: 17924 - DNA, 20 bp, Artificial
  CRISPR gRNA sequence
tttccttatctgtaaagtgg

SEQ ID NO: 17925 - DNA, 20 bp, Artificial
  CRISPR gRNA sequence
gtaaagtgggggataataat

SEQ ID NO: 17926 - DNA, 20 bp, Artificial
  CRISPR gRNA sequence
ggataataattggcaactca

SEQ ID NO: 17927 - DNA, 20 bp, Artificial
  CRISPR gRNA sequence
gataataattggcaactcat

SEQ ID NO: 17928 - DNA, 20 bp, Artificial
  CRISPR gRNA sequence
taattggcaactcataggat

SEQ ID NO: 17929 - DNA, 20 bp, Artificial
  CRISPR gRNA sequence
aattggcaactcataggatt

SEQ ID NO: 17930 - DNA, 20 bp, Artificial
  CRISPR gRNA sequence
attggcaactcataggatta

SEQ ID NO: 17931 - DNA, 20 bp, Artificial
  CRISPR gRNA sequence
ttggcaactcataggattag

SEQ ID NO: 17932 - DNA, 20 bp, Artificial
  CRISPR gRNA sequence
ggcaactcataggattaggg

SEQ ID NO: 17933 - DNA, 20 bp, Artificial
  CRISPR gRNA sequence
ctcataggattaggggagtt

SEQ ID NO: 17934 - DNA, 20 bp, Artificial
  CRISPR gRNA sequence
attaggggagttaagttgca

SEQ ID NO: 17935 - DNA, 20 bp, Artificial
  CRISPR gRNA sequence
taggggagttaagttgcatg

SEQ ID NO: 17936 - DNA, 20 bp, Artificial
  CRISPR gRNA sequence
gttaagttgcatggagccct

SEQ ID NO: 17937 - DNA, 20 bp, Artificial
  CRISPR gRNA sequence
agttgcatggagcccttaga

SEQ ID NO: 17938 - DNA, 20 bp, Artificial
  CRISPR gRNA sequence
gttgcatggagcccttagaa

SEQ ID NO: 17939 - DNA, 20 bp, Artificial
  CRISPR gRNA sequence
ttgcatggagcccttagaaa

SEQ ID NO: 17940 - DNA, 20 bp, Artificial
  CRISPR gRNA sequence
tgcatggagcccttagaaag

SEQ ID NO: 17941 - DNA, 20 bp, Artificial
  CRISPR gRNA sequence
ggagcccttagaaaggggac

SEQ ID NO: 17942 - DNA, 20 bp, Artificial
  CRISPR gRNA sequence
ttagaaaggggactggcgac

SEQ ID NO: 17943 - DNA, 20 bp, Artificial
  CRISPR gRNA sequence
aaaggggactggcgaccagt

SEQ ID NO: 17944 - DNA, 20 bp, Artificial
  CRISPR gRNA sequence
accagtaagtgctcaatgaa

SEQ ID NO: 17945 - DNA, 20 bp, Artificial
  CRISPR gRNA sequence
agtaagtgctcaatgaacag

SEQ ID NO: 17946 - DNA, 20 bp, Artificial
  CRISPR gRNA sequence
tgctcaatgaacagtagctt

SEQ ID NO: 17947 - DNA, 20 bp, Artificial
  CRISPR gRNA sequence
gctcaatgaacagtagctta

SEQ ID NO: 17948 - DNA, 20 bp, Artificial
  CRISPR gRNA sequence
caatgaacagtagcttaagg

SEQ ID NO: 17949 - DNA, 20 bp, Artificial
  CRISPR gRNA sequence
aaggcagcacaacttctgca

SEQ ID NO: 17950 - DNA, 20 bp, Artificial
  CRISPR gRNA sequence
cagcacaacttctgcatggt

SEQ ID NO: 17951 - DNA, 20 bp, Artificial
  CRISPR gRNA sequence
aatgtgcttcttacctctgt

SEQ ID NO: 17952 - DNA, 20 bp, Artificial
  CRISPR gRNA sequence
tgtgcttcttacctctgtga

SEQ ID NO: 17953 - DNA, 20 bp, Artificial
  CRISPR gRNA sequence
cttacctctgtgagagtgac

SEQ ID NO: 17954 - DNA, 20 bp, Artificial
  CRISPR gRNA sequence
ttacctctgtgagagtgacc

SEQ ID NO: 17955 - DNA, 20 bp, Artificial
  CRISPR gRNA sequence
tacctctgtgagagtgacca

SEQ ID NO: 17956 - DNA, 20 bp, Artificial
  CRISPR gRNA sequence
acctctgtgagagtgaccag

SEQ ID NO: 17957 - DNA, 20 bp, Artificial
  CRISPR gRNA sequence
ctctgtgagagtgaccaggg

SEQ ID NO: 17958 - DNA, 20 bp, Artificial
  CRISPR gRNA sequence
aggggagatttctctgtgtc

SEQ ID NO: 17959 - DNA, 20 bp, Artificial
  CRISPR gRNA sequence
ggggagatttctctgtgtct

SEQ ID NO: 17960 - DNA, 20 bp, Artificial
  CRISPR gRNA sequence
gggagatttctctgtgtctg

SEQ ID NO: 17961 - DNA, 20 bp, Artificial
  CRISPR gRNA sequence
ctctgtgtctggggctgtgc

SEQ ID NO: 17962 - DNA, 20 bp, Artificial
  CRISPR gRNA sequence
tattctgtttcaactgttaa

SEQ ID NO: 17963 - DNA, 20 bp, Artificial
  CRISPR gRNA sequence
tcaactgttaacggcaactc

SEQ ID NO: 17964 - DNA, 20 bp, Artificial
  CRISPR gRNA sequence
caactgttaacggcaactct

SEQ ID NO: 17965 - DNA, 20 bp, Artificial
  CRISPR gRNA sequence
actgttaacggcaactctgg

SEQ ID NO: 17966 - DNA, 20 bp, Artificial
  CRISPR gRNA sequence
ctgggagattgttgttatta

SEQ ID NO: 17967 - DNA, 20 bp, Artificial
  CRISPR gRNA sequence
ttgttattatagccatttta

SEQ ID NO: 17968 - DNA, 20 bp, Artificial
  CRISPR gRNA sequence
ttatagccattttacagacg

SEQ ID NO: 17969 - DNA, 20 bp, Artificial
  CRISPR gRNA sequence
tatagccattttacagacgc

SEQ ID NO: 17970 - DNA, 20 bp, Artificial
  CRISPR gRNA sequence
attttacagacgcaggcgct

SEQ ID NO: 17971 - DNA, 20 bp, Artificial
  CRISPR gRNA sequence
gcaggcgctgagattacgtc

SEQ ID NO: 17972 - DNA, 20 bp, Artificial
  CRISPR gRNA sequence
tgagattacgtccagttcat

SEQ ID NO: 17973 - DNA, 20 bp, Artificial
  CRISPR gRNA sequence
ttcattagatgttttcttcc

SEQ ID NO: 17974 - DNA, 20 bp, Artificial
  CRISPR gRNA sequence
cattagatgttttcttccca

SEQ ID NO: 17975 - DNA, 20 bp, Artificial
  CRISPR gRNA sequence
attagatgttttcttcccag

SEQ ID NO: 17976 - DNA, 20 bp, Artificial
  CRISPR gRNA sequence
agatgttttcttcccagagg

SEQ ID NO: 17977 - DNA, 20 bp, Artificial
  CRISPR gRNA sequence
gatgttttcttcccagaggc

SEQ ID NO: 17978 - DNA, 20 bp, Artificial
  CRISPR gRNA sequence
atgttttcttcccagaggcg

SEQ ID NO: 17979 - DNA, 20 bp, Artificial
  CRISPR gRNA sequence
gttttcttcccagaggcggg

SEQ ID NO: 17980 - DNA, 20 bp, Artificial
  CRISPR gRNA sequence
gaggcggggagtctatcttt

SEQ ID NO: 17981 - DNA, 20 bp, Artificial
  CRISPR gRNA sequence
aggcggggagtctatctttg

SEQ ID NO: 17982 - DNA, 20 bp, Artificial
  CRISPR gRNA sequence
ggcggggagtctatctttga

SEQ ID NO: 17983 - DNA, 20 bp, Artificial
  CRISPR gRNA sequence
gagtctatctttgagggtct

SEQ ID NO: 17984 - DNA, 20 bp, Artificial
  CRISPR gRNA sequence
agtctatctttgagggtcta

SEQ ID NO: 17985 - DNA, 20 bp, Artificial
  CRISPR gRNA sequence
tctatctttgagggtctaag

SEQ ID NO: 17986 - DNA, 20 bp, Artificial
  CRISPR gRNA sequence
ctatctttgagggtctaagg

SEQ ID NO: 17987 - DNA, 20 bp, Artificial
  CRISPR gRNA sequence
agggtctaaggaggcactga

SEQ ID NO: 17988 - DNA, 20 bp, Artificial
  CRISPR gRNA sequence
gggtctaaggaggcactgaa

SEQ ID NO: 17989 - DNA, 20 bp, Artificial
  CRISPR gRNA sequence
ggtctaaggaggcactgaaa

SEQ ID NO: 17990 - DNA, 20 bp, Artificial
  CRISPR gRNA sequence
tctaaggaggcactgaaagg

SEQ ID NO: 17991 - DNA, 20 bp, Artificial
  CRISPR gRNA sequence
aaggaggcactgaaagggag

SEQ ID NO: 17992 - DNA, 20 bp, Artificial
  CRISPR gRNA sequence
gaggcactgaaagggagaag

SEQ ID NO: 17993 - DNA, 20 bp, Artificial
  CRISPR gRNA sequence
aggcactgaaagggagaaga

SEQ ID NO: 17994 - DNA, 20 bp, Artificial
  CRISPR gRNA sequence
ggctcttttgctacccctaa

SEQ ID NO: 17995 - DNA, 20 bp, Artificial
  CRISPR gRNA sequence
ttgctacccctaaaagcctc

SEQ ID NO: 17996 - DNA, 20 bp, Artificial
  CRISPR gRNA sequence
actgctctgaactgtgatta

SEQ ID NO: 17997 - DNA, 20 bp, Artificial
  CRISPR gRNA sequence
tgctctgaactgtgattaaa

SEQ ID NO: 17998 - DNA, 20 bp, Artificial
  CRISPR gRNA sequence
gaactgtgattaaagagcat

SEQ ID NO: 17999 - DNA, 20 bp, Artificial
  CRISPR gRNA sequence
ctgtgattaaagagcatgag

SEQ ID NO: 18000 - DNA, 20 bp, Artificial
  CRISPR gRNA sequence
tgtgattaaagagcatgaga

SEQ ID NO: 18001 - DNA, 20 bp, Artificial
  CRISPR gRNA sequence
tgattaaagagcatgagaag

SEQ ID NO: 18002 - DNA, 20 bp, Artificial
  CRISPR gRNA sequence
gattaaagagcatgagaagg

SEQ ID NO: 18003 - DNA, 20 bp, Artificial
  CRISPR gRNA sequence
aaagagcatgagaaggaggc

SEQ ID NO: 18004 - DNA, 20 bp, Artificial
  CRISPR gRNA sequence
aagagcatgagaaggaggcc

SEQ ID NO: 18005 - DNA, 20 bp, Artificial
  CRISPR gRNA sequence
agagcatgagaaggaggcca

SEQ ID NO: 18006 - DNA, 20 bp, Artificial
  CRISPR gRNA sequence
gagcatgagaaggaggccag

SEQ ID NO: 18007 - DNA, 20 bp, Artificial
  CRISPR gRNA sequence
catgagaaggaggccagggg

SEQ ID NO: 18008 - DNA, 20 bp, Artificial
  CRISPR gRNA sequence
gagaaggaggccaggggtgg

SEQ ID NO: 18009 - DNA, 20 bp, Artificial
  CRISPR gRNA sequence
gtggctcacgcctataatcc

SEQ ID NO: 18010 - DNA, 20 bp, Artificial
  CRISPR gRNA sequence
gcctataatcctagcacttt

SEQ ID NO: 18011 - DNA, 20 bp, Artificial
  CRISPR gRNA sequence
ctataatcctagcactttga

SEQ ID NO: 18012 - DNA, 20 bp, Artificial
  CRISPR gRNA sequence
tataatcctagcactttgag

SEQ ID NO: 18013 - DNA, 20 bp, Artificial
  CRISPR gRNA sequence
tcctagcactttgagaggcc

SEQ ID NO: 18014 - DNA, 20 bp, Artificial
  CRISPR gRNA sequence
cctagcactttgagaggccg

SEQ ID NO: 18015 - DNA, 20 bp, Artificial
  CRISPR gRNA sequence
gcactttgagaggccgaggc

SEQ ID NO: 18016 - DNA, 20 bp, Artificial
  CRISPR gRNA sequence
ctttgagaggccgaggctgg

SEQ ID NO: 18017 - DNA, 20 bp, Artificial
  CRISPR gRNA sequence
ccgaggctggcggattactt

SEQ ID NO: 18018 - DNA, 20 bp, Artificial
  CRISPR gRNA sequence
cgaggctggcggattacttg

SEQ ID NO: 18019 - DNA, 20 bp, Artificial
  CRISPR gRNA sequence
gctggcggattacttgaggt

SEQ ID NO: 18020 - DNA, 20 bp, Artificial
  CRISPR gRNA sequence
ctggcggattacttgaggtc

SEQ ID NO: 18021 - DNA, 20 bp, Artificial
  CRISPR gRNA sequence
ggcggattacttgaggtcag

SEQ ID NO: 18022 - DNA, 20 bp, Artificial
  CRISPR gRNA sequence
ttacttgaggtcaggagttc

SEQ ID NO: 18023 - DNA, 20 bp, Artificial
  CRISPR gRNA sequence
tgaggtcaggagttcaagac

SEQ ID NO: 18024 - DNA, 20 bp, Artificial
  CRISPR gRNA sequence
gagttcaagaccagcctgac

SEQ ID NO: 18025 - DNA, 20 bp, Artificial
  CRISPR gRNA sequence
caagaccagcctgaccagca

SEQ ID NO: 18026 - DNA, 20 bp, Artificial
  CRISPR gRNA sequence
ctctgcaaaaatacaaaaat

SEQ ID NO: 18027 - DNA, 20 bp, Artificial
  CRISPR gRNA sequence
gcaaaaatacaaaaatgagc

SEQ ID NO: 18028 - DNA, 20 bp, Artificial
  CRISPR gRNA sequence
caaaaatacaaaaatgagct

SEQ ID NO: 18029 - DNA, 20 bp, Artificial
  CRISPR gRNA sequence
atacaaaaatgagctgggcg

SEQ ID NO: 18030 - DNA, 20 bp, Artificial
  CRISPR gRNA sequence
caaaaatgagctgggcgtgg

SEQ ID NO: 18031 - DNA, 20 bp, Artificial
  CRISPR gRNA sequence
aaatgagctgggcgtggtgg

SEQ ID NO: 18032 - DNA, 20 bp, Artificial
  CRISPR gRNA sequence
aatgagctgggcgtggtggt

SEQ ID NO: 18033 - DNA, 20 bp, Artificial
  CRISPR gRNA sequence
gtggtgggtgcctataatcc

SEQ ID NO: 18034 - DNA, 20 bp, Artificial
  CRISPR gRNA sequence
tgcctataatcccagctact

SEQ ID NO: 18035 - DNA, 20 bp, Artificial
  CRISPR gRNA sequence
gcctataatcccagctactt

SEQ ID NO: 18036 - DNA, 20 bp, Artificial
  CRISPR gRNA sequence
ctataatcccagctacttgg

SEQ ID NO: 18037 - DNA, 20 bp, Artificial
  CRISPR gRNA sequence
tataatcccagctacttggg

SEQ ID NO: 18038 - DNA, 20 bp, Artificial
  CRISPR gRNA sequence
tcccagctacttgggaggct

SEQ ID NO: 18039 - DNA, 20 bp, Artificial
  CRISPR gRNA sequence
cccagctacttgggaggctg

SEQ ID NO: 18040 - DNA, 20 bp, Artificial
  CRISPR gRNA sequence
agctacttgggaggctgagg

SEQ ID NO: 18041 - DNA, 20 bp, Artificial
  CRISPR gRNA sequence
gctacttgggaggctgaggc

SEQ ID NO: 18042 - DNA, 20 bp, Artificial
  CRISPR gRNA sequence
gcaggaaaattgcttgaacc

SEQ ID NO: 18043 - DNA, 20 bp, Artificial
  CRISPR gRNA sequence
caggaaaattgcttgaacct

SEQ ID NO: 18044 - DNA, 20 bp, Artificial
  CRISPR gRNA sequence
ggaaaattgcttgaacctgg

SEQ ID NO: 18045 - DNA, 20 bp, Artificial
  CRISPR gRNA sequence
gaaaattgcttgaacctggg

SEQ ID NO: 18046 - DNA, 20 bp, Artificial
  CRISPR gRNA sequence
aattgcttgaacctgggagg

SEQ ID NO: 18047 - DNA, 20 bp, Artificial
  CRISPR gRNA sequence
ttgcttgaacctgggaggcg

SEQ ID NO: 18048 - DNA, 20 bp, Artificial
  CRISPR gRNA sequence
tgcttgaacctgggaggcgg

SEQ ID NO: 18049 - DNA, 20 bp, Artificial
  CRISPR gRNA sequence
aacctgggaggcggaggttg

SEQ ID NO: 18050 - DNA, 20 bp, Artificial
  CRISPR gRNA sequence
tgggaggcggaggttgcagt

SEQ ID NO: 18051 - DNA, 20 bp, Artificial
  CRISPR gRNA sequence
ggcggaggttgcagtgagcc

SEQ ID NO: 18052 - DNA, 20 bp, Artificial
  CRISPR gRNA sequence
gagatcacgccactgcactc

SEQ ID NO: 18053 - DNA, 20 bp, Artificial
  CRISPR gRNA sequence
acgccactgcactccagcct

SEQ ID NO: 18054 - DNA, 20 bp, Artificial
  CRISPR gRNA sequence
ctgcactccagcctcggtga

SEQ ID NO: 18055 - DNA, 20 bp, Artificial
  CRISPR gRNA sequence
gcactccagcctcggtgaca

SEQ ID NO: 18056 - DNA, 20 bp, Artificial
  CRISPR gRNA sequence
tccagcctcggtgacagagc

SEQ ID NO: 18057 - DNA, 20 bp, Artificial
  CRISPR gRNA sequence
gacagagcaagactctgtct

SEQ ID NO: 18058 - DNA, 20 bp, Artificial
  CRISPR gRNA sequence
gtctcagacaaaaaaaaaaa

SEQ ID NO: 18059 - DNA, 20 bp, Artificial
  CRISPR gRNA sequence
gacaaaaaaaaaaaaagctt

SEQ ID NO: 18060 - DNA, 20 bp, Artificial
  CRISPR gRNA sequence
aaaaaaaaaaaaagcttgag

SEQ ID NO: 18061 - DNA, 20 bp, Artificial
  CRISPR gRNA sequence
aaaaaaaaaaaagcttgaga

SEQ ID NO: 18062 - DNA, 20 bp, Artificial
  CRISPR gRNA sequence
gaccatgaacttctcctcct

SEQ ID NO: 18063 - DNA, 20 bp, Artificial
  CRISPR gRNA sequence
accatgaacttctcctcctg

SEQ ID NO: 18064 - DNA, 20 bp, Artificial
  CRISPR gRNA sequence
cttctcctcctgaggaataa

SEQ ID NO: 18065 - DNA, 20 bp, Artificial
  CRISPR gRNA sequence
ttctcctcctgaggaataat

SEQ ID NO: 18066 - DNA, 20 bp, Artificial
  CRISPR gRNA sequence
tcctcctgaggaataatggg

SEQ ID NO: 18067 - DNA, 20 bp, Artificial
  CRISPR gRNA sequence
agacctctgaactgtgtgcc

SEQ ID NO: 18068 - DNA, 20 bp, Artificial
  CRISPR gRNA sequence
acctctgaactgtgtgccta

SEQ ID NO: 18069 - DNA, 20 bp, Artificial
  CRISPR gRNA sequence
gaactgtgtgcctagagaca

SEQ ID NO: 18070 - DNA, 20 bp, Artificial
  CRISPR gRNA sequence
tgtgcctagagacatggttt

SEQ ID NO: 18071 - DNA, 20 bp, Artificial
  CRISPR gRNA sequence
tctgctctgcctttgatcct

SEQ ID NO: 18072 - DNA, 20 bp, Artificial
  CRISPR gRNA sequence
tgatcctgagtacattacct

SEQ ID NO: 18073 - DNA, 20 bp, Artificial
  CRISPR gRNA sequence
gtacattaccttagccctct

SEQ ID NO: 18074 - DNA, 20 bp, Artificial
  CRISPR gRNA sequence
ctctgagcctccgtttcaac

SEQ ID NO: 18075 - DNA, 20 bp, Artificial
  CRISPR gRNA sequence
gcctccgtttcaacgagtgt

SEQ ID NO: 18076 - DNA, 20 bp, Artificial
  CRISPR gRNA sequence
ctccgtttcaacgagtgttg

SEQ ID NO: 18077 - DNA, 20 bp, Artificial
  CRISPR gRNA sequence
gtgttggagccccttcaatt

SEQ ID NO: 18078 - DNA, 20 bp, Artificial
  CRISPR gRNA sequence
cccttcaattgagtcttttt

SEQ ID NO: 18079 - DNA, 20 bp, Artificial
  CRISPR gRNA sequence
gattctgattcctcgttgcc

SEQ ID NO: 18080 - DNA, 20 bp, Artificial
  CRISPR gRNA sequence
tctgattcctcgttgcctgg

SEQ ID NO: 18081 - DNA, 20 bp, Artificial
  CRISPR gRNA sequence
ttctccttttcctttccccc

SEQ ID NO: 18082 - DNA, 20 bp, Artificial
  CRISPR gRNA sequence
tctccttttcctttccccca

SEQ ID NO: 18083 - DNA, 20 bp, Artificial
  CRISPR gRNA sequence
ctgctccccaacctcatgac

SEQ ID NO: 18084 - DNA, 20 bp, Artificial
  CRISPR gRNA sequence
acctcatgacaagctgcttc

SEQ ID NO: 18085 - DNA, 20 bp, Artificial
  CRISPR gRNA sequence
cctcatgacaagctgcttcc

SEQ ID NO: 18086 - DNA, 20 bp, Artificial
  CRISPR gRNA sequence
ctcatgacaagctgcttccg

SEQ ID NO: 18087 - DNA, 20 bp, Artificial
  CRISPR gRNA sequence
tcatgacaagctgcttccgg

SEQ ID NO: 18088 - DNA, 20 bp, Artificial
  CRISPR gRNA sequence
agctgcttccgggggccaaa

SEQ ID NO: 18089 - DNA, 20 bp, Artificial
  CRISPR gRNA sequence
ttccgggggccaaatggtgt

SEQ ID NO: 18090 - DNA, 20 bp, Artificial
  CRISPR gRNA sequence
tccgggggccaaatggtgtt

SEQ ID NO: 18091 - DNA, 20 bp, Artificial
  CRISPR gRNA sequence
gggggccaaatggtgttggg

SEQ ID NO: 18092 - DNA, 20 bp, Artificial
  CRISPR gRNA sequence
gccaaatggtgttgggaagc

SEQ ID NO: 18093 - DNA, 20 bp, Artificial
  CRISPR gRNA sequence
ccaaatggtgttgggaagcc

SEQ ID NO: 18094 - DNA, 20 bp, Artificial
  CRISPR gRNA sequence
caaatggtgttgggaagcca

SEQ ID NO: 18095 - DNA, 20 bp, Artificial
  CRISPR gRNA sequence
aaatggtgttgggaagccag

SEQ ID NO: 18096 - DNA, 20 bp, Artificial
  CRISPR gRNA sequence
gtgttgggaagccaggggcc

SEQ ID NO: 18097 - DNA, 20 bp, Artificial
  CRISPR gRNA sequence
tgttgggaagccaggggcct

SEQ ID NO: 18098 - DNA, 20 bp, Artificial
  CRISPR gRNA sequence
gaatgcctatctaccatgac

SEQ ID NO: 18099 - DNA, 20 bp, Artificial
  CRISPR gRNA sequence
taccatgaccagaccccaaa

SEQ ID NO: 18100 - DNA, 20 bp, Artificial
  CRISPR gRNA sequence
gaccccaaacagcttctttg

SEQ ID NO: 18101 - DNA, 20 bp, Artificial
  CRISPR gRNA sequence
accccaaacagcttctttgt

SEQ ID NO: 18102 - DNA, 20 bp, Artificial
  CRISPR gRNA sequence
ccccaaacagcttctttgtg

SEQ ID NO: 18103 - DNA, 20 bp, Artificial
  CRISPR gRNA sequence
cccaaacagcttctttgtgg

SEQ ID NO: 18104 - DNA, 20 bp, Artificial
  CRISPR gRNA sequence
aaacagcttctttgtggggg

SEQ ID NO: 18105 - DNA, 20 bp, Artificial
  CRISPR gRNA sequence
cagcttctttgtgggggtag

SEQ ID NO: 18106 - DNA, 20 bp, Artificial
  CRISPR gRNA sequence
gtgggggtagtagctcaaat

SEQ ID NO: 18107 - DNA, 20 bp, Artificial
  CRISPR gRNA sequence
gcttttgctcatgcaccctg

SEQ ID NO: 18108 - DNA, 20 bp, Artificial
  CRISPR gRNA sequence
tcatgcaccctgtagtcctc

SEQ ID NO: 18109 - DNA, 20 bp, Artificial
  CRISPR gRNA sequence
tagtcctccagataaactct

SEQ ID NO: 18110 - DNA, 20 bp, Artificial
  CRISPR gRNA sequence
tctctcacttttcccctcta

SEQ ID NO: 18111 - DNA, 20 bp, Artificial
  CRISPR gRNA sequence
ctgtaaaacaatgattcact

SEQ ID NO: 18112 - DNA, 20 bp, Artificial
  CRISPR gRNA sequence
tgattcactgagcaccccgt

SEQ ID NO: 18113 - DNA, 20 bp, Artificial
  CRISPR gRNA sequence
tcactgagcaccccgtaaga

SEQ ID NO: 18114 - DNA, 20 bp, Artificial
  CRISPR gRNA sequence
caccccgtaagaaagtcact

SEQ ID NO: 18115 - DNA, 20 bp, Artificial
  CRISPR gRNA sequence
cgtaagaaagtcactgagct

SEQ ID NO: 18116 - DNA, 20 bp, Artificial
  CRISPR gRNA sequence
cactgagctcagttccttac

SEQ ID NO: 18117 - DNA, 20 bp, Artificial
  CRISPR gRNA sequence
tcagttccttactggcccca

SEQ ID NO: 18118 - DNA, 20 bp, Artificial
  CRISPR gRNA sequence
agttccttactggccccaaa

SEQ ID NO: 18119 - DNA, 20 bp, Artificial
  CRISPR gRNA sequence
gttccttactggccccaaag

SEQ ID NO: 18120 - DNA, 20 bp, Artificial
  CRISPR gRNA sequence
ccccaaagaggtttaccaca

SEQ ID NO: 18121 - DNA, 20 bp, Artificial
  CRISPR gRNA sequence
ttaccacacagtccctgcca

SEQ ID NO: 18122 - DNA, 20 bp, Artificial
  CRISPR gRNA sequence
accacacagtccctgccaaa

SEQ ID NO: 18123 - DNA, 20 bp, Artificial
  CRISPR gRNA sequence
ccacacagtccctgccaaag

SEQ ID NO: 18124 - DNA, 20 bp, Artificial
  CRISPR gRNA sequence
tgccaaagaggcttgcaatg

SEQ ID NO: 18125 - DNA, 20 bp, Artificial
  CRISPR gRNA sequence
agaggcttgcaatgtagacc

SEQ ID NO: 18126 - DNA, 20 bp, Artificial
  CRISPR gRNA sequence
tgtagacccagatgatattt

SEQ ID NO: 18127 - DNA, 20 bp, Artificial
  CRISPR gRNA sequence
gtagacccagatgatatttt

SEQ ID NO: 18128 - DNA, 20 bp, Artificial
  CRISPR gRNA sequence
agacccagatgatattttag

SEQ ID NO: 18129 - DNA, 20 bp, Artificial
  CRISPR gRNA sequence
acccagatgatattttagga

SEQ ID NO: 18130 - DNA, 20 bp, Artificial
  CRISPR gRNA sequence
ccagatgatattttaggaga

SEQ ID NO: 18131 - DNA, 20 bp, Artificial
  CRISPR gRNA sequence
agagagacaaaacataataa

SEQ ID NO: 18132 - DNA, 20 bp, Artificial
  CRISPR gRNA sequence
gacaaaacataataatagca

SEQ ID NO: 18133 - DNA, 20 bp, Artificial
  CRISPR gRNA sequence
aaaacataataatagcatag

SEQ ID NO: 18134 - DNA, 20 bp, Artificial
  CRISPR gRNA sequence
ataataatagcatagtggtt

SEQ ID NO: 18135 - DNA, 20 bp, Artificial
  CRISPR gRNA sequence
taataatagcatagtggtta

SEQ ID NO: 18136 - DNA, 20 bp, Artificial
  CRISPR gRNA sequence
aataatagcatagtggttaa

SEQ ID NO: 18137 - DNA, 20 bp, Artificial
  CRISPR gRNA sequence
tagcatagtggttaagggtg

SEQ ID NO: 18138 - DNA, 20 bp, Artificial
  CRISPR gRNA sequence
agcatagtggttaagggtgc

SEQ ID NO: 18139 - DNA, 20 bp, Artificial
  CRISPR gRNA sequence
gtggttaagggtgcaggctc

SEQ ID NO: 18140 - DNA, 20 bp, Artificial
  CRISPR gRNA sequence
tggttaagggtgcaggctct

SEQ ID NO: 18141 - DNA, 20 bp, Artificial
  CRISPR gRNA sequence
caggctctgggttcaaatct

SEQ ID NO: 18142 - DNA, 20 bp, Artificial
  CRISPR gRNA sequence
aaatgttactcaacctctct

SEQ ID NO: 18143 - DNA, 20 bp, Artificial
  CRISPR gRNA sequence
tactcaacctctctgagtca

SEQ ID NO: 18144 - DNA, 20 bp, Artificial
  CRISPR gRNA sequence
cagaatcgactgcattttgt

SEQ ID NO: 18145 - DNA, 20 bp, Artificial
  CRISPR gRNA sequence
tcgactgcattttgttggca

SEQ ID NO: 18146 - DNA, 20 bp, Artificial
  CRISPR gRNA sequence
tggcacagtgcttatgtcac

SEQ ID NO: 18147 - DNA, 20 bp, Artificial
  CRISPR gRNA sequence
ggcacagtgcttatgtcact

SEQ ID NO: 18148 - DNA, 20 bp, Artificial
  CRISPR gRNA sequence
gggttgttgtgacttaccta

SEQ ID NO: 18149 - DNA, 20 bp, Artificial
  CRISPR gRNA sequence
gtgacttacctaaagtgact

SEQ ID NO: 18150 - DNA, 20 bp, Artificial
  CRISPR gRNA sequence
cttacctaaagtgacttagc

SEQ ID NO: 18151 - DNA, 20 bp, Artificial
  CRISPR gRNA sequence
cctaaagtgacttagcgagt

SEQ ID NO: 18152 - DNA, 20 bp, Artificial
  CRISPR gRNA sequence
aaagtgacttagcgagtaag

SEQ ID NO: 18153 - DNA, 20 bp, Artificial
  CRISPR gRNA sequence
cttagcgagtaagtggtact

SEQ ID NO: 18154 - DNA, 20 bp, Artificial
  CRISPR gRNA sequence
tgtaaactccaaaaataaaa

SEQ ID NO: 18155 - DNA, 20 bp, Artificial
  CRISPR gRNA sequence
actccaaaaataaaacagca

SEQ ID NO: 18156 - DNA, 20 bp, Artificial
  CRISPR gRNA sequence
gacacttgatactgtacaac

SEQ ID NO: 18157 - DNA, 20 bp, Artificial
  CRISPR gRNA sequence
tgatactgtacaactggcaa

SEQ ID NO: 18158 - DNA, 20 bp, Artificial
  CRISPR gRNA sequence
actgtacaactggcaaaagt

SEQ ID NO: 18159 - DNA, 20 bp, Artificial
  CRISPR gRNA sequence
actggcaaaagttagacatc

SEQ ID NO: 18160 - DNA, 20 bp, Artificial
  CRISPR gRNA sequence
ctggcaaaagttagacatct

SEQ ID NO: 18161 - DNA, 20 bp, Artificial
  CRISPR gRNA sequence
ttagacatctgggaaatgcc

SEQ ID NO: 18162 - DNA, 20 bp, Artificial
  CRISPR gRNA sequence
atctgggaaatgccaagtgt

SEQ ID NO: 18163 - DNA, 20 bp, Artificial
  CRISPR gRNA sequence
aatgccaagtgttggttaca

SEQ ID NO: 18164 - DNA, 20 bp, Artificial
  CRISPR gRNA sequence
atgccaagtgttggttacac

SEQ ID NO: 18165 - DNA, 20 bp, Artificial
  CRISPR gRNA sequence
gtgttggttacacgggtttg

SEQ ID NO: 18166 - DNA, 20 bp, Artificial
  CRISPR gRNA sequence
tgttggttacacgggtttgt

SEQ ID NO: 18167 - DNA, 20 bp, Artificial
  CRISPR gRNA sequence
tacacgggtttgtgggaatg

SEQ ID NO: 18168 - DNA, 20 bp, Artificial
  CRISPR gRNA sequence
cgggtttgtgggaatgtaga

SEQ ID NO: 18169 - DNA, 20 bp, Artificial
  CRISPR gRNA sequence
tttgtgggaatgtagatgga

SEQ ID NO: 18170 - DNA, 20 bp, Artificial
  CRISPR gRNA sequence
ttgtgggaatgtagatggat

SEQ ID NO: 18171 - DNA, 20 bp, Artificial
  CRISPR gRNA sequence
tgtgggaatgtagatggatg

SEQ ID NO: 18172 - DNA, 20 bp, Artificial
  CRISPR gRNA sequence
gtagatggatggggccgctc

SEQ ID NO: 18173 - DNA, 20 bp, Artificial
  CRISPR gRNA sequence
agatggatggggccgctctg

SEQ ID NO: 18174 - DNA, 20 bp, Artificial
  CRISPR gRNA sequence
ggccgctctggagaacgacc

SEQ ID NO: 18175 - DNA, 20 bp, Artificial
  CRISPR gRNA sequence
gagaacgacctggcatcatg

SEQ ID NO: 18176 - DNA, 20 bp, Artificial
  CRISPR gRNA sequence
tggcatcatgtagaatatct

SEQ ID NO: 18177 - DNA, 20 bp, Artificial
  CRISPR gRNA sequence
ggcatcatgtagaatatcta

SEQ ID NO: 18178 - DNA, 20 bp, Artificial
  CRISPR gRNA sequence
gtagaatatctaaggatatg

SEQ ID NO: 18179 - DNA, 20 bp, Artificial
  CRISPR gRNA sequence
gatatgtagatcctaccacc

SEQ ID NO: 18180 - DNA, 20 bp, Artificial
  CRISPR gRNA sequence
gatcctaccacctggcaatt

SEQ ID NO: 18181 - DNA, 20 bp, Artificial
  CRISPR gRNA sequence
ccacctggcaattcagctct

SEQ ID NO: 18182 - DNA, 20 bp, Artificial
  CRISPR gRNA sequence
cacctggcaattcagctctt

SEQ ID NO: 18183 - DNA, 20 bp, Artificial
  CRISPR gRNA sequence
tcttgggtctatatatcctg

SEQ ID NO: 18184 - DNA, 20 bp, Artificial
  CRISPR gRNA sequence
gaaatgttcccacaactccc

SEQ ID NO: 18185 - DNA, 20 bp, Artificial
  CRISPR gRNA sequence
aaatgttcccacaactcccc

SEQ ID NO: 18186 - DNA, 20 bp, Artificial
  CRISPR gRNA sequence
atgttcccacaactccccag

SEQ ID NO: 18187 - DNA, 20 bp, Artificial
  CRISPR gRNA sequence
ctccccaggagaacccatct

SEQ ID NO: 18188 - DNA, 20 bp, Artificial
  CRISPR gRNA sequence
tccccaggagaacccatctg

SEQ ID NO: 18189 - DNA, 20 bp, Artificial
  CRISPR gRNA sequence
caggagaacccatctgagga

SEQ ID NO: 18190 - DNA, 20 bp, Artificial
  CRISPR gRNA sequence
ggttactgctgtgttatttg

SEQ ID NO: 18191 - DNA, 20 bp, Artificial
  CRISPR gRNA sequence
tgctgtgttatttgtggtga

SEQ ID NO: 18192 - DNA, 20 bp, Artificial
  CRISPR gRNA sequence
ctgtgttatttgtggtgaca

SEQ ID NO: 18193 - DNA, 20 bp, Artificial
  CRISPR gRNA sequence
gtgttatttgtggtgacaga

SEQ ID NO: 18194 - DNA, 20 bp, Artificial
  CRISPR gRNA sequence
tatttgtggtgacagagagt

SEQ ID NO: 18195 - DNA, 20 bp, Artificial
  CRISPR gRNA sequence
tttgtggtgacagagagttg

SEQ ID NO: 18196 - DNA, 20 bp, Artificial
  CRISPR gRNA sequence
ttgtggtgacagagagttgg

SEQ ID NO: 18197 - DNA, 20 bp, Artificial
  CRISPR gRNA sequence
acagagagttggaggtcacc

SEQ ID NO: 18198 - DNA, 20 bp, Artificial
  CRISPR gRNA sequence
cagagagttggaggtcacct

SEQ ID NO: 18199 - DNA, 20 bp, Artificial
  CRISPR gRNA sequence
gtcacctaggtgtccatcac

SEQ ID NO: 18200 - DNA, 20 bp, Artificial
  CRISPR gRNA sequence
tcacctaggtgtccatcact

SEQ ID NO: 18201 - DNA, 20 bp, Artificial
  CRISPR gRNA sequence
cacctaggtgtccatcactg

SEQ ID NO: 18202 - DNA, 20 bp, Artificial
  CRISPR gRNA sequence
acctaggtgtccatcactgg

SEQ ID NO: 18203 - DNA, 20 bp, Artificial
  CRISPR gRNA sequence
ggtgtccatcactgggggtg

SEQ ID NO: 18204 - DNA, 20 bp, Artificial
  CRISPR gRNA sequence
tccatcactgggggtgtgga

SEQ ID NO: 18205 - DNA, 20 bp, Artificial
  CRISPR gRNA sequence
ccatcactgggggtgtggac

SEQ ID NO: 18206 - DNA, 20 bp, Artificial
  CRISPR gRNA sequence
tgggggtgtggacaggtgaa

SEQ ID NO: 18207 - DNA, 20 bp, Artificial
  CRISPR gRNA sequence
aaagtaacccctgcactcca

SEQ ID NO: 18208 - DNA, 20 bp, Artificial
  CRISPR gRNA sequence
agtaacccctgcactccata

SEQ ID NO: 18209 - DNA, 20 bp, Artificial
  CRISPR gRNA sequence
tagagaacaatgtccgtgat

SEQ ID NO: 18210 - DNA, 20 bp, Artificial
  CRISPR gRNA sequence
agaacaatgtccgtgattag

SEQ ID NO: 18211 - DNA, 20 bp, Artificial
  CRISPR gRNA sequence
aatgtccgtgattagaagca

SEQ ID NO: 18212 - DNA, 20 bp, Artificial
  CRISPR gRNA sequence
gaagcaaagatcaaatgcat

SEQ ID NO: 18213 - DNA, 20 bp, Artificial
  CRISPR gRNA sequence
gcaaagatcaaatgcatcag

SEQ ID NO: 18214 - DNA, 20 bp, Artificial
  CRISPR gRNA sequence
agatcaaatgcatcagaagc

SEQ ID NO: 18215 - DNA, 20 bp, Artificial
  CRISPR gRNA sequence
gatcaaatgcatcagaagca

SEQ ID NO: 18216 - DNA, 20 bp, Artificial
  CRISPR gRNA sequence
aaatgcatcagaagcaaggc

SEQ ID NO: 18217 - DNA, 20 bp, Artificial
  CRISPR gRNA sequence
tgcatcagaagcaaggcaag

SEQ ID NO: 18218 - DNA, 20 bp, Artificial
  CRISPR gRNA sequence
gcaagtagatcctaaaaaca

SEQ ID NO: 18219 - DNA, 20 bp, Artificial
  CRISPR gRNA sequence
tagatcctaaaaacatagta

SEQ ID NO: 18220 - DNA, 20 bp, Artificial
  CRISPR gRNA sequence
aaacatagtacagaatgcaa

SEQ ID NO: 18221 - DNA, 20 bp, Artificial
  CRISPR gRNA sequence
atagtacagaatgcaaaagt

SEQ ID NO: 18222 - DNA, 20 bp, Artificial
  CRISPR gRNA sequence
aatgcaaaagtaagaaactg

SEQ ID NO: 18223 - DNA, 20 bp, Artificial
  CRISPR gRNA sequence
caaaagtaagaaactgtggc

SEQ ID NO: 18224 - DNA, 20 bp, Artificial
  CRISPR gRNA sequence
aaaagtaagaaactgtggcc

SEQ ID NO: 18225 - DNA, 20 bp, Artificial
  CRISPR gRNA sequence
taagaaactgtggccaggcg

SEQ ID NO: 18226 - DNA, 20 bp, Artificial
  CRISPR gRNA sequence
gtgactcgcacctgtaattc

SEQ ID NO: 18227 - DNA, 20 bp, Artificial
  CRISPR gRNA sequence
cacctgtaattccagcactt

SEQ ID NO: 18228 - DNA, 20 bp, Artificial
  CRISPR gRNA sequence
acctgtaattccagcacttt

SEQ ID NO: 18229 - DNA, 20 bp, Artificial
  CRISPR gRNA sequence
ctgtaattccagcactttgg

SEQ ID NO: 18230 - DNA, 20 bp, Artificial
  CRISPR gRNA sequence
tgtaattccagcactttggg

SEQ ID NO: 18231 - DNA, 20 bp, Artificial
  CRISPR gRNA sequence
ttccagcactttgggaggcc

SEQ ID NO: 18232 - DNA, 20 bp, Artificial
  CRISPR gRNA sequence
tccagcactttgggaggccg

SEQ ID NO: 18233 - DNA, 20 bp, Artificial
  CRISPR gRNA sequence
agcactttgggaggccgagg

SEQ ID NO: 18234 - DNA, 20 bp, Artificial
  CRISPR gRNA sequence
gcactttgggaggccgaggc

SEQ ID NO: 18235 - DNA, 20 bp, Artificial
  CRISPR gRNA sequence
ctttgggaggccgaggcggg

SEQ ID NO: 18236 - DNA, 20 bp, Artificial
  CRISPR gRNA sequence
ccgaggcgggtggatcacct

SEQ ID NO: 18237 - DNA, 20 bp, Artificial
  CRISPR gRNA sequence
cgaggcgggtggatcacctg

SEQ ID NO: 18238 - DNA, 20 bp, Artificial
  CRISPR gRNA sequence
gcgggtggatcacctgaggt

SEQ ID NO: 18239 - DNA, 20 bp, Artificial
  CRISPR gRNA sequence
cgggtggatcacctgaggtc

SEQ ID NO: 18240 - DNA, 20 bp, Artificial
  CRISPR gRNA sequence
ggtggatcacctgaggtcag

SEQ ID NO: 18241 - DNA, 20 bp, Artificial
  CRISPR gRNA sequence
tcacctgaggtcaggagttt

SEQ ID NO: 18242 - DNA, 20 bp, Artificial
  CRISPR gRNA sequence
tgaggtcaggagtttgagac

SEQ ID NO: 18243 - DNA, 20 bp, Artificial
  CRISPR gRNA sequence
tcaggagtttgagaccagcc

SEQ ID NO: 18244 - DNA, 20 bp, Artificial
  CRISPR gRNA sequence
agtttgagaccagcctggcc

SEQ ID NO: 18245 - DNA, 20 bp, Artificial
  CRISPR gRNA sequence
gtttgagaccagcctggcca

SEQ ID NO: 18246 - DNA, 20 bp, Artificial
  CRISPR gRNA sequence
tgagaccagcctggccaagg

SEQ ID NO: 18247 - DNA, 20 bp, Artificial
  CRISPR gRNA sequence
aaccccatctctactaaaaa

SEQ ID NO: 18248 - DNA, 20 bp, Artificial
  CRISPR gRNA sequence
tctactaaaaatagaaaact

SEQ ID NO: 18249 - DNA, 20 bp, Artificial
  CRISPR gRNA sequence
taaaaatagaaaactcagcc

SEQ ID NO: 18250 - DNA, 20 bp, Artificial
  CRISPR gRNA sequence
aaaaatagaaaactcagcct

SEQ ID NO: 18251 - DNA, 20 bp, Artificial
  CRISPR gRNA sequence
agaaaactcagcctgggtga

SEQ ID NO: 18252 - DNA, 20 bp, Artificial
  CRISPR gRNA sequence
aaaactcagcctgggtgaca

SEQ ID NO: 18253 - DNA, 20 bp, Artificial
  CRISPR gRNA sequence
ctcagcctgggtgacagagt

SEQ ID NO: 18254 - DNA, 20 bp, Artificial
  CRISPR gRNA sequence
ccatctaaaaaaaaaaaaaa

SEQ ID NO: 18255 - DNA, 20 bp, Artificial
  CRISPR gRNA sequence
catctaaaaaaaaaaaaaaa

SEQ ID NO: 18256 - DNA, 20 bp, Artificial
  CRISPR gRNA sequence
aaaggcaaaacatgttttat

SEQ ID NO: 18257 - DNA, 20 bp, Artificial
  CRISPR gRNA sequence
aggcaaaacatgttttataa

SEQ ID NO: 18258 - DNA, 20 bp, Artificial
  CRISPR gRNA sequence
tttataagagcacatacaaa

SEQ ID NO: 18259 - DNA, 20 bp, Artificial
  CRISPR gRNA sequence
taagagcacatacaaacaga

SEQ ID NO: 18260 - DNA, 20 bp, Artificial
  CRISPR gRNA sequence
aagatacacctgaaatgcat

SEQ ID NO: 18261 - DNA, 20 bp, Artificial
  CRISPR gRNA sequence
acacctgaaatgcattagaa

SEQ ID NO: 18262 - DNA, 20 bp, Artificial
  CRISPR gRNA sequence
cacctgaaatgcattagaat

SEQ ID NO: 18263 - DNA, 20 bp, Artificial
  CRISPR gRNA sequence
aatgcattagaatgggcacc

SEQ ID NO: 18264 - DNA, 20 bp, Artificial
  CRISPR gRNA sequence
attagaatgggcacccagta

SEQ ID NO: 18265 - DNA, 20 bp, Artificial
  CRISPR gRNA sequence
ttagaatgggcacccagtat

SEQ ID NO: 18266 - DNA, 20 bp, Artificial
  CRISPR gRNA sequence
tgggcacccagtatgggaaa

SEQ ID NO: 18267 - DNA, 20 bp, Artificial
  CRISPR gRNA sequence
gggcacccagtatgggaaat

SEQ ID NO: 18268 - DNA, 20 bp, Artificial
  CRISPR gRNA sequence
ggcacccagtatgggaaata

SEQ ID NO: 18269 - DNA, 20 bp, Artificial
  CRISPR gRNA sequence
gggaaatagggacattaatg

SEQ ID NO: 18270 - DNA, 20 bp, Artificial
  CRISPR gRNA sequence
gaaatagggacattaatgaa

SEQ ID NO: 18271 - DNA, 20 bp, Artificial
  CRISPR gRNA sequence
gaaaaccctcatgtgaacca

SEQ ID NO: 18272 - DNA, 20 bp, Artificial
  CRISPR gRNA sequence
ctcatgtgaaccaaagatca

SEQ ID NO: 18273 - DNA, 20 bp, Artificial
  CRISPR gRNA sequence
gatcatagtgtaccatgacc

SEQ ID NO: 18274 - DNA, 20 bp, Artificial
  CRISPR gRNA sequence
atcatagtgtaccatgacct

SEQ ID NO: 18275 - DNA, 20 bp, Artificial
  CRISPR gRNA sequence
taccatgacctgggctgcac

SEQ ID NO: 18276 - DNA, 20 bp, Artificial
  CRISPR gRNA sequence
accatgacctgggctgcact

SEQ ID NO: 18277 - DNA, 20 bp, Artificial
  CRISPR gRNA sequence
atgacctgggctgcactggg

SEQ ID NO: 18278 - DNA, 20 bp, Artificial
  CRISPR gRNA sequence
ctgcactgggcagttaatcg

SEQ ID NO: 18279 - DNA, 20 bp, Artificial
  CRISPR gRNA sequence
tgcactgggcagttaatcga

SEQ ID NO: 18280 - DNA, 20 bp, Artificial
  CRISPR gRNA sequence
ggcagttaatcgaaggttta

SEQ ID NO: 18281 - DNA, 20 bp, Artificial
  CRISPR gRNA sequence
gcagttaatcgaaggtttaa

SEQ ID NO: 18282 - DNA, 20 bp, Artificial
  CRISPR gRNA sequence
taatcgaaggtttaaaggcc

SEQ ID NO: 18283 - DNA, 20 bp, Artificial
  CRISPR gRNA sequence
aatcgaaggtttaaaggccc

SEQ ID NO: 18284 - DNA, 20 bp, Artificial
  CRISPR gRNA sequence
atcgaaggtttaaaggccca

SEQ ID NO: 18285 - DNA, 20 bp, Artificial
  CRISPR gRNA sequence
tcgaaggtttaaaggcccag

SEQ ID NO: 18286 - DNA, 20 bp, Artificial
  CRISPR gRNA sequence
ttaaaggcccaggggttgaa

SEQ ID NO: 18287 - DNA, 20 bp, Artificial
  CRISPR gRNA sequence
ggcccaggggttgaaaagaa

SEQ ID NO: 18288 - DNA, 20 bp, Artificial
  CRISPR gRNA sequence
ggttgaaaagaaaagaaaca

SEQ ID NO: 18289 - DNA, 20 bp, Artificial
  CRISPR gRNA sequence
gttgaaaagaaaagaaacaa

SEQ ID NO: 18290 - DNA, 20 bp, Artificial
  CRISPR gRNA sequence
tgaaaagaaaagaaacaaag

SEQ ID NO: 18291 - DNA, 20 bp, Artificial
  CRISPR gRNA sequence
gaaaagaaaagaaacaaagg

SEQ ID NO: 18292 - DNA, 20 bp, Artificial
  CRISPR gRNA sequence
aagaaacaaaggaggattca

SEQ ID NO: 18293 - DNA, 20 bp, Artificial
  CRISPR gRNA sequence
agaaacaaaggaggattcat

SEQ ID NO: 18294 - DNA, 20 bp, Artificial
  CRISPR gRNA sequence
gaaacaaaggaggattcatg

SEQ ID NO: 18295 - DNA, 20 bp, Artificial
  CRISPR gRNA sequence
caaaggaggattcatggggt

SEQ ID NO: 18296 - DNA, 20 bp, Artificial
  CRISPR gRNA sequence
aaaggaggattcatggggtg

SEQ ID NO: 18297 - DNA, 20 bp, Artificial
  CRISPR gRNA sequence
gaggattcatggggtgaggt

SEQ ID NO: 18298 - DNA, 20 bp, Artificial
  CRISPR gRNA sequence
gggtgaggttggtacctcta

SEQ ID NO: 18299 - DNA, 20 bp, Artificial
  CRISPR gRNA sequence
cctctatggctcaccaacaa

SEQ ID NO: 18300 - DNA, 20 bp, Artificial
  CRISPR gRNA sequence
ctctatggctcaccaacaat

SEQ ID NO: 18301 - DNA, 20 bp, Artificial
  CRISPR gRNA sequence
tctatggctcaccaacaata

SEQ ID NO: 18302 - DNA, 20 bp, Artificial
  CRISPR gRNA sequence
caccaacaatagggcctgca

SEQ ID NO: 18303 - DNA, 20 bp, Artificial
  CRISPR gRNA sequence
ccaacaatagggcctgcaca

SEQ ID NO: 18304 - DNA, 20 bp, Artificial
  CRISPR gRNA sequence
aatagggcctgcacagagcc

SEQ ID NO: 18305 - DNA, 20 bp, Artificial
  CRISPR gRNA sequence
tgcacagagcctggtaccta

SEQ ID NO: 18306 - DNA, 20 bp, Artificial
  CRISPR gRNA sequence
ggtacctatagatgttcaca

SEQ ID NO: 18307 - DNA, 20 bp, Artificial
  CRISPR gRNA sequence
cctctgctcttgccacccca

SEQ ID NO: 18308 - DNA, 20 bp, Artificial
  CRISPR gRNA sequence
ctctgctcttgccaccccac

SEQ ID NO: 18309 - DNA, 20 bp, Artificial
  CRISPR gRNA sequence
ttgccaccccacaggctgtc

SEQ ID NO: 18310 - DNA, 20 bp, Artificial
  CRISPR gRNA sequence
ccccacaggctgtctggtga

SEQ ID NO: 18311 - DNA, 20 bp, Artificial
  CRISPR gRNA sequence
tgatggcttgatttgtgccc

SEQ ID NO: 18312 - DNA, 20 bp, Artificial
  CRISPR gRNA sequence
atggcttgatttgtgcccaa

SEQ ID NO: 18313 - DNA, 20 bp, Artificial
  CRISPR gRNA sequence
ttgatttgtgcccaagagcc

SEQ ID NO: 18314 - DNA, 20 bp, Artificial
  CRISPR gRNA sequence
tgatttgtgcccaagagccc

SEQ ID NO: 18315 - DNA, 20 bp, Artificial
  CRISPR gRNA sequence
gatttgtgcccaagagccca

SEQ ID NO: 18316 - DNA, 20 bp, Artificial
  CRISPR gRNA sequence
tgcccaagagcccagggtcc

SEQ ID NO: 18317 - DNA, 20 bp, Artificial
  CRISPR gRNA sequence
gcccaagagcccagggtcct

SEQ ID NO: 18318 - DNA, 20 bp, Artificial
  CRISPR gRNA sequence
cccaagagcccagggtcctg

SEQ ID NO: 18319 - DNA, 20 bp, Artificial
  CRISPR gRNA sequence
aagagcccagggtcctgggg

SEQ ID NO: 18320 - DNA, 20 bp, Artificial
  CRISPR gRNA sequence
gagcccagggtcctggggaa

SEQ ID NO: 18321 - DNA, 20 bp, Artificial
  CRISPR gRNA sequence
ccagggtcctggggaagaga

SEQ ID NO: 18322 - DNA, 20 bp, Artificial
  CRISPR gRNA sequence
cagggtcctggggaagagat

SEQ ID NO: 18323 - DNA, 20 bp, Artificial
  CRISPR gRNA sequence
gggaagagataggaacatgc

SEQ ID NO: 18324 - DNA, 20 bp, Artificial
  CRISPR gRNA sequence
agataggaacatgctggact

SEQ ID NO: 18325 - DNA, 20 bp, Artificial
  CRISPR gRNA sequence
ataggaacatgctggacttg

SEQ ID NO: 18326 - DNA, 20 bp, Artificial
  CRISPR gRNA sequence
ggaacatgctggacttggag

SEQ ID NO: 18327 - DNA, 20 bp, Artificial
  CRISPR gRNA sequence
gaacatgctggacttggagc

SEQ ID NO: 18328 - DNA, 20 bp, Artificial
  CRISPR gRNA sequence
atgctggacttggagcagga

SEQ ID NO: 18329 - DNA, 20 bp, Artificial
  CRISPR gRNA sequence
tgctggacttggagcaggat

SEQ ID NO: 18330 - DNA, 20 bp, Artificial
  CRISPR gRNA sequence
gctggacttggagcaggatg

SEQ ID NO: 18331 - DNA, 20 bp, Artificial
  CRISPR gRNA sequence
ctggacttggagcaggatgg

SEQ ID NO: 18332 - DNA, 20 bp, Artificial
  CRISPR gRNA sequence
ggacttggagcaggatgggg

SEQ ID NO: 18333 - DNA, 20 bp, Artificial
  CRISPR gRNA sequence
gacttggagcaggatggggg

SEQ ID NO: 18334 - DNA, 20 bp, Artificial
  CRISPR gRNA sequence
cttggagcaggatgggggag

SEQ ID NO: 18335 - DNA, 20 bp, Artificial
  CRISPR gRNA sequence
gagcaggatgggggaggagc

SEQ ID NO: 18336 - DNA, 20 bp, Artificial
  CRISPR gRNA sequence
gatgggggaggagctggatg

SEQ ID NO: 18337 - DNA, 20 bp, Artificial
  CRISPR gRNA sequence
tgggggaggagctggatgta

SEQ ID NO: 18338 - DNA, 20 bp, Artificial
  CRISPR gRNA sequence
gggggaggagctggatgtag

SEQ ID NO: 18339 - DNA, 20 bp, Artificial
  CRISPR gRNA sequence
ggaggagctggatgtagagg

SEQ ID NO: 18340 - DNA, 20 bp, Artificial
  CRISPR gRNA sequence
ggagctggatgtagaggaag

SEQ ID NO: 18341 - DNA, 20 bp, Artificial
  CRISPR gRNA sequence
ggaagaagcccctcactctc

SEQ ID NO: 18342 - DNA, 20 bp, Artificial
  CRISPR gRNA sequence
cagcctgctgtttgcaaacc

SEQ ID NO: 18343 - DNA, 20 bp, Artificial
  CRISPR gRNA sequence
tgctgtttgcaaaccaagtg

SEQ ID NO: 18344 - DNA, 20 bp, Artificial
  CRISPR gRNA sequence
caaaccaagtgtagatatcc

SEQ ID NO: 18345 - DNA, 20 bp, Artificial
  CRISPR gRNA sequence
aaaccaagtgtagatatccc

SEQ ID NO: 18346 - DNA, 20 bp, Artificial
  CRISPR gRNA sequence
accaagtgtagatatcccag

SEQ ID NO: 18347 - DNA, 20 bp, Artificial
  CRISPR gRNA sequence
tgtagatatcccaggagaac

SEQ ID NO: 18348 - DNA, 20 bp, Artificial
  CRISPR gRNA sequence
gatatcccaggagaacgaga

SEQ ID NO: 18349 - DNA, 20 bp, Artificial
  CRISPR gRNA sequence
tatcccaggagaacgagaca

SEQ ID NO: 18350 - DNA, 20 bp, Artificial
  CRISPR gRNA sequence
tcccaggagaacgagacaga

SEQ ID NO: 18351 - DNA, 20 bp, Artificial
  CRISPR gRNA sequence
ccaggagaacgagacagaga

SEQ ID NO: 18352 - DNA, 20 bp, Artificial
  CRISPR gRNA sequence
caggagaacgagacagagag

SEQ ID NO: 18353 - DNA, 20 bp, Artificial
  CRISPR gRNA sequence
acgagacagagagaggactt

SEQ ID NO: 18354 - DNA, 20 bp, Artificial
  CRISPR gRNA sequence
gagacagagagaggacttaa

SEQ ID NO: 18355 - DNA, 20 bp, Artificial
  CRISPR gRNA sequence
gaggacttaagagaaactac

SEQ ID NO: 18356 - DNA, 20 bp, Artificial
  CRISPR gRNA sequence
agaaactactggtctcactc

SEQ ID NO: 18357 - DNA, 20 bp, Artificial
  CRISPR gRNA sequence
cactcaagactttcacttcc

SEQ ID NO: 18358 - DNA, 20 bp, Artificial
  CRISPR gRNA sequence
ctcaagactttcacttcctg

SEQ ID NO: 18359 - DNA, 20 bp, Artificial
  CRISPR gRNA sequence
aagactttcacttcctggag

SEQ ID NO: 18360 - DNA, 20 bp, Artificial
  CRISPR gRNA sequence
ttcacttcctggagtggcac

SEQ ID NO: 18361 - DNA, 20 bp, Artificial
  CRISPR gRNA sequence
tcacttcctggagtggcacg

SEQ ID NO: 18362 - DNA, 20 bp, Artificial
  CRISPR gRNA sequence
acttcctggagtggcacgag

SEQ ID NO: 18363 - DNA, 20 bp, Artificial
  CRISPR gRNA sequence
cttcctggagtggcacgagg

SEQ ID NO: 18364 - DNA, 20 bp, Artificial
  CRISPR gRNA sequence
ggagtggcacgaggaggtca

SEQ ID NO: 18365 - DNA, 20 bp, Artificial
  CRISPR gRNA sequence
gagtggcacgaggaggtcac

SEQ ID NO: 18366 - DNA, 20 bp, Artificial
  CRISPR gRNA sequence
gtggcacgaggaggtcacag

SEQ ID NO: 18367 - DNA, 20 bp, Artificial
  CRISPR gRNA sequence
cacgaggaggtcacaggaga

SEQ ID NO: 18368 - DNA, 20 bp, Artificial
  CRISPR gRNA sequence
cgaggaggtcacaggagacg

SEQ ID NO: 18369 - DNA, 20 bp, Artificial
  CRISPR gRNA sequence
aggaggtcacaggagacgga

SEQ ID NO: 18370 - DNA, 20 bp, Artificial
  CRISPR gRNA sequence
ggaggtcacaggagacggag

SEQ ID NO: 18371 - DNA, 20 bp, Artificial
  CRISPR gRNA sequence
caggagacggagaggaaact

SEQ ID NO: 18372 - DNA, 20 bp, Artificial
  CRISPR gRNA sequence
aggagacggagaggaaacta

SEQ ID NO: 18373 - DNA, 20 bp, Artificial
  CRISPR gRNA sequence
ggagaggaaactaaggcatg

SEQ ID NO: 18374 - DNA, 20 bp, Artificial
  CRISPR gRNA sequence
tgtagcaacactgcaatgct

SEQ ID NO: 18375 - DNA, 20 bp, Artificial
  CRISPR gRNA sequence
gtagcaacactgcaatgctc

SEQ ID NO: 18376 - DNA, 20 bp, Artificial
  CRISPR gRNA sequence
tagcaacactgcaatgctca

SEQ ID NO: 18377 - DNA, 20 bp, Artificial
  CRISPR gRNA sequence
agcaacactgcaatgctcag

SEQ ID NO: 18378 - DNA, 20 bp, Artificial
  CRISPR gRNA sequence
ctgcaatgctcaggggctta

SEQ ID NO: 18379 - DNA, 20 bp, Artificial
  CRISPR gRNA sequence
tgcaatgctcaggggcttat

SEQ ID NO: 18380 - DNA, 20 bp, Artificial
  CRISPR gRNA sequence
tgctcaggggcttatgggcc

SEQ ID NO: 18381 - DNA, 20 bp, Artificial
  CRISPR gRNA sequence
ggggcttatgggcctggaaa

SEQ ID NO: 18382 - DNA, 20 bp, Artificial
  CRISPR gRNA sequence
tatgggcctggaaacagttg

SEQ ID NO: 18383 - DNA, 20 bp, Artificial
  CRISPR gRNA sequence
atgggcctggaaacagttgc

SEQ ID NO: 18384 - DNA, 20 bp, Artificial
  CRISPR gRNA sequence
ggatctgatcatttgtcctc

SEQ ID NO: 18385 - DNA, 20 bp, Artificial
  CRISPR gRNA sequence
gatctgatcatttgtcctca

SEQ ID NO: 18386 - DNA, 20 bp, Artificial
  CRISPR gRNA sequence
ctgatcatttgtcctcaagg

SEQ ID NO: 18387 - DNA, 20 bp, Artificial
  CRISPR gRNA sequence
tgatcatttgtcctcaaggc

SEQ ID NO: 18388 - DNA, 20 bp, Artificial
  CRISPR gRNA sequence
gatcatttgtcctcaaggca

SEQ ID NO: 18389 - DNA, 20 bp, Artificial
  CRISPR gRNA sequence
tcatttgtcctcaaggcagg

SEQ ID NO: 18390 - DNA, 20 bp, Artificial
  CRISPR gRNA sequence
tgtcctcaaggcagggagac

SEQ ID NO: 18391 - DNA, 20 bp, Artificial
  CRISPR gRNA sequence
cctcaaggcagggagactag

SEQ ID NO: 18392 - DNA, 20 bp, Artificial
  CRISPR gRNA sequence
gtgcatgtgtatgtgtgtaa

SEQ ID NO: 18393 - DNA, 20 bp, Artificial
  CRISPR gRNA sequence
tgcatgtgtatgtgtgtaat

SEQ ID NO: 18394 - DNA, 20 bp, Artificial
  CRISPR gRNA sequence
gcatgtgtatgtgtgtaatg

SEQ ID NO: 18395 - DNA, 20 bp, Artificial
  CRISPR gRNA sequence
catgtgtatgtgtgtaatgg

SEQ ID NO: 18396 - DNA, 20 bp, Artificial
  CRISPR gRNA sequence
gtgtatgtgtgtaatggggg

SEQ ID NO: 18397 - DNA, 20 bp, Artificial
  CRISPR gRNA sequence
tgtatgtgtgtaatgggggc

SEQ ID NO: 18398 - DNA, 20 bp, Artificial
  CRISPR gRNA sequence
tatgtgtgtaatgggggcag

SEQ ID NO: 18399 - DNA, 20 bp, Artificial
  CRISPR gRNA sequence
atgtgtgtaatgggggcagg

SEQ ID NO: 18400 - DNA, 20 bp, Artificial
  CRISPR gRNA sequence
gtgtaatgggggcaggaggt

SEQ ID NO: 18401 - DNA, 20 bp, Artificial
  CRISPR gRNA sequence
atgggggcaggaggtcagat

SEQ ID NO: 18402 - DNA, 20 bp, Artificial
  CRISPR gRNA sequence
aggtcagatgagcttcgtgt

SEQ ID NO: 18403 - DNA, 20 bp, Artificial
  CRISPR gRNA sequence
ggtcagatgagcttcgtgtc

SEQ ID NO: 18404 - DNA, 20 bp, Artificial
  CRISPR gRNA sequence
tcagatgagcttcgtgtcag

SEQ ID NO: 18405 - DNA, 20 bp, Artificial
  CRISPR gRNA sequence
agatgagcttcgtgtcagga

SEQ ID NO: 18406 - DNA, 20 bp, Artificial
  CRISPR gRNA sequence
gatgagcttcgtgtcaggag

SEQ ID NO: 18407 - DNA, 20 bp, Artificial
  CRISPR gRNA sequence
gcttcgtgtcaggagaggtc

SEQ ID NO: 18408 - DNA, 20 bp, Artificial
  CRISPR gRNA sequence
ttcgtgtcaggagaggtctg

SEQ ID NO: 18409 - DNA, 20 bp, Artificial
  CRISPR gRNA sequence
aggtctggagatattgctat

SEQ ID NO: 18410 - DNA, 20 bp, Artificial
  CRISPR gRNA sequence
ctggagatattgctattggt

SEQ ID NO: 18411 - DNA, 20 bp, Artificial
  CRISPR gRNA sequence
aaatcccctttctgacctgc

SEQ ID NO: 18412 - DNA, 20 bp, Artificial
  CRISPR gRNA sequence
tttctgacctgcaagctcct

SEQ ID NO: 18413 - DNA, 20 bp, Artificial
  CRISPR gRNA sequence
caagctcctcagctgtgcca

SEQ ID NO: 18414 - DNA, 20 bp, Artificial
  CRISPR gRNA sequence
aagctcctcagctgtgccac

SEQ ID NO: 18415 - DNA, 20 bp, Artificial
  CRISPR gRNA sequence
agctcctcagctgtgccaca

SEQ ID NO: 18416 - DNA, 20 bp, Artificial
  CRISPR gRNA sequence
gctcctcagctgtgccacag

SEQ ID NO: 18417 - DNA, 20 bp, Artificial
  CRISPR gRNA sequence
tcagctgtgccacaggggct

SEQ ID NO: 18418 - DNA, 20 bp, Artificial
  CRISPR gRNA sequence
gggcttggctgcaaaatcaa

SEQ ID NO: 18419 - DNA, 20 bp, Artificial
  CRISPR gRNA sequence
gcaaaatcaaaagttgaatc

SEQ ID NO: 18420 - DNA, 20 bp, Artificial
  CRISPR gRNA sequence
caaaagttgaatccagtcga

SEQ ID NO: 18421 - DNA, 20 bp, Artificial
  CRISPR gRNA sequence
aaaagttgaatccagtcgat

SEQ ID NO: 18422 - DNA, 20 bp, Artificial
  CRISPR gRNA sequence
gcctatttgttttgtttccc

SEQ ID NO: 18423 - DNA, 20 bp, Artificial
  CRISPR gRNA sequence
tttgtttcccaagccaatat

SEQ ID NO: 18424 - DNA, 20 bp, Artificial
  CRISPR gRNA sequence
accatcacaatgtctctata

SEQ ID NO: 18425 - DNA, 20 bp, Artificial
  CRISPR gRNA sequence
catcacaatgtctctatata

SEQ ID NO: 18426 - DNA, 20 bp, Artificial
  CRISPR gRNA sequence
agagtacacacaattgttac

SEQ ID NO: 18427 - DNA, 20 bp, Artificial
  CRISPR gRNA sequence
agtacacacaattgttacca

SEQ ID NO: 18428 - DNA, 20 bp, Artificial
  CRISPR gRNA sequence
gtacacacaattgttaccag

SEQ ID NO: 18429 - DNA, 20 bp, Artificial
  CRISPR gRNA sequence
actccctattgccttctgcc

SEQ ID NO: 18430 - DNA, 20 bp, Artificial
  CRISPR gRNA sequence
ggacacattttacatcatta

SEQ ID NO: 18431 - DNA, 20 bp, Artificial
  CRISPR gRNA sequence
ttacatcattatggcccctt

SEQ ID NO: 18432 - DNA, 20 bp, Artificial
  CRISPR gRNA sequence
attatggcccctttggtatt

SEQ ID NO: 18433 - DNA, 20 bp, Artificial
  CRISPR gRNA sequence
gtatttggatttgccaccct

SEQ ID NO: 18434 - DNA, 20 bp, Artificial
  CRISPR gRNA sequence
tggatttgccacccttggct

SEQ ID NO: 18435 - DNA, 20 bp, Artificial
  CRISPR gRNA sequence
gatttgccacccttggcttg

SEQ ID NO: 18436 - DNA, 20 bp, Artificial
  CRISPR gRNA sequence
atttgccacccttggcttgg

SEQ ID NO: 18437 - DNA, 20 bp, Artificial
  CRISPR gRNA sequence
ccttggcttggaggcccttg

SEQ ID NO: 18438 - DNA, 20 bp, Artificial
  CRISPR gRNA sequence
cttggcttggaggcccttgc

SEQ ID NO: 18439 - DNA, 20 bp, Artificial
  CRISPR gRNA sequence
tggaggcccttgcaggtccc

SEQ ID NO: 18440 - DNA, 20 bp, Artificial
  CRISPR gRNA sequence
ccttgcaggtcccaagataa

SEQ ID NO: 18441 - DNA, 20 bp, Artificial
  CRISPR gRNA sequence
caggtcccaagataatggct

SEQ ID NO: 18442 - DNA, 20 bp, Artificial
  CRISPR gRNA sequence
aggtcccaagataatggctt

SEQ ID NO: 18443 - DNA, 20 bp, Artificial
  CRISPR gRNA sequence
gtcccaagataatggcttgg

SEQ ID NO: 18444 - DNA, 20 bp, Artificial
  CRISPR gRNA sequence
tcccaagataatggcttggg

SEQ ID NO: 18445 - DNA, 20 bp, Artificial
  CRISPR gRNA sequence
cccaagataatggcttggga

SEQ ID NO: 18446 - DNA, 20 bp, Artificial
  CRISPR gRNA sequence
agataatggcttgggaggga

SEQ ID NO: 18447 - DNA, 20 bp, Artificial
  CRISPR gRNA sequence
gataatggcttgggagggat

SEQ ID NO: 18448 - DNA, 20 bp, Artificial
  CRISPR gRNA sequence
gcttgggagggatgggtgac

SEQ ID NO: 18449 - DNA, 20 bp, Artificial
  CRISPR gRNA sequence
cttgggagggatgggtgact

SEQ ID NO: 18450 - DNA, 20 bp, Artificial
  CRISPR gRNA sequence
ttgggagggatgggtgactg

SEQ ID NO: 18451 - DNA, 20 bp, Artificial
  CRISPR gRNA sequence
ggagggatgggtgactgggg

SEQ ID NO: 18452 - DNA, 20 bp, Artificial
  CRISPR gRNA sequence
gagggatgggtgactggggc

SEQ ID NO: 18453 - DNA, 20 bp, Artificial
  CRISPR gRNA sequence
agggatgggtgactggggca

SEQ ID NO: 18454 - DNA, 20 bp, Artificial
  CRISPR gRNA sequence
ggatgggtgactggggcagg

SEQ ID NO: 18455 - DNA, 20 bp, Artificial
  CRISPR gRNA sequence
atgggtgactggggcaggga

SEQ ID NO: 18456 - DNA, 20 bp, Artificial
  CRISPR gRNA sequence
tgggtgactggggcagggag

SEQ ID NO: 18457 - DNA, 20 bp, Artificial
  CRISPR gRNA sequence
gtgactggggcagggagagg

SEQ ID NO: 18458 - DNA, 20 bp, Artificial
  CRISPR gRNA sequence
tgactggggcagggagaggc

SEQ ID NO: 18459 - DNA, 20 bp, Artificial
  CRISPR gRNA sequence
aattatgtcctgtcctgcaa

SEQ ID NO: 18460 - DNA, 20 bp, Artificial
  CRISPR gRNA sequence
tcctgtcctgcaatggaatt

SEQ ID NO: 18461 - DNA, 20 bp, Artificial
  CRISPR gRNA sequence
cctgtcctgcaatggaattg

SEQ ID NO: 18462 - DNA, 20 bp, Artificial
  CRISPR gRNA sequence
tgcaatggaattgaggtgta

SEQ ID NO: 18463 - DNA, 20 bp, Artificial
  CRISPR gRNA sequence
aatggaattgaggtgtacag

SEQ ID NO: 18464 - DNA, 20 bp, Artificial
  CRISPR gRNA sequence
atggaattgaggtgtacagt

SEQ ID NO: 18465 - DNA, 20 bp, Artificial
  CRISPR gRNA sequence
tggaattgaggtgtacagta

SEQ ID NO: 18466 - DNA, 20 bp, Artificial
  CRISPR gRNA sequence
tacagtagggtctttttcta

SEQ ID NO: 18467 - DNA, 20 bp, Artificial
  CRISPR gRNA sequence
cagtagggtctttttctaca

SEQ ID NO: 18468 - DNA, 20 bp, Artificial
  CRISPR gRNA sequence
agtagggtctttttctacag

SEQ ID NO: 18469 - DNA, 20 bp, Artificial
  CRISPR gRNA sequence
gtagggtctttttctacaga

SEQ ID NO: 18470 - DNA, 20 bp, Artificial
  CRISPR gRNA sequence
tctttttctacagagggtct

SEQ ID NO: 18471 - DNA, 20 bp, Artificial
  CRISPR gRNA sequence
tttttctacagagggtcttg

SEQ ID NO: 18472 - DNA, 20 bp, Artificial
  CRISPR gRNA sequence
ttttctacagagggtcttgg

SEQ ID NO: 18473 - DNA, 20 bp, Artificial
  CRISPR gRNA sequence
tttctacagagggtcttgga

SEQ ID NO: 18474 - DNA, 20 bp, Artificial
  CRISPR gRNA sequence
ttctacagagggtcttggag

SEQ ID NO: 18475 - DNA, 20 bp, Artificial
  CRISPR gRNA sequence
cagagggtcttggaggggac

SEQ ID NO: 18476 - DNA, 20 bp, Artificial
  CRISPR gRNA sequence
gtcttggaggggactggccc

SEQ ID NO: 18477 - DNA, 20 bp, Artificial
  CRISPR gRNA sequence
tcttggaggggactggccct

SEQ ID NO: 18478 - DNA, 20 bp, Artificial
  CRISPR gRNA sequence
actggccctgggtacccaaa

SEQ ID NO: 18479 - DNA, 20 bp, Artificial
  CRISPR gRNA sequence
ctggccctgggtacccaaac

SEQ ID NO: 18480 - DNA, 20 bp, Artificial
  CRISPR gRNA sequence
ccctgggtacccaaacaggc

SEQ ID NO: 18481 - DNA, 20 bp, Artificial
  CRISPR gRNA sequence
ccaaacaggccagttccaca

SEQ ID NO: 18482 - DNA, 20 bp, Artificial
  CRISPR gRNA sequence
aaacaggccagttccacaca

SEQ ID NO: 18483 - DNA, 20 bp, Artificial
  CRISPR gRNA sequence
caggccagttccacacagag

SEQ ID NO: 18484 - DNA, 20 bp, Artificial
  CRISPR gRNA sequence
aggccagttccacacagaga

SEQ ID NO: 18485 - DNA, 20 bp, Artificial
  CRISPR gRNA sequence
gccagttccacacagagaag

SEQ ID NO: 18486 - DNA, 20 bp, Artificial
  CRISPR gRNA sequence
agttccacacagagaaggag

SEQ ID NO: 18487 - DNA, 20 bp, Artificial
  CRISPR gRNA sequence
gttccacacagagaaggagc

SEQ ID NO: 18488 - DNA, 20 bp, Artificial
  CRISPR gRNA sequence
ccacacagagaaggagcagg

SEQ ID NO: 18489 - DNA, 20 bp, Artificial
  CRISPR gRNA sequence
agaaggagcaggaagcacta

SEQ ID NO: 18490 - DNA, 20 bp, Artificial
  CRISPR gRNA sequence
agcaggaagcactaaagttg

SEQ ID NO: 18491 - DNA, 20 bp, Artificial
  CRISPR gRNA sequence
agcactaaagttgcagcatc

SEQ ID NO: 18492 - DNA, 20 bp, Artificial
  CRISPR gRNA sequence
gcactaaagttgcagcatct

SEQ ID NO: 18493 - DNA, 20 bp, Artificial
  CRISPR gRNA sequence
cactaaagttgcagcatctg

SEQ ID NO: 18494 - DNA, 20 bp, Artificial
  CRISPR gRNA sequence
agttgcagcatctggggtgt

SEQ ID NO: 18495 - DNA, 20 bp, Artificial
  CRISPR gRNA sequence
gttgcagcatctggggtgtt

SEQ ID NO: 18496 - DNA, 20 bp, Artificial
  CRISPR gRNA sequence
gggtgttgggtgcactttcc

SEQ ID NO: 18497 - DNA, 20 bp, Artificial
  CRISPR gRNA sequence
cactttcccagctctgctgc

SEQ ID NO: 18498 - DNA, 20 bp, Artificial
  CRISPR gRNA sequence
tcccagctctgctgccagct

SEQ ID NO: 18499 - DNA, 20 bp, Artificial
  CRISPR gRNA sequence
agctctgctgccagctcaga

SEQ ID NO: 18500 - DNA, 20 bp, Artificial
  CRISPR gRNA sequence
ctgctgccagctcagatgga

SEQ ID NO: 18501 - DNA, 20 bp, Artificial
  CRISPR gRNA sequence
tgctgccagctcagatggaa

SEQ ID NO: 18502 - DNA, 20 bp, Artificial
  CRISPR gRNA sequence
gctcagatggaaaggtgatt

SEQ ID NO: 18503 - DNA, 20 bp, Artificial
  CRISPR gRNA sequence
tcagatggaaaggtgattaa

SEQ ID NO: 18504 - DNA, 20 bp, Artificial
  CRISPR gRNA sequence
cagatggaaaggtgattaag

SEQ ID NO: 18505 - DNA, 20 bp, Artificial
  CRISPR gRNA sequence
tggaaaggtgattaagaggt

SEQ ID NO: 18506 - DNA, 20 bp, Artificial
  CRISPR gRNA sequence
gattaagaggtaagctgtct

SEQ ID NO: 18507 - DNA, 20 bp, Artificial
  CRISPR gRNA sequence
tgagatcacacctgtaatcc

SEQ ID NO: 18508 - DNA, 20 bp, Artificial
  CRISPR gRNA sequence
cacctgtaatcccagcactt

SEQ ID NO: 18509 - DNA, 20 bp, Artificial
  CRISPR gRNA sequence
acctgtaatcccagcacttt

SEQ ID NO: 18510 - DNA, 20 bp, Artificial
  CRISPR gRNA sequence
ctgtaatcccagcactttgg

SEQ ID NO: 18511 - DNA, 20 bp, Artificial
  CRISPR gRNA sequence
tgtaatcccagcactttggg

SEQ ID NO: 18512 - DNA, 20 bp, Artificial
  CRISPR gRNA sequence
tcccagcactttgggaggct

SEQ ID NO: 18513 - DNA, 20 bp, Artificial
  CRISPR gRNA sequence
cccagcactttgggaggctg

SEQ ID NO: 18514 - DNA, 20 bp, Artificial
  CRISPR gRNA sequence
cagcactttgggaggctgag

SEQ ID NO: 18515 - DNA, 20 bp, Artificial
  CRISPR gRNA sequence
agcactttgggaggctgagg

SEQ ID NO: 18516 - DNA, 20 bp, Artificial
  CRISPR gRNA sequence
gcactttgggaggctgagga

SEQ ID NO: 18517 - DNA, 20 bp, Artificial
  CRISPR gRNA sequence
actttgggaggctgaggagg

SEQ ID NO: 18518 - DNA, 20 bp, Artificial
  CRISPR gRNA sequence
ctttgggaggctgaggaggg

SEQ ID NO: 18519 - DNA, 20 bp, Artificial
  CRISPR gRNA sequence
ctgaggagggaggatgactt

SEQ ID NO: 18520 - DNA, 20 bp, Artificial
  CRISPR gRNA sequence
tgaggagggaggatgacttg

SEQ ID NO: 18521 - DNA, 20 bp, Artificial
  CRISPR gRNA sequence
gagggaggatgacttgaggc

SEQ ID NO: 18522 - DNA, 20 bp, Artificial
  CRISPR gRNA sequence
agggaggatgacttgaggcc

SEQ ID NO: 18523 - DNA, 20 bp, Artificial
  CRISPR gRNA sequence
ggaggatgacttgaggccag

SEQ ID NO: 18524 - DNA, 20 bp, Artificial
  CRISPR gRNA sequence
tgacttgaggccaggagttt

SEQ ID NO: 18525 - DNA, 20 bp, Artificial
  CRISPR gRNA sequence
tgaggccaggagtttgagac

SEQ ID NO: 18526 - DNA, 20 bp, Artificial
  CRISPR gRNA sequence
ccaggagtttgagaccagcc

SEQ ID NO: 18527 - DNA, 20 bp, Artificial
  CRISPR gRNA sequence
caggagtttgagaccagcct

SEQ ID NO: 18528 - DNA, 20 bp, Artificial
  CRISPR gRNA sequence
tgagaccagcctgggcaaca

SEQ ID NO: 18529 - DNA, 20 bp, Artificial
  CRISPR gRNA sequence
atagtgaaaccccatctctt

SEQ ID NO: 18530 - DNA, 20 bp, Artificial
  CRISPR gRNA sequence
ccccatctcttcagaaataa

SEQ ID NO: 18531 - DNA, 20 bp, Artificial
  CRISPR gRNA sequence
gaaataaaagatacaaaaat

SEQ ID NO: 18532 - DNA, 20 bp, Artificial
  CRISPR gRNA sequence
taaaagatacaaaaattagc

SEQ ID NO: 18533 - DNA, 20 bp, Artificial
  CRISPR gRNA sequence
aaaagatacaaaaattagct

SEQ ID NO: 18534 - DNA, 20 bp, Artificial
  CRISPR gRNA sequence
atacaaaaattagctgggtg

SEQ ID NO: 18535 - DNA, 20 bp, Artificial
  CRISPR gRNA sequence
caaaaattagctgggtgtgg

SEQ ID NO: 18536 - DNA, 20 bp, Artificial
  CRISPR gRNA sequence
aaaattagctgggtgtggtg

SEQ ID NO: 18537 - DNA, 20 bp, Artificial
  CRISPR gRNA sequence
ggtgtggtggagtgcccttg

SEQ ID NO: 18538 - DNA, 20 bp, Artificial
  CRISPR gRNA sequence
gtggagtgcccttgtagtct

SEQ ID NO: 18539 - DNA, 20 bp, Artificial
  CRISPR gRNA sequence
cccttgtagtctcggctact

SEQ ID NO: 18540 - DNA, 20 bp, Artificial
  CRISPR gRNA sequence
ccttgtagtctcggctactt

SEQ ID NO: 18541 - DNA, 20 bp, Artificial
  CRISPR gRNA sequence
ttgtagtctcggctacttgg

SEQ ID NO: 18542 - DNA, 20 bp, Artificial
  CRISPR gRNA sequence
tgtagtctcggctacttggg

SEQ ID NO: 18543 - DNA, 20 bp, Artificial
  CRISPR gRNA sequence
tctcggctacttgggaggct

SEQ ID NO: 18544 - DNA, 20 bp, Artificial
  CRISPR gRNA sequence
ctcggctacttgggaggctg

SEQ ID NO: 18545 - DNA, 20 bp, Artificial
  CRISPR gRNA sequence
ggctacttgggaggctgagg

SEQ ID NO: 18546 - DNA, 20 bp, Artificial
  CRISPR gRNA sequence
gctacttgggaggctgaggc

SEQ ID NO: 18547 - DNA, 20 bp, Artificial
  CRISPR gRNA sequence
tacttgggaggctgaggcag

SEQ ID NO: 18548 - DNA, 20 bp, Artificial
  CRISPR gRNA sequence
acttgggaggctgaggcagg

SEQ ID NO: 18549 - DNA, 20 bp, Artificial
  CRISPR gRNA sequence
gggaggctgaggcaggagga

SEQ ID NO: 18550 - DNA, 20 bp, Artificial
  CRISPR gRNA sequence
ctgaggcaggaggatggctt

SEQ ID NO: 18551 - DNA, 20 bp, Artificial
  CRISPR gRNA sequence
gcaggaggatggcttgagct

SEQ ID NO: 18552 - DNA, 20 bp, Artificial
  CRISPR gRNA sequence
caggaggatggcttgagctc

SEQ ID NO: 18553 - DNA, 20 bp, Artificial
  CRISPR gRNA sequence
ggaggatggcttgagctcag

SEQ ID NO: 18554 - DNA, 20 bp, Artificial
  CRISPR gRNA sequence
tggcttgagctcaggagctt

SEQ ID NO: 18555 - DNA, 20 bp, Artificial
  CRISPR gRNA sequence
ggcttgagctcaggagcttg

SEQ ID NO: 18556 - DNA, 20 bp, Artificial
  CRISPR gRNA sequence
agctcaggagcttgaggctg

SEQ ID NO: 18557 - DNA, 20 bp, Artificial
  CRISPR gRNA sequence
caggagcttgaggctgcagt

SEQ ID NO: 18558 - DNA, 20 bp, Artificial
  CRISPR gRNA sequence
tgtgccactgcactccaacc

SEQ ID NO: 18559 - DNA, 20 bp, Artificial
  CRISPR gRNA sequence
gtgccactgcactccaacct

SEQ ID NO: 18560 - DNA, 20 bp, Artificial
  CRISPR gRNA sequence
ctgcactccaacctgggcaa

SEQ ID NO: 18561 - DNA, 20 bp, Artificial
  CRISPR gRNA sequence
gcactccaacctgggcaaca

SEQ ID NO: 18562 - DNA, 20 bp, Artificial
  CRISPR gRNA sequence
tccaacctgggcaacagagt

SEQ ID NO: 18563 - DNA, 20 bp, Artificial
  CRISPR gRNA sequence
agactttgtctcataaatga

SEQ ID NO: 18564 - DNA, 20 bp, Artificial
  CRISPR gRNA sequence
gactttgtctcataaatgaa

SEQ ID NO: 18565 - DNA, 20 bp, Artificial
  CRISPR gRNA sequence
aaggatgaatgaatgaatga

SEQ ID NO: 18566 - DNA, 20 bp, Artificial
  CRISPR gRNA sequence
tgaatgaatgaatgaaagaa

SEQ ID NO: 18567 - DNA, 20 bp, Artificial
  CRISPR gRNA sequence
tgaatgaatgaaagaatggt

SEQ ID NO: 18568 - DNA, 20 bp, Artificial
  CRISPR gRNA sequence
tgaaagaatggtaagctccc

SEQ ID NO: 18569 - DNA, 20 bp, Artificial
  CRISPR gRNA sequence
gaaagaatggtaagctccct

SEQ ID NO: 18570 - DNA, 20 bp, Artificial
  CRISPR gRNA sequence
ggtaagctccctgggaactg

SEQ ID NO: 18571 - DNA, 20 bp, Artificial
  CRISPR gRNA sequence
gtaagctccctgggaactgt

SEQ ID NO: 18572 - DNA, 20 bp, Artificial
  CRISPR gRNA sequence
cctgggaactgtgggatgca

SEQ ID NO: 18573 - DNA, 20 bp, Artificial
  CRISPR gRNA sequence
tgggaactgtgggatgcaaa

SEQ ID NO: 18574 - DNA, 20 bp, Artificial
  CRISPR gRNA sequence
cctttttgccatcccaattc

SEQ ID NO: 18575 - DNA, 20 bp, Artificial
  CRISPR gRNA sequence
ccaattccagcaccgttgaa

SEQ ID NO: 18576 - DNA, 20 bp, Artificial
  CRISPR gRNA sequence
cgttgaatggatttccattg

SEQ ID NO: 18577 - DNA, 20 bp, Artificial
  CRISPR gRNA sequence
cattgcagctccctgccctt

SEQ ID NO: 18578 - DNA, 20 bp, Artificial
  CRISPR gRNA sequence
attgcagctccctgcccttt

SEQ ID NO: 18579 - DNA, 20 bp, Artificial
  CRISPR gRNA sequence
ccctttgggtttgaaccaac

SEQ ID NO: 18580 - DNA, 20 bp, Artificial
  CRISPR gRNA sequence
ggtttgaaccaaccagcctc

SEQ ID NO: 18581 - DNA, 20 bp, Artificial
  CRISPR gRNA sequence
caaccagcctctggcaaaca

SEQ ID NO: 18582 - DNA, 20 bp, Artificial
  CRISPR gRNA sequence
tctggcaaacaaagtaactt

SEQ ID NO: 18583 - DNA, 20 bp, Artificial
  CRISPR gRNA sequence
tggcaaacaaagtaacttca

SEQ ID NO: 18584 - DNA, 20 bp, Artificial
  CRISPR gRNA sequence
caaacaaagtaacttcagag

SEQ ID NO: 18585 - DNA, 20 bp, Artificial
  CRISPR gRNA sequence
aaacaaagtaacttcagagc

SEQ ID NO: 18586 - DNA, 20 bp, Artificial
  CRISPR gRNA sequence
aaagtaacttcagagcagga

SEQ ID NO: 18587 - DNA, 20 bp, Artificial
  CRISPR gRNA sequence
gtaacttcagagcaggaaag

SEQ ID NO: 18588 - DNA, 20 bp, Artificial
  CRISPR gRNA sequence
agtggaaaacaaattaaaat

SEQ ID NO: 18589 - DNA, 20 bp, Artificial
  CRISPR gRNA sequence
ttaaaattggctgcaatccc

SEQ ID NO: 18590 - DNA, 20 bp, Artificial
  CRISPR gRNA sequence
ttggctgcaatccctagcca

SEQ ID NO: 18591 - DNA, 20 bp, Artificial
  CRISPR gRNA sequence
tggctgcaatccctagccaa

SEQ ID NO: 18592 - DNA, 20 bp, Artificial
  CRISPR gRNA sequence
ggctgcaatccctagccaaa

SEQ ID NO: 18593 - DNA, 20 bp, Artificial
  CRISPR gRNA sequence
tccctagccaaagggcttct

SEQ ID NO: 18594 - DNA, 20 bp, Artificial
  CRISPR gRNA sequence
ctagccaaagggcttctcag

SEQ ID NO: 18595 - DNA, 20 bp, Artificial
  CRISPR gRNA sequence
ccaaagggcttctcagcagt

SEQ ID NO: 18596 - DNA, 20 bp, Artificial
  CRISPR gRNA sequence
aaagggcttctcagcagttg

SEQ ID NO: 18597 - DNA, 20 bp, Artificial
  CRISPR gRNA sequence
aagggcttctcagcagttgg

SEQ ID NO: 18598 - DNA, 20 bp, Artificial
  CRISPR gRNA sequence
ggcttctcagcagttggagg

SEQ ID NO: 18599 - DNA, 20 bp, Artificial
  CRISPR gRNA sequence
gcttctcagcagttggaggc

SEQ ID NO: 18600 - DNA, 20 bp, Artificial
  CRISPR gRNA sequence
cagcagttggaggcaggtta

SEQ ID NO: 18601 - DNA, 20 bp, Artificial
  CRISPR gRNA sequence
agttggaggcaggttaaaga

SEQ ID NO: 18602 - DNA, 20 bp, Artificial
  CRISPR gRNA sequence
tggaggcaggttaaagaaag

SEQ ID NO: 18603 - DNA, 20 bp, Artificial
  CRISPR gRNA sequence
ggaggcaggttaaagaaaga

SEQ ID NO: 18604 - DNA, 20 bp, Artificial
  CRISPR gRNA sequence
caggttaaagaaagaaggac

SEQ ID NO: 18605 - DNA, 20 bp, Artificial
  CRISPR gRNA sequence
taaagaaagaaggacaagct

SEQ ID NO: 18606 - DNA, 20 bp, Artificial
  CRISPR gRNA sequence
agaaggacaagctcagtcac

SEQ ID NO: 18607 - DNA, 20 bp, Artificial
  CRISPR gRNA sequence
agctcagtcacaagtgaaat

SEQ ID NO: 18608 - DNA, 20 bp, Artificial
  CRISPR gRNA sequence
catgtatctgtccaaaccca

SEQ ID NO: 18609 - DNA, 20 bp, Artificial
  CRISPR gRNA sequence
cccacagaatgtacaacacc

SEQ ID NO: 18610 - DNA, 20 bp, Artificial
  CRISPR gRNA sequence
cacagaatgtacaacaccaa

SEQ ID NO: 18611 - DNA, 20 bp, Artificial
  CRISPR gRNA sequence
accctcatgtaaacaaacca

SEQ ID NO: 18612 - DNA, 20 bp, Artificial
  CRISPR gRNA sequence
tgtaaacaaaccatggacct

SEQ ID NO: 18613 - DNA, 20 bp, Artificial
  CRISPR gRNA sequence
gtaaacaaaccatggacctt

SEQ ID NO: 18614 - DNA, 20 bp, Artificial
  CRISPR gRNA sequence
gtaataatgatgcatcaatg

SEQ ID NO: 18615 - DNA, 20 bp, Artificial
  CRISPR gRNA sequence
taataatgatgcatcaatgt

SEQ ID NO: 18616 - DNA, 20 bp, Artificial
  CRISPR gRNA sequence
attgattataacaaatgtat

SEQ ID NO: 18617 - DNA, 20 bp, Artificial
  CRISPR gRNA sequence
ttataacaaatgtatcagtc

SEQ ID NO: 18618 - DNA, 20 bp, Artificial
  CRISPR gRNA sequence
aaatgtatcagtctggtgct

SEQ ID NO: 18619 - DNA, 20 bp, Artificial
  CRISPR gRNA sequence
ctggtgctgagtgttcatca

SEQ ID NO: 18620 - DNA, 20 bp, Artificial
  CRISPR gRNA sequence
tggtgctgagtgttcatcat

SEQ ID NO: 18621 - DNA, 20 bp, Artificial
  CRISPR gRNA sequence
ggtgctgagtgttcatcatg

SEQ ID NO: 18622 - DNA, 20 bp, Artificial
  CRISPR gRNA sequence
gtgctgagtgttcatcatgg

SEQ ID NO: 18623 - DNA, 20 bp, Artificial
  CRISPR gRNA sequence
gctgagtgttcatcatgggg

SEQ ID NO: 18624 - DNA, 20 bp, Artificial
  CRISPR gRNA sequence
ctgagtgttcatcatggggg

SEQ ID NO: 18625 - DNA, 20 bp, Artificial
  CRISPR gRNA sequence
tgggggaggctatgcctgta

SEQ ID NO: 18626 - DNA, 20 bp, Artificial
  CRISPR gRNA sequence
gggggaggctatgcctgtat

SEQ ID NO: 18627 - DNA, 20 bp, Artificial
  CRISPR gRNA sequence
gggaggctatgcctgtatgg

SEQ ID NO: 18628 - DNA, 20 bp, Artificial
  CRISPR gRNA sequence
ggaggctatgcctgtatggg

SEQ ID NO: 18629 - DNA, 20 bp, Artificial
  CRISPR gRNA sequence
gctatgcctgtatgggagga

SEQ ID NO: 18630 - DNA, 20 bp, Artificial
  CRISPR gRNA sequence
tatgcctgtatgggaggacg

SEQ ID NO: 18631 - DNA, 20 bp, Artificial
  CRISPR gRNA sequence
atgcctgtatgggaggacgg

SEQ ID NO: 18632 - DNA, 20 bp, Artificial
  CRISPR gRNA sequence
cctgtatgggaggacggagg

SEQ ID NO: 18633 - DNA, 20 bp, Artificial
  CRISPR gRNA sequence
atgggaggacggaggtagat

SEQ ID NO: 18634 - DNA, 20 bp, Artificial
  CRISPR gRNA sequence
tgggaggacggaggtagatg

SEQ ID NO: 18635 - DNA, 20 bp, Artificial
  CRISPR gRNA sequence
gggaggacggaggtagatga

SEQ ID NO: 18636 - DNA, 20 bp, Artificial
  CRISPR gRNA sequence
ggaggtagatgagggatgtg

SEQ ID NO: 18637 - DNA, 20 bp, Artificial
  CRISPR gRNA sequence
gaggtagatgagggatgtga

SEQ ID NO: 18638 - DNA, 20 bp, Artificial
  CRISPR gRNA sequence
agatgagggatgtgaaggtc

SEQ ID NO: 18639 - DNA, 20 bp, Artificial
  CRISPR gRNA sequence
gtctagcttccttgctgtcc

SEQ ID NO: 18640 - DNA, 20 bp, Artificial
  CRISPR gRNA sequence
cttccttgctgtcccagctt

SEQ ID NO: 18641 - DNA, 20 bp, Artificial
  CRISPR gRNA sequence
cccagcttgagtgctcccta

SEQ ID NO: 18642 - DNA, 20 bp, Artificial
  CRISPR gRNA sequence
ccagcttgagtgctccctat

SEQ ID NO: 18643 - DNA, 20 bp, Artificial
  CRISPR gRNA sequence
ttgagtgctccctatgggat

SEQ ID NO: 18644 - DNA, 20 bp, Artificial
  CRISPR gRNA sequence
tgctccctatgggattggct

SEQ ID NO: 18645 - DNA, 20 bp, Artificial
  CRISPR gRNA sequence
tgctttcttcccttttcctt

SEQ ID NO: 18646 - DNA, 20 bp, Artificial
  CRISPR gRNA sequence
gctttcttcccttttccttc

SEQ ID NO: 18647 - DNA, 20 bp, Artificial
  CRISPR gRNA sequence
ttccctcctgtgaatgtccc

SEQ ID NO: 18648 - DNA, 20 bp, Artificial
  CRISPR gRNA sequence
gcaaatctccatctcctact

SEQ ID NO: 18649 - DNA, 20 bp, Artificial
  CRISPR gRNA sequence
ccatctcctacttggcttcc

SEQ ID NO: 18650 - DNA, 20 bp, Artificial
  CRISPR gRNA sequence
cttcccagacaatctgacct

SEQ ID NO: 18651 - DNA, 20 bp, Artificial
  CRISPR gRNA sequence
cttacttctatttttcctcc

SEQ ID NO: 18652 - DNA, 20 bp, Artificial
  CRISPR gRNA sequence
tacttctatttttcctccaa

SEQ ID NO: 18653 - DNA, 20 bp, Artificial
  CRISPR gRNA sequence
acttctatttttcctccaag

SEQ ID NO: 18654 - DNA, 20 bp, Artificial
  CRISPR gRNA sequence
cttctatttttcctccaaga

SEQ ID NO: 18655 - DNA, 20 bp, Artificial
  CRISPR gRNA sequence
tttttcctccaagagggacg

SEQ ID NO: 18656 - DNA, 20 bp, Artificial
  CRISPR gRNA sequence
agagggacgtggaaatccta

SEQ ID NO: 18657 - DNA, 20 bp, Artificial
  CRISPR gRNA sequence
gagggacgtggaaatcctac

SEQ ID NO: 18658 - DNA, 20 bp, Artificial
  CRISPR gRNA sequence
aatcctacaggaccccacaa

SEQ ID NO: 18659 - DNA, 20 bp, Artificial
  CRISPR gRNA sequence
ggaccccacaaaagacacca

SEQ ID NO: 18660 - DNA, 20 bp, Artificial
  CRISPR gRNA sequence
accacagatgccccctctga

SEQ ID NO: 18661 - DNA, 20 bp, Artificial
  CRISPR gRNA sequence
agatgccccctctgaaagtt

SEQ ID NO: 18662 - DNA, 20 bp, Artificial
  CRISPR gRNA sequence
gatgccccctctgaaagttc

SEQ ID NO: 18663 - DNA, 20 bp, Artificial
  CRISPR gRNA sequence
ccccctctgaaagttcaggc

SEQ ID NO: 18664 - DNA, 20 bp, Artificial
  CRISPR gRNA sequence
ggcaagccacctatcttctc

SEQ ID NO: 18665 - DNA, 20 bp, Artificial
  CRISPR gRNA sequence
gcaagccacctatcttctct

SEQ ID NO: 18666 - DNA, 20 bp, Artificial
  CRISPR gRNA sequence
atcttctctgggtcccgatt

SEQ ID NO: 18667 - DNA, 20 bp, Artificial
  CRISPR gRNA sequence
tcttctctgggtcccgattg

SEQ ID NO: 18668 - DNA, 20 bp, Artificial
  CRISPR gRNA sequence
acactgacctcataacaact

SEQ ID NO: 18669 - DNA, 20 bp, Artificial
  CRISPR gRNA sequence
ggaaaatcttaaaactcgaa

SEQ ID NO: 18670 - DNA, 20 bp, Artificial
  CRISPR gRNA sequence
gaaaatcttaaaactcgaat

SEQ ID NO: 18671 - DNA, 20 bp, Artificial
  CRISPR gRNA sequence
ctcgaatgggccatcatctc

SEQ ID NO: 18672 - DNA, 20 bp, Artificial
  CRISPR gRNA sequence
tctccagcttgtgcatttgc

SEQ ID NO: 18673 - DNA, 20 bp, Artificial
  CRISPR gRNA sequence
agcttgtgcatttgccagta

SEQ ID NO: 18674 - DNA, 20 bp, Artificial
  CRISPR gRNA sequence
gcttgtgcatttgccagtaa

SEQ ID NO: 18675 - DNA, 20 bp, Artificial
  CRISPR gRNA sequence
cttgtgcatttgccagtaaa

SEQ ID NO: 18676 - DNA, 20 bp, Artificial
  CRISPR gRNA sequence
gcatttgccagtaaagggta

SEQ ID NO: 18677 - DNA, 20 bp, Artificial
  CRISPR gRNA sequence
agtaaagggtaaagttattg

SEQ ID NO: 18678 - DNA, 20 bp, Artificial
  CRISPR gRNA sequence
gtaaagggtaaagttattgt

SEQ ID NO: 18679 - DNA, 20 bp, Artificial
  CRISPR gRNA sequence
agggtaaagttattgtgggt

SEQ ID NO: 18680 - DNA, 20 bp, Artificial
  CRISPR gRNA sequence
gggtaaagttattgtgggtg

SEQ ID NO: 18681 - DNA, 20 bp, Artificial
  CRISPR gRNA sequence
ggtaaagttattgtgggtga

SEQ ID NO: 18682 - DNA, 20 bp, Artificial
  CRISPR gRNA sequence
gtaaagttattgtgggtgag

SEQ ID NO: 18683 - DNA, 20 bp, Artificial
  CRISPR gRNA sequence
gttattgtgggtgaggggcc

SEQ ID NO: 18684 - DNA, 20 bp, Artificial
  CRISPR gRNA sequence
attgtgggtgaggggcctgg

SEQ ID NO: 18685 - DNA, 20 bp, Artificial
  CRISPR gRNA sequence
ggtgaggggcctggtggtcc

SEQ ID NO: 18686 - DNA, 20 bp, Artificial
  CRISPR gRNA sequence
gtgaggggcctggtggtccc

SEQ ID NO: 18687 - DNA, 20 bp, Artificial
  CRISPR gRNA sequence
gggcctggtggtcccaggat

SEQ ID NO: 18688 - DNA, 20 bp, Artificial
  CRISPR gRNA sequence
gtggtcccaggatgagaatg

SEQ ID NO: 18689 - DNA, 20 bp, Artificial
  CRISPR gRNA sequence
cccaggatgagaatgaagat

SEQ ID NO: 18690 - DNA, 20 bp, Artificial
  CRISPR gRNA sequence
agaatgaagatgagctgtat

SEQ ID NO: 18691 - DNA, 20 bp, Artificial
  CRISPR gRNA sequence
aagatgagctgtatgagctg

SEQ ID NO: 18692 - DNA, 20 bp, Artificial
  CRISPR gRNA sequence
tgagctgtatgagctgcagc

SEQ ID NO: 18693 - DNA, 20 bp, Artificial
  CRISPR gRNA sequence
gagctgtatgagctgcagcc

SEQ ID NO: 18694 - DNA, 20 bp, Artificial
  CRISPR gRNA sequence
gctgtatgagctgcagccag

SEQ ID NO: 18695 - DNA, 20 bp, Artificial
  CRISPR gRNA sequence
agctgcagccaggagacctt

SEQ ID NO: 18696 - DNA, 20 bp, Artificial
  CRISPR gRNA sequence
ggagaccttcggtccctgtc

SEQ ID NO: 18697 - DNA, 20 bp, Artificial
  CRISPR gRNA sequence
ttcggtccctgtccagaatg

SEQ ID NO: 18698 - DNA, 20 bp, Artificial
  CRISPR gRNA sequence
tcggtccctgtccagaatgc

SEQ ID NO: 18699 - DNA, 20 bp, Artificial
  CRISPR gRNA sequence
cggtccctgtccagaatgca

SEQ ID NO: 18700 - DNA, 20 bp, Artificial
  CRISPR gRNA sequence
ccctgtccagaatgcagggt

SEQ ID NO: 18701 - DNA, 20 bp, Artificial
  CRISPR gRNA sequence
cctgtccagaatgcagggtt

SEQ ID NO: 18702 - DNA, 20 bp, Artificial
  CRISPR gRNA sequence
ccagaatgcagggttgggat

SEQ ID NO: 18703 - DNA, 20 bp, Artificial
  CRISPR gRNA sequence
agaatgcagggttgggataa

SEQ ID NO: 18704 - DNA, 20 bp, Artificial
  CRISPR gRNA sequence
agttcccttccccgcttgcc

SEQ ID NO: 18705 - DNA, 20 bp, Artificial
  CRISPR gRNA sequence
cccgcttgcctggtctgtcc

SEQ ID NO: 18706 - DNA, 20 bp, Artificial
  CRISPR gRNA sequence
tgcctggtctgtcccagctc

SEQ ID NO: 18707 - DNA, 20 bp, Artificial
  CRISPR gRNA sequence
tggtctgtcccagctccaga

SEQ ID NO: 18708 - DNA, 20 bp, Artificial
  CRISPR gRNA sequence
ctgcatgccactcctaactg

SEQ ID NO: 18709 - DNA, 20 bp, Artificial
  CRISPR gRNA sequence
cctaactgcagtcaatgacc

SEQ ID NO: 18710 - DNA, 20 bp, Artificial
  CRISPR gRNA sequence
actgcagtcaatgacctgga

SEQ ID NO: 18711 - DNA, 20 bp, Artificial
  CRISPR gRNA sequence
ctgcagtcaatgacctggaa

SEQ ID NO: 18712 - DNA, 20 bp, Artificial
  CRISPR gRNA sequence
gcagtcaatgacctggaaag

SEQ ID NO: 18713 - DNA, 20 bp, Artificial
  CRISPR gRNA sequence
gacctggaaaggagtccaac

SEQ ID NO: 18714 - DNA, 20 bp, Artificial
  CRISPR gRNA sequence
ggagtccaacaagtttttcc

SEQ ID NO: 18715 - DNA, 20 bp, Artificial
  CRISPR gRNA sequence
gtccaacaagtttttcctgg

SEQ ID NO: 18716 - DNA, 20 bp, Artificial
  CRISPR gRNA sequence
tccaacaagtttttcctgga

SEQ ID NO: 18717 - DNA, 20 bp, Artificial
  CRISPR gRNA sequence
ccaacaagtttttcctggaa

SEQ ID NO: 18718 - DNA, 20 bp, Artificial
  CRISPR gRNA sequence
cctggaagggaacctgaccc

SEQ ID NO: 18719 - DNA, 20 bp, Artificial
  CRISPR gRNA sequence
agggaacctgaccctggtgc

SEQ ID NO: 18720 - DNA, 20 bp, Artificial
  CRISPR gRNA sequence
gggaacctgaccctggtgct

SEQ ID NO: 18721 - DNA, 20 bp, Artificial
  CRISPR gRNA sequence
ggaacctgaccctggtgctg

SEQ ID NO: 18722 - DNA, 20 bp, Artificial
  CRISPR gRNA sequence
acctgaccctggtgctgggg

SEQ ID NO: 18723 - DNA, 20 bp, Artificial
  CRISPR gRNA sequence
cctgaccctggtgctggggt

SEQ ID NO: 18724 - DNA, 20 bp, Artificial
  CRISPR gRNA sequence
ctgaccctggtgctggggta

SEQ ID NO: 18725 - DNA, 20 bp, Artificial
  CRISPR gRNA sequence
tgaccctggtgctggggtag

SEQ ID NO: 18726 - DNA, 20 bp, Artificial
  CRISPR gRNA sequence
gaccctggtgctggggtagg

SEQ ID NO: 18727 - DNA, 20 bp, Artificial
  CRISPR gRNA sequence
cctggtgctggggtaggggg

SEQ ID NO: 18728 - DNA, 20 bp, Artificial
  CRISPR gRNA sequence
tggtgctggggtagggggtg

SEQ ID NO: 18729 - DNA, 20 bp, Artificial
  CRISPR gRNA sequence
ggggtagggggtggagtgat

SEQ ID NO: 18730 - DNA, 20 bp, Artificial
  CRISPR gRNA sequence
gggtagggggtggagtgatg

SEQ ID NO: 18731 - DNA, 20 bp, Artificial
  CRISPR gRNA sequence
tgatgaggatcttgtgactg

SEQ ID NO: 18732 - DNA, 20 bp, Artificial
  CRISPR gRNA sequence
gaggatcttgtgactgcagt

SEQ ID NO: 18733 - DNA, 20 bp, Artificial
  CRISPR gRNA sequence
tcttgtgactgcagttagca

SEQ ID NO: 18734 - DNA, 20 bp, Artificial
  CRISPR gRNA sequence
gtgactgcagttagcaaagc

SEQ ID NO: 18735 - DNA, 20 bp, Artificial
  CRISPR gRNA sequence
tgactgcagttagcaaagcc

SEQ ID NO: 18736 - DNA, 20 bp, Artificial
  CRISPR gRNA sequence
caaagccaggccccacactc

SEQ ID NO: 18737 - DNA, 20 bp, Artificial
  CRISPR gRNA sequence
cactccagtcctgacccatc

SEQ ID NO: 18738 - DNA, 20 bp, Artificial
  CRISPR gRNA sequence
ccatccggctctacttaaca

SEQ ID NO: 18739 - DNA, 20 bp, Artificial
  CRISPR gRNA sequence
acttaacacagtccccccgc

SEQ ID NO: 18740 - DNA, 20 bp, Artificial
  CRISPR gRNA sequence
tccccccgccagcactctgc

SEQ ID NO: 18741 - DNA, 20 bp, Artificial
  CRISPR gRNA sequence
ccccccgccagcactctgct

SEQ ID NO: 18742 - DNA, 20 bp, Artificial
  CRISPR gRNA sequence
gccagcactctgctgggtgc

SEQ ID NO: 18743 - DNA, 20 bp, Artificial
  CRISPR gRNA sequence
cagcactctgctgggtgctg

SEQ ID NO: 18744 - DNA, 20 bp, Artificial
  CRISPR gRNA sequence
tgctgggtgctggagacccc

SEQ ID NO: 18745 - DNA, 20 bp, Artificial
  CRISPR gRNA sequence
gagaccccaagatgaaccac

SEQ ID NO: 18746 - DNA, 20 bp, Artificial
  CRISPR gRNA sequence
ccccaagatgaaccacgagc

SEQ ID NO: 18747 - DNA, 20 bp, Artificial
  CRISPR gRNA sequence
acgagccagtcctgcttgct

SEQ ID NO: 18748 - DNA, 20 bp, Artificial
  CRISPR gRNA sequence
tgcttgctgagatctgacta

SEQ ID NO: 18749 - DNA, 20 bp, Artificial
  CRISPR gRNA sequence
cttgctgagatctgactacg

SEQ ID NO: 18750 - DNA, 20 bp, Artificial
  CRISPR gRNA sequence
tgagatctgactacggagtc

SEQ ID NO: 18751 - DNA, 20 bp, Artificial
  CRISPR gRNA sequence
tgactacggagtccagccat

SEQ ID NO: 18752 - DNA, 20 bp, Artificial
  CRISPR gRNA sequence
ctacggagtccagccatcgg

SEQ ID NO: 18753 - DNA, 20 bp, Artificial
  CRISPR gRNA sequence
tacggagtccagccatcggc

SEQ ID NO: 18754 - DNA, 20 bp, Artificial
  CRISPR gRNA sequence
agtccagccatcggcaggct

SEQ ID NO: 18755 - DNA, 20 bp, Artificial
  CRISPR gRNA sequence
ccatcggcaggcttggctgt

SEQ ID NO: 18756 - DNA, 20 bp, Artificial
  CRISPR gRNA sequence
cggcaggcttggctgtgagt

SEQ ID NO: 18757 - DNA, 20 bp, Artificial
  CRISPR gRNA sequence
ggctgtgagtgagaattacc

SEQ ID NO: 18758 - DNA, 20 bp, Artificial
  CRISPR gRNA sequence
gctgtgagtgagaattacct

SEQ ID NO: 18759 - DNA, 20 bp, Artificial
  CRISPR gRNA sequence
gtgagtgagaattacctggg

SEQ ID NO: 18760 - DNA, 20 bp, Artificial
  CRISPR gRNA sequence
tgagtgagaattacctggga

SEQ ID NO: 18761 - DNA, 20 bp, Artificial
  CRISPR gRNA sequence
gagtgagaattacctgggaa

SEQ ID NO: 18762 - DNA, 20 bp, Artificial
  CRISPR gRNA sequence
tgggaagggtgttaaaaaca

SEQ ID NO: 18763 - DNA, 20 bp, Artificial
  CRISPR gRNA sequence
gtgttaaaaacacagcgtcc

SEQ ID NO: 18764 - DNA, 20 bp, Artificial
  CRISPR gRNA sequence
tgttaaaaacacagcgtcct

SEQ ID NO: 18765 - DNA, 20 bp, Artificial
  CRISPR gRNA sequence
agcgtcctgggcctcacccc

SEQ ID NO: 18766 - DNA, 20 bp, Artificial
  CRISPR gRNA sequence
tcacccccagtgattctatt

SEQ ID NO: 18767 - DNA, 20 bp, Artificial
  CRISPR gRNA sequence
cacccccagtgattctattc

SEQ ID NO: 18768 - DNA, 20 bp, Artificial
  CRISPR gRNA sequence
acccccagtgattctattca

SEQ ID NO: 18769 - DNA, 20 bp, Artificial
  CRISPR gRNA sequence
ccccagtgattctattcagg

SEQ ID NO: 18770 - DNA, 20 bp, Artificial
  CRISPR gRNA sequence
gattctattcagggagtctg

SEQ ID NO: 18771 - DNA, 20 bp, Artificial
  CRISPR gRNA sequence
ctattcagggagtctgcagc

SEQ ID NO: 18772 - DNA, 20 bp, Artificial
  CRISPR gRNA sequence
tattcagggagtctgcagcc

SEQ ID NO: 18773 - DNA, 20 bp, Artificial
  CRISPR gRNA sequence
agggagtctgcagccgggcc

SEQ ID NO: 18774 - DNA, 20 bp, Artificial
  CRISPR gRNA sequence
gggagtctgcagccgggccc

SEQ ID NO: 18775 - DNA, 20 bp, Artificial
  CRISPR gRNA sequence
tattttctttcatttttttt

SEQ ID NO: 18776 - DNA, 20 bp, Artificial
  CRISPR gRNA sequence
ttctttcattttttttgaga

SEQ ID NO: 18777 - DNA, 20 bp, Artificial
  CRISPR gRNA sequence
ctttcattttttttgagacg

SEQ ID NO: 18778 - DNA, 20 bp, Artificial
  CRISPR gRNA sequence
ggagtttcactcttgttgcc

SEQ ID NO: 18779 - DNA, 20 bp, Artificial
  CRISPR gRNA sequence
gagtttcactcttgttgccc

SEQ ID NO: 18780 - DNA, 20 bp, Artificial
  CRISPR gRNA sequence
ttcactcttgttgcccaggc

SEQ ID NO: 18781 - DNA, 20 bp, Artificial
  CRISPR gRNA sequence
cactcttgttgcccaggctg

SEQ ID NO: 18782 - DNA, 20 bp, Artificial
  CRISPR gRNA sequence
ttgcccaggctggagtgcaa

SEQ ID NO: 18783 - DNA, 20 bp, Artificial
  CRISPR gRNA sequence
ggagtgcaatggtgtgatct

SEQ ID NO: 18784 - DNA, 20 bp, Artificial
  CRISPR gRNA sequence
tcaccgcaatctccgcctcc

SEQ ID NO: 18785 - DNA, 20 bp, Artificial
  CRISPR gRNA sequence
caccgcaatctccgcctcct

SEQ ID NO: 18786 - DNA, 20 bp, Artificial
  CRISPR gRNA sequence
caatctccgcctcctgggtt

SEQ ID NO: 18787 - DNA, 20 bp, Artificial
  CRISPR gRNA sequence
aatctccgcctcctgggttc

SEQ ID NO: 18788 - DNA, 20 bp, Artificial
  CRISPR gRNA sequence
ttcaggcgattctcctccac

SEQ ID NO: 18789 - DNA, 20 bp, Artificial
  CRISPR gRNA sequence
ttctcctccaccagcctacc

SEQ ID NO: 18790 - DNA, 20 bp, Artificial
  CRISPR gRNA sequence
tcctccaccagcctaccgag

SEQ ID NO: 18791 - DNA, 20 bp, Artificial
  CRISPR gRNA sequence
ccaccagcctaccgagtagc

SEQ ID NO: 18792 - DNA, 20 bp, Artificial
  CRISPR gRNA sequence
caccagcctaccgagtagct

SEQ ID NO: 18793 - DNA, 20 bp, Artificial
  CRISPR gRNA sequence
ctaccgagtagctgggatta

SEQ ID NO: 18794 - DNA, 20 bp, Artificial
  CRISPR gRNA sequence
taccgagtagctgggattac

SEQ ID NO: 18795 - DNA, 20 bp, Artificial
  CRISPR gRNA sequence
caggcatgcaccactacacc

SEQ ID NO: 18796 - DNA, 20 bp, Artificial
  CRISPR gRNA sequence
cccggctaattttgtatttt

SEQ ID NO: 18797 - DNA, 20 bp, Artificial
  CRISPR gRNA sequence
ccggctaattttgtattttt

SEQ ID NO: 18798 - DNA, 20 bp, Artificial
  CRISPR gRNA sequence
ggctaattttgtatttttag

SEQ ID NO: 18799 - DNA, 20 bp, Artificial
  CRISPR gRNA sequence
ctaattttgtatttttagga

SEQ ID NO: 18800 - DNA, 20 bp, Artificial
  CRISPR gRNA sequence
ttttgtatttttaggagaga

SEQ ID NO: 18801 - DNA, 20 bp, Artificial
  CRISPR gRNA sequence
cggtgtttcaccatgttgcc

SEQ ID NO: 18802 - DNA, 20 bp, Artificial
  CRISPR gRNA sequence
ggtgtttcaccatgttgccc

SEQ ID NO: 18803 - DNA, 20 bp, Artificial
  CRISPR gRNA sequence
tttcaccatgttgcccaggc

SEQ ID NO: 18804 - DNA, 20 bp, Artificial
  CRISPR gRNA sequence
tggtctcgaactcctgatcc

SEQ ID NO: 18805 - DNA, 20 bp, Artificial
  CRISPR gRNA sequence
ggtctcgaactcctgatccc

SEQ ID NO: 18806 - DNA, 20 bp, Artificial
  CRISPR gRNA sequence
cctgatcccaggtgatccac

SEQ ID NO: 18807 - DNA, 20 bp, Artificial
  CRISPR gRNA sequence
cccaggtgatccaccggcct

SEQ ID NO: 18808 - DNA, 20 bp, Artificial
  CRISPR gRNA sequence
ccaccggcctcagcctccca

SEQ ID NO: 18809 - DNA, 20 bp, Artificial
  CRISPR gRNA sequence
gcctcagcctcccaaagtgc

SEQ ID NO: 18810 - DNA, 20 bp, Artificial
  CRISPR gRNA sequence
cctcagcctcccaaagtgct

SEQ ID NO: 18811 - DNA, 20 bp, Artificial
  CRISPR gRNA sequence
ctcagcctcccaaagtgctg

SEQ ID NO: 18812 - DNA, 20 bp, Artificial
  CRISPR gRNA sequence
ctcccaaagtgctggggtta

SEQ ID NO: 18813 - DNA, 20 bp, Artificial
  CRISPR gRNA sequence
tcccaaagtgctggggttac

SEQ ID NO: 18814 - DNA, 20 bp, Artificial
  CRISPR gRNA sequence
agtgctggggttacaggtgt

SEQ ID NO: 18815 - DNA, 20 bp, Artificial
  CRISPR gRNA sequence
caggtgtgagccaccatgcc

SEQ ID NO: 18816 - DNA, 20 bp, Artificial
  CRISPR gRNA sequence
gtgagccaccatgcccggcc

SEQ ID NO: 18817 - DNA, 20 bp, Artificial
  CRISPR gRNA sequence
atatatttttttcctaaaaa

SEQ ID NO: 18818 - DNA, 20 bp, Artificial
  CRISPR gRNA sequence
tatatttttttcctaaaaaa

SEQ ID NO: 18819 - DNA, 20 bp, Artificial
  CRISPR gRNA sequence
aaaggtcttgctctgttgcc

SEQ ID NO: 18820 - DNA, 20 bp, Artificial
  CRISPR gRNA sequence
aaggtcttgctctgttgccc

SEQ ID NO: 18821 - DNA, 20 bp, Artificial
  CRISPR gRNA sequence
tcttgctctgttgcccaggc

SEQ ID NO: 18822 - DNA, 20 bp, Artificial
  CRISPR gRNA sequence
ccaggctggtcttgaactcc

SEQ ID NO: 18823 - DNA, 20 bp, Artificial
  CRISPR gRNA sequence
ggtcttgaactcctggtctc

SEQ ID NO: 18824 - DNA, 20 bp, Artificial
  CRISPR gRNA sequence
tcatcctgccttgacctccc

SEQ ID NO: 18825 - DNA, 20 bp, Artificial
  CRISPR gRNA sequence
catcctgccttgacctccca

SEQ ID NO: 18826 - DNA, 20 bp, Artificial
  CRISPR gRNA sequence
gccttgacctcccaaggtga

SEQ ID NO: 18827 - DNA, 20 bp, Artificial
  CRISPR gRNA sequence
ctcccaaggtgatggaatta

SEQ ID NO: 18828 - DNA, 20 bp, Artificial
  CRISPR gRNA sequence
tcccaaggtgatggaattac

SEQ ID NO: 18829 - DNA, 20 bp, Artificial
  CRISPR gRNA sequence
ggtgatggaattacaggcat

SEQ ID NO: 18830 - DNA, 20 bp, Artificial
  CRISPR gRNA sequence
acaggcatgagccactgcac

SEQ ID NO: 18831 - DNA, 20 bp, Artificial
  CRISPR gRNA sequence
caggcatgagccactgcacc

SEQ ID NO: 18832 - DNA, 20 bp, Artificial
  CRISPR gRNA sequence
tcttatatctttccttcctg

SEQ ID NO: 18833 - DNA, 20 bp, Artificial
  CRISPR gRNA sequence
ctttccttcctgaagtcttt

SEQ ID NO: 18834 - DNA, 20 bp, Artificial
  CRISPR gRNA sequence
gccctctgctgccatgccct

SEQ ID NO: 18835 - DNA, 20 bp, Artificial
  CRISPR gRNA sequence
ctgctgccatgcccttggtc

SEQ ID NO: 18836 - DNA, 20 bp, Artificial
  CRISPR gRNA sequence
ctgccatgcccttggtctag

SEQ ID NO: 18837 - DNA, 20 bp, Artificial
  CRISPR gRNA sequence
gcccttggtctagtagtcac

SEQ ID NO: 18838 - DNA, 20 bp, Artificial
  CRISPR gRNA sequence
tctagtagtcaccagaccct

SEQ ID NO: 18839 - DNA, 20 bp, Artificial
  CRISPR gRNA sequence
tagtcaccagaccctcagca

SEQ ID NO: 18840 - DNA, 20 bp, Artificial
  CRISPR gRNA sequence
cctcagcatagattttacaa

SEQ ID NO: 18841 - DNA, 20 bp, Artificial
  CRISPR gRNA sequence
atagattttacaatagcttc

SEQ ID NO: 18842 - DNA, 20 bp, Artificial
  CRISPR gRNA sequence
tagattttacaatagcttcc

SEQ ID NO: 18843 - DNA, 20 bp, Artificial
  CRISPR gRNA sequence
tccaggtctttcctctcatc

SEQ ID NO: 18844 - DNA, 20 bp, Artificial
  CRISPR gRNA sequence
tcatccggtttcccaaactg

SEQ ID NO: 18845 - DNA, 20 bp, Artificial
  CRISPR gRNA sequence
catccggtttcccaaactgc

SEQ ID NO: 18846 - DNA, 20 bp, Artificial
  CRISPR gRNA sequence
tcttccatctttacaatttt

SEQ ID NO: 18847 - DNA, 20 bp, Artificial
  CRISPR gRNA sequence
cttccatctttacaattttt

SEQ ID NO: 18848 - DNA, 20 bp, Artificial
  CRISPR gRNA sequence
ttccatctttacaatttttg

SEQ ID NO: 18849 - DNA, 20 bp, Artificial
  CRISPR gRNA sequence
acctgttctacaatttacct

SEQ ID NO: 18850 - DNA, 20 bp, Artificial
  CRISPR gRNA sequence
tttcttaaattaacttttta

SEQ ID NO: 18851 - DNA, 20 bp, Artificial
  CRISPR gRNA sequence
actttttaaagaaacttaaa

SEQ ID NO: 18852 - DNA, 20 bp, Artificial
  CRISPR gRNA sequence
cttaaatagaccgattttaa

SEQ ID NO: 18853 - DNA, 20 bp, Artificial
  CRISPR gRNA sequence
aatagaccgattttaaaaga

SEQ ID NO: 18854 - DNA, 20 bp, Artificial
  CRISPR gRNA sequence
gattttaaaagaaagctttc

SEQ ID NO: 18855 - DNA, 20 bp, Artificial
  CRISPR gRNA sequence
ttttaaaagaaagctttcta

SEQ ID NO: 18856 - DNA, 20 bp, Artificial
  CRISPR gRNA sequence
agaaagctttctagagttga

SEQ ID NO: 18857 - DNA, 20 bp, Artificial
  CRISPR gRNA sequence
aagctttctagagttgaaag

SEQ ID NO: 18858 - DNA, 20 bp, Artificial
  CRISPR gRNA sequence
agctttctagagttgaaagc

SEQ ID NO: 18859 - DNA, 20 bp, Artificial
  CRISPR gRNA sequence
gctttctagagttgaaagcg

SEQ ID NO: 18860 - DNA, 20 bp, Artificial
  CRISPR gRNA sequence
tttctagagttgaaagcggg

SEQ ID NO: 18861 - DNA, 20 bp, Artificial
  CRISPR gRNA sequence
tagagttgaaagcggggagt

SEQ ID NO: 18862 - DNA, 20 bp, Artificial
  CRISPR gRNA sequence
gttgaaagcggggagtcaga

SEQ ID NO: 18863 - DNA, 20 bp, Artificial
  CRISPR gRNA sequence
tatttgtccacccatgtacc

SEQ ID NO: 18864 - DNA, 20 bp, Artificial
  CRISPR gRNA sequence
tgtccacccatgtacctagc

SEQ ID NO: 18865 - DNA, 20 bp, Artificial
  CRISPR gRNA sequence
cctagcaagattattcacaa

SEQ ID NO: 18866 - DNA, 20 bp, Artificial
  CRISPR gRNA sequence
caagattattcacaatagtc

SEQ ID NO: 18867 - DNA, 20 bp, Artificial
  CRISPR gRNA sequence
agattattcacaatagtcaa

SEQ ID NO: 18868 - DNA, 20 bp, Artificial
  CRISPR gRNA sequence
gattattcacaatagtcaag

SEQ ID NO: 18869 - DNA, 20 bp, Artificial
  CRISPR gRNA sequence
tattcacaatagtcaagagg

SEQ ID NO: 18870 - DNA, 20 bp, Artificial
  CRISPR gRNA sequence
attcacaatagtcaagaggt

SEQ ID NO: 18871 - DNA, 20 bp, Artificial
  CRISPR gRNA sequence
tcaagaggtaggaacaaccc

SEQ ID NO: 18872 - DNA, 20 bp, Artificial
  CRISPR gRNA sequence
agtgtctatcaacaaatgaa

SEQ ID NO: 18873 - DNA, 20 bp, Artificial
  CRISPR gRNA sequence
atgaatggatgaacaaaata

SEQ ID NO: 18874 - DNA, 20 bp, Artificial
  CRISPR gRNA sequence
tgaatggatgaacaaaatat

SEQ ID NO: 18875 - DNA, 20 bp, Artificial
  CRISPR gRNA sequence
aatatgggatatccacatat

SEQ ID NO: 18876 - DNA, 20 bp, Artificial
  CRISPR gRNA sequence
attagaatactattccgcca

SEQ ID NO: 18877 - DNA, 20 bp, Artificial
  CRISPR gRNA sequence
gaatactattccgccataga

SEQ ID NO: 18878 - DNA, 20 bp, Artificial
  CRISPR gRNA sequence
aatactattccgccatagaa

SEQ ID NO: 18879 - DNA, 20 bp, Artificial
  CRISPR gRNA sequence
ccatagaaaggaattacaca

SEQ ID NO: 18880 - DNA, 20 bp, Artificial
  CRISPR gRNA sequence
gaattacacatggcacgaca

SEQ ID NO: 18881 - DNA, 20 bp, Artificial
  CRISPR gRNA sequence
tggcacgacatggatgaacc

SEQ ID NO: 18882 - DNA, 20 bp, Artificial
  CRISPR gRNA sequence
cacgacatggatgaacctgg

SEQ ID NO: 18883 - DNA, 20 bp, Artificial
  CRISPR gRNA sequence
aacctggaagacattatgct

SEQ ID NO: 18884 - DNA, 20 bp, Artificial
  CRISPR gRNA sequence
gaagacattatgctaagtga

SEQ ID NO: 18885 - DNA, 20 bp, Artificial
  CRISPR gRNA sequence
gacattatgctaagtgaaag

SEQ ID NO: 18886 - DNA, 20 bp, Artificial
  CRISPR gRNA sequence
ttatgctaagtgaaagaagc

SEQ ID NO: 18887 - DNA, 20 bp, Artificial
  CRISPR gRNA sequence
tatgctaagtgaaagaagcc

SEQ ID NO: 18888 - DNA, 20 bp, Artificial
  CRISPR gRNA sequence
tgaaagaagccaggcacaaa

SEQ ID NO: 18889 - DNA, 20 bp, Artificial
  CRISPR gRNA sequence
atatcacgtaattctattta

SEQ ID NO: 18890 - DNA, 20 bp, Artificial
  CRISPR gRNA sequence
tatcacgtaattctatttat

SEQ ID NO: 18891 - DNA, 20 bp, Artificial
  CRISPR gRNA sequence
cacgtaattctatttatagg

SEQ ID NO: 18892 - DNA, 20 bp, Artificial
  CRISPR gRNA sequence
ttctatttataggcggtgtc

SEQ ID NO: 18893 - DNA, 20 bp, Artificial
  CRISPR gRNA sequence
ctatttataggcggtgtcta

SEQ ID NO: 18894 - DNA, 20 bp, Artificial
  CRISPR gRNA sequence
tttataggcggtgtctagag

SEQ ID NO: 18895 - DNA, 20 bp, Artificial
  CRISPR gRNA sequence
gtctagagtagcccaaaaca

SEQ ID NO: 18896 - DNA, 20 bp, Artificial
  CRISPR gRNA sequence
ctagagtagcccaaaacata

SEQ ID NO: 18897 - DNA, 20 bp, Artificial
  CRISPR gRNA sequence
agtagcccaaaacatagaga

SEQ ID NO: 18898 - DNA, 20 bp, Artificial
  CRISPR gRNA sequence
gtagcccaaaacatagagac

SEQ ID NO: 18899 - DNA, 20 bp, Artificial
  CRISPR gRNA sequence
gcccaaaacatagagacagg

SEQ ID NO: 18900 - DNA, 20 bp, Artificial
  CRISPR gRNA sequence
aaaacatagagacaggaagt

SEQ ID NO: 18901 - DNA, 20 bp, Artificial
  CRISPR gRNA sequence
aacatagagacaggaagttg

SEQ ID NO: 18902 - DNA, 20 bp, Artificial
  CRISPR gRNA sequence
caggaagttggagttaccac

SEQ ID NO: 18903 - DNA, 20 bp, Artificial
  CRISPR gRNA sequence
aagttggagttaccacgagc

SEQ ID NO: 18904 - DNA, 20 bp, Artificial
  CRISPR gRNA sequence
agttggagttaccacgagct

SEQ ID NO: 18905 - DNA, 20 bp, Artificial
  CRISPR gRNA sequence
tggagttaccacgagctggg

SEQ ID NO: 18906 - DNA, 20 bp, Artificial
  CRISPR gRNA sequence
agttaccacgagctgggtgg

SEQ ID NO: 18907 - DNA, 20 bp, Artificial
  CRISPR gRNA sequence
gttaccacgagctgggtgga

SEQ ID NO: 18908 - DNA, 20 bp, Artificial
  CRISPR gRNA sequence
ttaccacgagctgggtggaa

SEQ ID NO: 18909 - DNA, 20 bp, Artificial
  CRISPR gRNA sequence
taccacgagctgggtggaag

SEQ ID NO: 18910 - DNA, 20 bp, Artificial
  CRISPR gRNA sequence
cacgagctgggtggaagggg

SEQ ID NO: 18911 - DNA, 20 bp, Artificial
  CRISPR gRNA sequence
gagctgggtggaaggggcag

SEQ ID NO: 18912 - DNA, 20 bp, Artificial
  CRISPR gRNA sequence
agctgggtggaaggggcagt

SEQ ID NO: 18913 - DNA, 20 bp, Artificial
  CRISPR gRNA sequence
gctgggtggaaggggcagtg

SEQ ID NO: 18914 - DNA, 20 bp, Artificial
  CRISPR gRNA sequence
tgggtggaaggggcagtggg

SEQ ID NO: 18915 - DNA, 20 bp, Artificial
  CRISPR gRNA sequence
agtggggagttattgcttat

SEQ ID NO: 18916 - DNA, 20 bp, Artificial
  CRISPR gRNA sequence
gtggggagttattgcttatt

SEQ ID NO: 18917 - DNA, 20 bp, Artificial
  CRISPR gRNA sequence
gggagttattgcttattggg

SEQ ID NO: 18918 - DNA, 20 bp, Artificial
  CRISPR gRNA sequence
gagttattgcttattgggta

SEQ ID NO: 18919 - DNA, 20 bp, Artificial
  CRISPR gRNA sequence
ttgcttattgggtagagttt

SEQ ID NO: 18920 - DNA, 20 bp, Artificial
  CRISPR gRNA sequence
tattgggtagagtttcagtt

SEQ ID NO: 18921 - DNA, 20 bp, Artificial
  CRISPR gRNA sequence
attgggtagagtttcagttt

SEQ ID NO: 18922 - DNA, 20 bp, Artificial
  CRISPR gRNA sequence
tgggtagagtttcagtttgg

SEQ ID NO: 18923 - DNA, 20 bp, Artificial
  CRISPR gRNA sequence
gggtagagtttcagtttggg

SEQ ID NO: 18924 - DNA, 20 bp, Artificial
  CRISPR gRNA sequence
ttcagtttgggaggatgaaa

SEQ ID NO: 18925 - DNA, 20 bp, Artificial
  CRISPR gRNA sequence
ttgggaggatgaaaaagttc

SEQ ID NO: 18926 - DNA, 20 bp, Artificial
  CRISPR gRNA sequence
gggaggatgaaaaagttctg

SEQ ID NO: 18927 - DNA, 20 bp, Artificial
  CRISPR gRNA sequence
ggatgaaaaagttctggaga

SEQ ID NO: 18928 - DNA, 20 bp, Artificial
  CRISPR gRNA sequence
gaaaaagttctggagatgga

SEQ ID NO: 18929 - DNA, 20 bp, Artificial
  CRISPR gRNA sequence
aaagttctggagatggatgg

SEQ ID NO: 18930 - DNA, 20 bp, Artificial
  CRISPR gRNA sequence
gttctggagatggatggtag

SEQ ID NO: 18931 - DNA, 20 bp, Artificial
  CRISPR gRNA sequence
tctggagatggatggtagcg

SEQ ID NO: 18932 - DNA, 20 bp, Artificial
  CRISPR gRNA sequence
ctggagatggatggtagcgg

SEQ ID NO: 18933 - DNA, 20 bp, Artificial
  CRISPR gRNA sequence
tggtagcggaggttgcacaa

SEQ ID NO: 18934 - DNA, 20 bp, Artificial
  CRISPR gRNA sequence
ccactgaaatgtacatttga

SEQ ID NO: 18935 - DNA, 20 bp, Artificial
  CRISPR gRNA sequence
ctgaaatgtacatttgaaag

SEQ ID NO: 18936 - DNA, 20 bp, Artificial
  CRISPR gRNA sequence
acatttgaaagtggttaaaa

SEQ ID NO: 18937 - DNA, 20 bp, Artificial
  CRISPR gRNA sequence
ttttaccatgattttacaaa

SEQ ID NO: 18938 - DNA, 20 bp, Artificial
  CRISPR gRNA sequence
cttttttttccatgtataaa

SEQ ID NO: 18939 - DNA, 20 bp, Artificial
  CRISPR gRNA sequence
ttttccatgtataaacggaa

SEQ ID NO: 18940 - DNA, 20 bp, Artificial
  CRISPR gRNA sequence
gaaaagcaaaaccaaaccaa

SEQ ID NO: 18941 - DNA, 20 bp, Artificial
  CRISPR gRNA sequence
caaaccaacagtatcacttg

SEQ ID NO: 18942 - DNA, 20 bp, Artificial
  CRISPR gRNA sequence
agtatcacttgtggttgaaa

SEQ ID NO: 18943 - DNA, 20 bp, Artificial
  CRISPR gRNA sequence
caatgttactaaaataatct

SEQ ID NO: 18944 - DNA, 20 bp, Artificial
  CRISPR gRNA sequence
ttctttaccactttgttaaa

SEQ ID NO: 18945 - DNA, 20 bp, Artificial
  CRISPR gRNA sequence
actttgttaaaaagaaatct

SEQ ID NO: 18946 - DNA, 20 bp, Artificial
  CRISPR gRNA sequence
tgttaaaaagaaatcttagc

SEQ ID NO: 18947 - DNA, 20 bp, Artificial
  CRISPR gRNA sequence
aaagaaatcttagcaagcat

SEQ ID NO: 18948 - DNA, 20 bp, Artificial
  CRISPR gRNA sequence
aagaaatcttagcaagcatt

SEQ ID NO: 18949 - DNA, 20 bp, Artificial
  CRISPR gRNA sequence
agaaatcttagcaagcatta

SEQ ID NO: 18950 - DNA, 20 bp, Artificial
  CRISPR gRNA sequence
attagggcactgtcaaacat

SEQ ID NO: 18951 - DNA, 20 bp, Artificial
  CRISPR gRNA sequence
ttagggcactgtcaaacatc

SEQ ID NO: 18952 - DNA, 20 bp, Artificial
  CRISPR gRNA sequence
tagggcactgtcaaacatca

SEQ ID NO: 18953 - DNA, 20 bp, Artificial
  CRISPR gRNA sequence
tgtcaaacatcagggaaaat

SEQ ID NO: 18954 - DNA, 20 bp, Artificial
  CRISPR gRNA sequence
tcaaacatcagggaaaatca

SEQ ID NO: 18955 - DNA, 20 bp, Artificial
  CRISPR gRNA sequence
agagactttgtccttgatgt

SEQ ID NO: 18956 - DNA, 20 bp, Artificial
  CRISPR gRNA sequence
gactttgtccttgatgtcag

SEQ ID NO: 18957 - DNA, 20 bp, Artificial
  CRISPR gRNA sequence
actttgtccttgatgtcaga

SEQ ID NO: 18958 - DNA, 20 bp, Artificial
  CRISPR gRNA sequence
ccttgatgtcagaaggattg

SEQ ID NO: 18959 - DNA, 20 bp, Artificial
  CRISPR gRNA sequence
cttgatgtcagaaggattga

SEQ ID NO: 18960 - DNA, 20 bp, Artificial
  CRISPR gRNA sequence
actatctatgtccttcctat

SEQ ID NO: 18961 - DNA, 20 bp, Artificial
  CRISPR gRNA sequence
tatgtccttcctatgagaat

SEQ ID NO: 18962 - DNA, 20 bp, Artificial
  CRISPR gRNA sequence
gtccttcctatgagaatcgg

SEQ ID NO: 18963 - DNA, 20 bp, Artificial
  CRISPR gRNA sequence
tcttttgactgtgtgtgtct

SEQ ID NO: 18964 - DNA, 20 bp, Artificial
  CRISPR gRNA sequence
actgtgtgtgtcttggtctt

SEQ ID NO: 18965 - DNA, 20 bp, Artificial
  CRISPR gRNA sequence
ctctctcttttttttttcct

SEQ ID NO: 18966 - DNA, 20 bp, Artificial
  CRISPR gRNA sequence
ctcttttttttttcctgaga

SEQ ID NO: 18967 - DNA, 20 bp, Artificial
  CRISPR gRNA sequence
gacagtcttgctctgttgcc

SEQ ID NO: 18968 - DNA, 20 bp, Artificial
  CRISPR gRNA sequence
acagtcttgctctgttgccc

SEQ ID NO: 18969 - DNA, 20 bp, Artificial
  CRISPR gRNA sequence
tcttgctctgttgcccaggc

SEQ ID NO: 18970 - DNA, 20 bp, Artificial
  CRISPR gRNA sequence
ctgttgcccaggctggcgtg

SEQ ID NO: 18971 - DNA, 20 bp, Artificial
  CRISPR gRNA sequence
ttgcccaggctggcgtgcag

SEQ ID NO: 18972 - DNA, 20 bp, Artificial
  CRISPR gRNA sequence
ggcgtgcagtggtgcaatct

SEQ ID NO: 18973 - DNA, 20 bp, Artificial
  CRISPR gRNA sequence
agtggtgcaatctcagctct

SEQ ID NO: 18974 - DNA, 20 bp, Artificial
  CRISPR gRNA sequence
gtggtgcaatctcagctctc

SEQ ID NO: 18975 - DNA, 20 bp, Artificial
  CRISPR gRNA sequence
ctcgggtaacctccacctct

SEQ ID NO: 18976 - DNA, 20 bp, Artificial
  CRISPR gRNA sequence
tcgggtaacctccacctctc

SEQ ID NO: 18977 - DNA, 20 bp, Artificial
  CRISPR gRNA sequence
ctcgggtaaactccgcctct

SEQ ID NO: 18978 - DNA, 20 bp, Artificial
  CRISPR gRNA sequence
tcgggtaaactccgcctctt

SEQ ID NO: 18979 - DNA, 20 bp, Artificial
  CRISPR gRNA sequence
aaactccgcctcttgggttc

SEQ ID NO: 18980 - DNA, 20 bp, Artificial
  CRISPR gRNA sequence
ttcaagtgattctcgtgcct

SEQ ID NO: 18981 - DNA, 20 bp, Artificial
  CRISPR gRNA sequence
ttctcgtgcctcagcctccc

SEQ ID NO: 18982 - DNA, 20 bp, Artificial
  CRISPR gRNA sequence
tcgtgcctcagcctcccaag

SEQ ID NO: 18983 - DNA, 20 bp, Artificial
  CRISPR gRNA sequence
cctcagcctcccaagtagtt

SEQ ID NO: 18984 - DNA, 20 bp, Artificial
  CRISPR gRNA sequence
ctcccaagtagttgagatta

SEQ ID NO: 18985 - DNA, 20 bp, Artificial
  CRISPR gRNA sequence
tcccaagtagttgagattac

SEQ ID NO: 18986 - DNA, 20 bp, Artificial
  CRISPR gRNA sequence
caggtgtgcaccaccatgcc

SEQ ID NO: 18987 - DNA, 20 bp, Artificial
  CRISPR gRNA sequence
tgcccggctaaaacacaaaa

SEQ ID NO: 18988 - DNA, 20 bp, Artificial
  CRISPR gRNA sequence
taaaacacaaaaaagtgttt

SEQ ID NO: 18989 - DNA, 20 bp, Artificial
  CRISPR gRNA sequence
aacacaaaaaagtgttttag

SEQ ID NO: 18990 - DNA, 20 bp, Artificial
  CRISPR gRNA sequence
cacaaaaaagtgttttagta

SEQ ID NO: 18991 - DNA, 20 bp, Artificial
  CRISPR gRNA sequence
aaaaagtgttttagtagagt

SEQ ID NO: 18992 - DNA, 20 bp, Artificial
  CRISPR gRNA sequence
aaaagtgttttagtagagtt

SEQ ID NO: 18993 - DNA, 20 bp, Artificial
  CRISPR gRNA sequence
aaagtgttttagtagagttg

SEQ ID NO: 18994 - DNA, 20 bp, Artificial
  CRISPR gRNA sequence
tagtagagttggggtttctc

SEQ ID NO: 18995 - DNA, 20 bp, Artificial
  CRISPR gRNA sequence
agtagagttggggtttctcc

SEQ ID NO: 18996 - DNA, 20 bp, Artificial
  CRISPR gRNA sequence
tggggtttctccaggttgcc

SEQ ID NO: 18997 - DNA, 20 bp, Artificial
  CRISPR gRNA sequence
ggggtttctccaggttgccc

SEQ ID NO: 18998 - DNA, 20 bp, Artificial
  CRISPR gRNA sequence
tttctccaggttgcccaggc

SEQ ID NO: 18999 - DNA, 20 bp, Artificial
  CRISPR gRNA sequence
ccaggctggtcttgaactcc

SEQ ID NO: 19000 - DNA, 20 bp, Artificial
  CRISPR gRNA sequence
ggtcttgaactcctggcctc

SEQ ID NO: 19001 - DNA, 20 bp, Artificial
  CRISPR gRNA sequence
ctcaagcaatccacccgcct

SEQ ID NO: 19002 - DNA, 20 bp, Artificial
  CRISPR gRNA sequence
ccacccgcctcggcctccca

SEQ ID NO: 19003 - DNA, 20 bp, Artificial
  CRISPR gRNA sequence
gcctcggcctcccaaagtgc

SEQ ID NO: 19004 - DNA, 20 bp, Artificial
  CRISPR gRNA sequence
cctcggcctcccaaagtgct

SEQ ID NO: 19005 - DNA, 20 bp, Artificial
  CRISPR gRNA sequence
ctcccaaagtgctaggatta

SEQ ID NO: 19006 - DNA, 20 bp, Artificial
  CRISPR gRNA sequence
tcccaaagtgctaggattac

SEQ ID NO: 19007 - DNA, 20 bp, Artificial
  CRISPR gRNA sequence
caggtgtgaaccactgctcc

SEQ ID NO: 19008 - DNA, 20 bp, Artificial
  CRISPR gRNA sequence
atctttctaaacaatccctt

SEQ ID NO: 19009 - DNA, 20 bp, Artificial
  CRISPR gRNA sequence
tctttctaaacaatcccttt

SEQ ID NO: 19010 - DNA, 20 bp, Artificial
  CRISPR gRNA sequence
cccaatgcatgaatattctt

SEQ ID NO: 19011 - DNA, 20 bp, Artificial
  CRISPR gRNA sequence
aatgcatgaatattctttgg

SEQ ID NO: 19012 - DNA, 20 bp, Artificial
  CRISPR gRNA sequence
tattctttggtggttttcta

SEQ ID NO: 19013 - DNA, 20 bp, Artificial
  CRISPR gRNA sequence
agtgctttttctgtacacat

SEQ ID NO: 19014 - DNA, 20 bp, Artificial
  CRISPR gRNA sequence
tgtacacatcagacatcatc

SEQ ID NO: 19015 - DNA, 20 bp, Artificial
  CRISPR gRNA sequence
cacatcagacatcatcaagc

SEQ ID NO: 19016 - DNA, 20 bp, Artificial
  CRISPR gRNA sequence
ctcatgttttatccatttta

SEQ ID NO: 19017 - DNA, 20 bp, Artificial
  CRISPR gRNA sequence
tccattttacagatgaacct

SEQ ID NO: 19018 - DNA, 20 bp, Artificial
  CRISPR gRNA sequence
cattttacagatgaacctca

SEQ ID NO: 19019 - DNA, 20 bp, Artificial
  CRISPR gRNA sequence
ttttacagatgaacctcaga

SEQ ID NO: 19020 - DNA, 20 bp, Artificial
  CRISPR gRNA sequence
tttacagatgaacctcagag

SEQ ID NO: 19021 - DNA, 20 bp, Artificial
  CRISPR gRNA sequence
ttacagatgaacctcagaga

SEQ ID NO: 19022 - DNA, 20 bp, Artificial
  CRISPR gRNA sequence
tacagatgaacctcagagag

SEQ ID NO: 19023 - DNA, 20 bp, Artificial
  CRISPR gRNA sequence
agatgaacctcagagagggg

SEQ ID NO: 19024 - DNA, 20 bp, Artificial
  CRISPR gRNA sequence
agagaggggaagtcacttgt

SEQ ID NO: 19025 - DNA, 20 bp, Artificial
  CRISPR gRNA sequence
gtcacttgtcagtgtgactc

SEQ ID NO: 19026 - DNA, 20 bp, Artificial
  CRISPR gRNA sequence
tcacttgtcagtgtgactca

SEQ ID NO: 19027 - DNA, 20 bp, Artificial
  CRISPR gRNA sequence
gtgtgactcaaggcaaatct

SEQ ID NO: 19028 - DNA, 20 bp, Artificial
  CRISPR gRNA sequence
tgtgactcaaggcaaatctg

SEQ ID NO: 19029 - DNA, 20 bp, Artificial
  CRISPR gRNA sequence
ctcaaggcaaatctgaggct

SEQ ID NO: 19030 - DNA, 20 bp, Artificial
  CRISPR gRNA sequence
ggcaaatctgaggctaagtc

SEQ ID NO: 19031 - DNA, 20 bp, Artificial
  CRISPR gRNA sequence
aaatctgaggctaagtccag

SEQ ID NO: 19032 - DNA, 20 bp, Artificial
  CRISPR gRNA sequence
agaagtttcctacctccctc

SEQ ID NO: 19033 - DNA, 20 bp, Artificial
  CRISPR gRNA sequence
cagccacttccctgattgcc

SEQ ID NO: 19034 - DNA, 20 bp, Artificial
  CRISPR gRNA sequence
ctgattgcctggaactaatc

SEQ ID NO: 19035 - DNA, 20 bp, Artificial
  CRISPR gRNA sequence
gattgcctggaactaatcca

SEQ ID NO: 19036 - DNA, 20 bp, Artificial
  CRISPR gRNA sequence
gaactaatccagagtttcct

SEQ ID NO: 19037 - DNA, 20 bp, Artificial
  CRISPR gRNA sequence
aactaatccagagtttcctt

SEQ ID NO: 19038 - DNA, 20 bp, Artificial
  CRISPR gRNA sequence
tttctgattctgctcttctc

SEQ ID NO: 19039 - DNA, 20 bp, Artificial
  CRISPR gRNA sequence
ttctgattctgctcttctca

SEQ ID NO: 19040 - DNA, 20 bp, Artificial
  CRISPR gRNA sequence
ctgctcttctcaaggtatct

SEQ ID NO: 19041 - DNA, 20 bp, Artificial
  CRISPR gRNA sequence
tgctcttctcaaggtatctg

SEQ ID NO: 19042 - DNA, 20 bp, Artificial
  CRISPR gRNA sequence
cttctcaaggtatctgaggc

SEQ ID NO: 19043 - DNA, 20 bp, Artificial
  CRISPR gRNA sequence
ttctcaaggtatctgaggct

SEQ ID NO: 19044 - DNA, 20 bp, Artificial
  CRISPR gRNA sequence
aggtatctgaggctgggtct

SEQ ID NO: 19045 - DNA, 20 bp, Artificial
  CRISPR gRNA sequence
ggtatctgaggctgggtctt

SEQ ID NO: 19046 - DNA, 20 bp, Artificial
  CRISPR gRNA sequence
gggtcttaggacatgaaacc

SEQ ID NO: 19047 - DNA, 20 bp, Artificial
  CRISPR gRNA sequence
taggacatgaaaccaagccc

SEQ ID NO: 19048 - DNA, 20 bp, Artificial
  CRISPR gRNA sequence
tgaaaccaagccccagccat

SEQ ID NO: 19049 - DNA, 20 bp, Artificial
  CRISPR gRNA sequence
accaagccccagccatcaga

SEQ ID NO: 19050 - DNA, 20 bp, Artificial
  CRISPR gRNA sequence
gccccagccatcagacagac

SEQ ID NO: 19051 - DNA, 20 bp, Artificial
  CRISPR gRNA sequence
ccccagccatcagacagact

SEQ ID NO: 19052 - DNA, 20 bp, Artificial
  CRISPR gRNA sequence
tcagacagactgggtatcaa

SEQ ID NO: 19053 - DNA, 20 bp, Artificial
  CRISPR gRNA sequence
cagacagactgggtatcaac

SEQ ID NO: 19054 - DNA, 20 bp, Artificial
  CRISPR gRNA sequence
caggtttctctctgactgcc

SEQ ID NO: 19055 - DNA, 20 bp, Artificial
  CRISPR gRNA sequence
aggtttctctctgactgcct

SEQ ID NO: 19056 - DNA, 20 bp, Artificial
  CRISPR gRNA sequence
tgggacctgccctgcatttg

SEQ ID NO: 19057 - DNA, 20 bp, Artificial
  CRISPR gRNA sequence
ggacctgccctgcatttgtg

SEQ ID NO: 19058 - DNA, 20 bp, Artificial
  CRISPR gRNA sequence
gacctgccctgcatttgtgg

SEQ ID NO: 19059 - DNA, 20 bp, Artificial
  CRISPR gRNA sequence
ttcacatctgcttgctgcac

SEQ ID NO: 19060 - DNA, 20 bp, Artificial
  CRISPR gRNA sequence
tcacatctgcttgctgcact

SEQ ID NO: 19061 - DNA, 20 bp, Artificial
  CRISPR gRNA sequence
atctgcttgctgcactgggc

SEQ ID NO: 19062 - DNA, 20 bp, Artificial
  CRISPR gRNA sequence
tctgcttgctgcactgggct

SEQ ID NO: 19063 - DNA, 20 bp, Artificial
  CRISPR gRNA sequence
gctgcactgggctgggctct

SEQ ID NO: 19064 - DNA, 20 bp, Artificial
  CRISPR gRNA sequence
gcactgggctgggctctcag

SEQ ID NO: 19065 - DNA, 20 bp, Artificial
  CRISPR gRNA sequence
gggctgggctctcagtagac

SEQ ID NO: 19066 - DNA, 20 bp, Artificial
  CRISPR gRNA sequence
ggctgggctctcagtagacc

SEQ ID NO: 19067 - DNA, 20 bp, Artificial
  CRISPR gRNA sequence
gctgggctctcagtagacca

SEQ ID NO: 19068 - DNA, 20 bp, Artificial
  CRISPR gRNA sequence
tctgcaaactgcttgctatg

SEQ ID NO: 19069 - DNA, 20 bp, Artificial
  CRISPR gRNA sequence
actgcttgctatgtggcgtt

SEQ ID NO: 19070 - DNA, 20 bp, Artificial
  CRISPR gRNA sequence
aaacaaaacaaaacacctcc

SEQ ID NO: 19071 - DNA, 20 bp, Artificial
  CRISPR gRNA sequence
tcctggtactccttttctga

SEQ ID NO: 19072 - DNA, 20 bp, Artificial
  CRISPR gRNA sequence
ctggtactccttttctgata

SEQ ID NO: 19073 - DNA, 20 bp, Artificial
  CRISPR gRNA sequence
tggtactccttttctgatag

SEQ ID NO: 19074 - DNA, 20 bp, Artificial
  CRISPR gRNA sequence
ttctgatagaggttttgtaa

SEQ ID NO: 19075 - DNA, 20 bp, Artificial
  CRISPR gRNA sequence
tctgatagaggttttgtaac

SEQ ID NO: 19076 - DNA, 20 bp, Artificial
  CRISPR gRNA sequence
ctgatagaggttttgtaaca

SEQ ID NO: 19077 - DNA, 20 bp, Artificial
  CRISPR gRNA sequence
gatagaggttttgtaacagg

SEQ ID NO: 19078 - DNA, 20 bp, Artificial
  CRISPR gRNA sequence
tagaggttttgtaacaggga

SEQ ID NO: 19079 - DNA, 20 bp, Artificial
  CRISPR gRNA sequence
gaggttttgtaacagggaga

SEQ ID NO: 19080 - DNA, 20 bp, Artificial
  CRISPR gRNA sequence
tttgtaacagggagagagta

SEQ ID NO: 19081 - DNA, 20 bp, Artificial
  CRISPR gRNA sequence
tgtaacagggagagagtaaa

SEQ ID NO: 19082 - DNA, 20 bp, Artificial
  CRISPR gRNA sequence
cagggagagagtaaagagat

SEQ ID NO: 19083 - DNA, 20 bp, Artificial
  CRISPR gRNA sequence
gtaaagagatgagaccacat

SEQ ID NO: 19084 - DNA, 20 bp, Artificial
  CRISPR gRNA sequence
gagaccacatcagcgcctcc

SEQ ID NO: 19085 - DNA, 20 bp, Artificial
  CRISPR gRNA sequence
cctcccagtgtctctgactt

SEQ ID NO: 19086 - DNA, 20 bp, Artificial
  CRISPR gRNA sequence
ctcccagtgtctctgacttg

SEQ ID NO: 19087 - DNA, 20 bp, Artificial
  CRISPR gRNA sequence
tcccagtgtctctgacttga

SEQ ID NO: 19088 - DNA, 20 bp, Artificial
  CRISPR gRNA sequence
tttgccccacaaacgaacat

SEQ ID NO: 19089 - DNA, 20 bp, Artificial
  CRISPR gRNA sequence
tgccccacaaacgaacattg

SEQ ID NO: 19090 - DNA, 20 bp, Artificial
  CRISPR gRNA sequence
aaacgaacattggagtcacc

SEQ ID NO: 19091 - DNA, 20 bp, Artificial
  CRISPR gRNA sequence
aacgaacattggagtcacct

SEQ ID NO: 19092 - DNA, 20 bp, Artificial
  CRISPR gRNA sequence
aacattggagtcacctggga

SEQ ID NO: 19093 - DNA, 20 bp, Artificial
  CRISPR gRNA sequence
ttggagtcacctgggataga

SEQ ID NO: 19094 - DNA, 20 bp, Artificial
  CRISPR gRNA sequence
gggatagatggtttaacctg

SEQ ID NO: 19095 - DNA, 20 bp, Artificial
  CRISPR gRNA sequence
ggatagatggtttaacctgc

SEQ ID NO: 19096 - DNA, 20 bp, Artificial
  CRISPR gRNA sequence
tggtttaacctgcaggatct

SEQ ID NO: 19097 - DNA, 20 bp, Artificial
  CRISPR gRNA sequence
gcaggatctcagcctcaccc

SEQ ID NO: 19098 - DNA, 20 bp, Artificial
  CRISPR gRNA sequence
caggatctcagcctcacccc

SEQ ID NO: 19099 - DNA, 20 bp, Artificial
  CRISPR gRNA sequence
tctcagcctcaccccaggcc

SEQ ID NO: 19100 - DNA, 20 bp, Artificial
  CRISPR gRNA sequence
tcaccccaggcctagccaac

SEQ ID NO: 19101 - DNA, 20 bp, Artificial
  CRISPR gRNA sequence
caccccaggcctagccaacc

SEQ ID NO: 19102 - DNA, 20 bp, Artificial
  CRISPR gRNA sequence
caggcctagccaaccgggcc

SEQ ID NO: 19103 - DNA, 20 bp, Artificial
  CRISPR gRNA sequence
aggcctagccaaccgggcct

SEQ ID NO: 19104 - DNA, 20 bp, Artificial
  CRISPR gRNA sequence
ggcctagccaaccgggcctg

SEQ ID NO: 19105 - DNA, 20 bp, Artificial
  CRISPR gRNA sequence
gcctagccaaccgggcctgg

SEQ ID NO: 19106 - DNA, 20 bp, Artificial
  CRISPR gRNA sequence
agccaaccgggcctgggggt

SEQ ID NO: 19107 - DNA, 20 bp, Artificial
  CRISPR gRNA sequence
accgggcctgggggtgagcc

SEQ ID NO: 19108 - DNA, 20 bp, Artificial
  CRISPR gRNA sequence
ccgggcctgggggtgagccc

SEQ ID NO: 19109 - DNA, 20 bp, Artificial
  CRISPR gRNA sequence
ccgggaacctacatcctgaa

SEQ ID NO: 19110 - DNA, 20 bp, Artificial
  CRISPR gRNA sequence
cgggaacctacatcctgaac

SEQ ID NO: 19111 - DNA, 20 bp, Artificial
  CRISPR gRNA sequence
cctgaacaggttgatcatcc

SEQ ID NO: 19112 - DNA, 20 bp, Artificial
  CRISPR gRNA sequence
ctgaacaggttgatcatccc

SEQ ID NO: 19113 - DNA, 20 bp, Artificial
  CRISPR gRNA sequence
tcccaggtgatgttcatgtg

SEQ ID NO: 19114 - DNA, 20 bp, Artificial
  CRISPR gRNA sequence
cccaggtgatgttcatgtgt

SEQ ID NO: 19115 - DNA, 20 bp, Artificial
  CRISPR gRNA sequence
ccaggtgatgttcatgtgtg

SEQ ID NO: 19116 - DNA, 20 bp, Artificial
  CRISPR gRNA sequence
aggtgatgttcatgtgtggg

SEQ ID NO: 19117 - DNA, 20 bp, Artificial
  CRISPR gRNA sequence
atgttcatgtgtggggagcc

SEQ ID NO: 19118 - DNA, 20 bp, Artificial
  CRISPR gRNA sequence
tgttcatgtgtggggagcct

SEQ ID NO: 19119 - DNA, 20 bp, Artificial
  CRISPR gRNA sequence
ggagcctgggattccccact

SEQ ID NO: 19120 - DNA, 20 bp, Artificial
  CRISPR gRNA sequence
tccccactcagtcatctcca

SEQ ID NO: 19121 - DNA, 20 bp, Artificial
  CRISPR gRNA sequence
accctgcctccaaacgctct

SEQ ID NO: 19122 - DNA, 20 bp, Artificial
  CRISPR gRNA sequence
tccaaacgctctgagattgt

SEQ ID NO: 19123 - DNA, 20 bp, Artificial
  CRISPR gRNA sequence
caaacgctctgagattgttg

SEQ ID NO: 19124 - DNA, 20 bp, Artificial
  CRISPR gRNA sequence
gctctgagattgttggagac

SEQ ID NO: 19125 - DNA, 20 bp, Artificial
  CRISPR gRNA sequence
ctctgagattgttggagacc

SEQ ID NO: 19126 - DNA, 20 bp, Artificial
  CRISPR gRNA sequence
tggagaccaggtcatcccct

SEQ ID NO: 19127 - DNA, 20 bp, Artificial
  CRISPR gRNA sequence
ggagaccaggtcatccccta

SEQ ID NO: 19128 - DNA, 20 bp, Artificial
  CRISPR gRNA sequence
gagaccaggtcatcccctaa

SEQ ID NO: 19129 - DNA, 20 bp, Artificial
  CRISPR gRNA sequence
gaccaggtcatcccctaagg

SEQ ID NO: 19130 - DNA, 20 bp, Artificial
  CRISPR gRNA sequence
aggtcatcccctaagggagc

SEQ ID NO: 19131 - DNA, 20 bp, Artificial
  CRISPR gRNA sequence
ggtcatcccctaagggagcc

SEQ ID NO: 19132 - DNA, 20 bp, Artificial
  CRISPR gRNA sequence
gtcatcccctaagggagccg

SEQ ID NO: 19133 - DNA, 20 bp, Artificial
  CRISPR gRNA sequence
tcatcccctaagggagccgg

SEQ ID NO: 19134 - DNA, 20 bp, Artificial
  CRISPR gRNA sequence
taagggagccgggggtttgc

SEQ ID NO: 19135 - DNA, 20 bp, Artificial
  CRISPR gRNA sequence
aagggagccgggggtttgca

SEQ ID NO: 19136 - DNA, 20 bp, Artificial
  CRISPR gRNA sequence
tttgcaaggtgatcatttgt

SEQ ID NO: 19137 - DNA, 20 bp, Artificial
  CRISPR gRNA sequence
tgcaaggtgatcatttgttg

SEQ ID NO: 19138 - DNA, 20 bp, Artificial
  CRISPR gRNA sequence
ggtgatcatttgttggagtc

SEQ ID NO: 19139 - DNA, 20 bp, Artificial
  CRISPR gRNA sequence
ttgttggagtcaagttcctt

SEQ ID NO: 19140 - DNA, 20 bp, Artificial
  CRISPR gRNA sequence
cctttggctcctctttctcc

SEQ ID NO: 19141 - DNA, 20 bp, Artificial
  CRISPR gRNA sequence
tttggctcctctttctccaa

SEQ ID NO: 19142 - DNA, 20 bp, Artificial
  CRISPR gRNA sequence
ttggctcctctttctccaag

SEQ ID NO: 19143 - DNA, 20 bp, Artificial
  CRISPR gRNA sequence
gctcctctttctccaagagg

SEQ ID NO: 19144 - DNA, 20 bp, Artificial
  CRISPR gRNA sequence
cctctttctccaagaggaag

SEQ ID NO: 19145 - DNA, 20 bp, Artificial
  CRISPR gRNA sequence
ctgtttccttaatctcactc

SEQ ID NO: 19146 - DNA, 20 bp, Artificial
  CRISPR gRNA sequence
gtttccttaatctcactccg

SEQ ID NO: 19147 - DNA, 20 bp, Artificial
  CRISPR gRNA sequence
tccttaatctcactccggag

SEQ ID NO: 19148 - DNA, 20 bp, Artificial
  CRISPR gRNA sequence
gtatttatttattttttctc

SEQ ID NO: 19149 - DNA, 20 bp, Artificial
  CRISPR gRNA sequence
atttatttattttttctctg

SEQ ID NO: 19150 - DNA, 20 bp, Artificial
  CRISPR gRNA sequence
tatttattttttctctggag

SEQ ID NO: 19151 - DNA, 20 bp, Artificial
  CRISPR gRNA sequence
atttattttttctctggagt

SEQ ID NO: 19152 - DNA, 20 bp, Artificial
  CRISPR gRNA sequence
tttattttttctctggagtg

SEQ ID NO: 19153 - DNA, 20 bp, Artificial
  CRISPR gRNA sequence
tattttttctctggagtggg

SEQ ID NO: 19154 - DNA, 20 bp, Artificial
  CRISPR gRNA sequence
tttttctctggagtggggag

SEQ ID NO: 19155 - DNA, 20 bp, Artificial
  CRISPR gRNA sequence
tctggagtggggagcagaaa

SEQ ID NO: 19156 - DNA, 20 bp, Artificial
  CRISPR gRNA sequence
ggagtggggagcagaaacgg

SEQ ID NO: 19157 - DNA, 20 bp, Artificial
  CRISPR gRNA sequence
aaacggaagacttcctgcca

SEQ ID NO: 19158 - DNA, 20 bp, Artificial
  CRISPR gRNA sequence
ggaagacttcctgccaaagt

SEQ ID NO: 19159 - DNA, 20 bp, Artificial
  CRISPR gRNA sequence
cctgccaaagttagacactc

SEQ ID NO: 19160 - DNA, 20 bp, Artificial
  CRISPR gRNA sequence
ctgccaaagttagacactcc

SEQ ID NO: 19161 - DNA, 20 bp, Artificial
  CRISPR gRNA sequence
aagttagacactccaggctg

SEQ ID NO: 19162 - DNA, 20 bp, Artificial
  CRISPR gRNA sequence
tagacactccaggctgcggc

SEQ ID NO: 19163 - DNA, 20 bp, Artificial
  CRISPR gRNA sequence
agacactccaggctgcggct

SEQ ID NO: 19164 - DNA, 20 bp, Artificial
  CRISPR gRNA sequence
gacactccaggctgcggctg

SEQ ID NO: 19165 - DNA, 20 bp, Artificial
  CRISPR gRNA sequence
cactccaggctgcggctggg

SEQ ID NO: 19166 - DNA, 20 bp, Artificial
  CRISPR gRNA sequence
actccaggctgcggctgggg

SEQ ID NO: 19167 - DNA, 20 bp, Artificial
  CRISPR gRNA sequence
ctccaggctgcggctgggga

SEQ ID NO: 19168 - DNA, 20 bp, Artificial
  CRISPR gRNA sequence
ccaggctgcggctggggagg

SEQ ID NO: 19169 - DNA, 20 bp, Artificial
  CRISPR gRNA sequence
ggagccatgccttgaacttc

SEQ ID NO: 19170 - DNA, 20 bp, Artificial
  CRISPR gRNA sequence
gagccatgccttgaacttct

SEQ ID NO: 19171 - DNA, 20 bp, Artificial
  CRISPR gRNA sequence
gccacctctcctgtgccacc

SEQ ID NO: 19172 - DNA, 20 bp, Artificial
  CRISPR gRNA sequence
ccacctctcctgtgccacct

SEQ ID NO: 19173 - DNA, 20 bp, Artificial
  CRISPR gRNA sequence
cacctctcctgtgccaccta

SEQ ID NO: 19174 - DNA, 20 bp, Artificial
  CRISPR gRNA sequence
ctctcctgtgccacctaggg

SEQ ID NO: 19175 - DNA, 20 bp, Artificial
  CRISPR gRNA sequence
ctcctgtgccacctagggtg

SEQ ID NO: 19176 - DNA, 20 bp, Artificial
  CRISPR gRNA sequence
cctgtgccacctagggtgga

SEQ ID NO: 19177 - DNA, 20 bp, Artificial
  CRISPR gRNA sequence
ctgtgccacctagggtggag

SEQ ID NO: 19178 - DNA, 20 bp, Artificial
  CRISPR gRNA sequence
tgtgccacctagggtggaga

SEQ ID NO: 19179 - DNA, 20 bp, Artificial
  CRISPR gRNA sequence
gtgccacctagggtggagag

SEQ ID NO: 19180 - DNA, 20 bp, Artificial
  CRISPR gRNA sequence
cctagggtggagaggggctg

SEQ ID NO: 19181 - DNA, 20 bp, Artificial
  CRISPR gRNA sequence
ctagggtggagaggggctgt

SEQ ID NO: 19182 - DNA, 20 bp, Artificial
  CRISPR gRNA sequence
tggagaggggctgtgggact

SEQ ID NO: 19183 - DNA, 20 bp, Artificial
  CRISPR gRNA sequence
ggagaggggctgtgggactc

SEQ ID NO: 19184 - DNA, 20 bp, Artificial
  CRISPR gRNA sequence
agaggggctgtgggactcag

SEQ ID NO: 19185 - DNA, 20 bp, Artificial
  CRISPR gRNA sequence
gaggggctgtgggactcagg

SEQ ID NO: 19186 - DNA, 20 bp, Artificial
  CRISPR gRNA sequence
tgtgggactcaggaggaccg

SEQ ID NO: 19187 - DNA, 20 bp, Artificial
  CRISPR gRNA sequence
tcaggaggaccgcggctttt

SEQ ID NO: 19188 - DNA, 20 bp, Artificial
  CRISPR gRNA sequence
aggaggaccgcggcttttaa

SEQ ID NO: 19189 - DNA, 20 bp, Artificial
  CRISPR gRNA sequence
accgcggcttttaagagttc

SEQ ID NO: 19190 - DNA, 20 bp, Artificial
  CRISPR gRNA sequence
gcttttaagagttccagact

SEQ ID NO: 19191 - DNA, 20 bp, Artificial
  CRISPR gRNA sequence
taagagttccagactaagct

SEQ ID NO: 19192 - DNA, 20 bp, Artificial
  CRISPR gRNA sequence
gttccagactaagctaagca

SEQ ID NO: 19193 - DNA, 20 bp, Artificial
  CRISPR gRNA sequence
ccagactaagctaagcatgg

SEQ ID NO: 19194 - DNA, 20 bp, Artificial
  CRISPR gRNA sequence
aagcatggtggctccgattc

SEQ ID NO: 19195 - DNA, 20 bp, Artificial
  CRISPR gRNA sequence
ggctccgattccggctttcc

SEQ ID NO: 19196 - DNA, 20 bp, Artificial
  CRISPR gRNA sequence
attccggctttcctggaccc

SEQ ID NO: 19197 - DNA, 20 bp, Artificial
  CRISPR gRNA sequence
ttccggctttcctggacccc

SEQ ID NO: 19198 - DNA, 20 bp, Artificial
  CRISPR gRNA sequence
tccggctttcctggacccca

SEQ ID NO: 19199 - DNA, 20 bp, Artificial
  CRISPR gRNA sequence
cggctttcctggaccccagg

SEQ ID NO: 19200 - DNA, 20 bp, Artificial
  CRISPR gRNA sequence
ccaatctcccactcccaccc

SEQ ID NO: 19201 - DNA, 20 bp, Artificial
  CRISPR gRNA sequence
ccaccccggcattcgcacgc

SEQ ID NO: 19202 - DNA, 20 bp, Artificial
  CRISPR gRNA sequence
gcattcgcacgctggctttc

SEQ ID NO: 19203 - DNA, 20 bp, Artificial
  CRISPR gRNA sequence
cattcgcacgctggctttcc

SEQ ID NO: 19204 - DNA, 20 bp, Artificial
  CRISPR gRNA sequence
attcgcacgctggctttccg

SEQ ID NO: 19205 - DNA, 20 bp, Artificial
  CRISPR gRNA sequence
gctggctttccggggcgctt

SEQ ID NO: 19206 - DNA, 20 bp, Artificial
  CRISPR gRNA sequence
ggcgctttagcctctctcct

SEQ ID NO: 19207 - DNA, 20 bp, Artificial
  CRISPR gRNA sequence
cgctttagcctctctcctta

SEQ ID NO: 19208 - DNA, 20 bp, Artificial
  CRISPR gRNA sequence
gctttagcctctctccttag

SEQ ID NO: 19209 - DNA, 20 bp, Artificial
  CRISPR gRNA sequence
ctttagcctctctccttaga

SEQ ID NO: 19210 - DNA, 20 bp, Artificial
  CRISPR gRNA sequence
tctccttagagggtgtgact

SEQ ID NO: 19211 - DNA, 20 bp, Artificial
  CRISPR gRNA sequence
ctccttagagggtgtgactc

SEQ ID NO: 19212 - DNA, 20 bp, Artificial
  CRISPR gRNA sequence
tccttagagggtgtgactca

SEQ ID NO: 19213 - DNA, 20 bp, Artificial
  CRISPR gRNA sequence
gggtgtgactcagggcccca

SEQ ID NO: 19214 - DNA, 20 bp, Artificial
  CRISPR gRNA sequence
gtgactcagggccccaaagc

SEQ ID NO: 19215 - DNA, 20 bp, Artificial
  CRISPR gRNA sequence
tgactcagggccccaaagcg

SEQ ID NO: 19216 - DNA, 20 bp, Artificial
  CRISPR gRNA sequence
ctcagggccccaaagcgagg

SEQ ID NO: 19217 - DNA, 20 bp, Artificial
  CRISPR gRNA sequence
cagggccccaaagcgaggta

SEQ ID NO: 19218 - DNA, 20 bp, Artificial
  CRISPR gRNA sequence
ggccccaaagcgaggtagag

SEQ ID NO: 19219 - DNA, 20 bp, Artificial
  CRISPR gRNA sequence
ccaaagcgaggtagagaagt

SEQ ID NO: 19220 - DNA, 20 bp, Artificial
  CRISPR gRNA sequence
aaagcgaggtagagaagtga

SEQ ID NO: 19221 - DNA, 20 bp, Artificial
  CRISPR gRNA sequence
aggtagagaagtgagagatc

SEQ ID NO: 19222 - DNA, 20 bp, Artificial
  CRISPR gRNA sequence
gtagagaagtgagagatcaa

SEQ ID NO: 19223 - DNA, 20 bp, Artificial
  CRISPR gRNA sequence
gaagtgagagatcaagagat

SEQ ID NO: 19224 - DNA, 20 bp, Artificial
  CRISPR gRNA sequence
gagagatcaagagatcggtt

SEQ ID NO: 19225 - DNA, 20 bp, Artificial
  CRISPR gRNA sequence
atcaagagatcggttcagtc

SEQ ID NO: 19226 - DNA, 20 bp, Artificial
  CRISPR gRNA sequence
tcaagagatcggttcagtcc

SEQ ID NO: 19227 - DNA, 20 bp, Artificial
  CRISPR gRNA sequence
caagagatcggttcagtccg

SEQ ID NO: 19228 - DNA, 20 bp, Artificial
  CRISPR gRNA sequence
aagagatcggttcagtccgg

SEQ ID NO: 19229 - DNA, 20 bp, Artificial
  CRISPR gRNA sequence
agagatcggttcagtccggg

SEQ ID NO: 19230 - DNA, 20 bp, Artificial
  CRISPR gRNA sequence
caacaacacacaccttcgcc

SEQ ID NO: 19231 - DNA, 20 bp, Artificial
  CRISPR gRNA sequence
ccttcgccaagatgttcaac

SEQ ID NO: 19232 - DNA, 20 bp, Artificial
  CRISPR gRNA sequence
ttcgccaagatgttcaacga

SEQ ID NO: 19233 - DNA, 20 bp, Artificial
  CRISPR gRNA sequence
caagatgttcaacgagagtt

SEQ ID NO: 19234 - DNA, 20 bp, Artificial
  CRISPR gRNA sequence
aagatgttcaacgagagttg

SEQ ID NO: 19235 - DNA, 20 bp, Artificial
  CRISPR gRNA sequence
tgaggacttatcccatcctc

SEQ ID NO: 19236 - DNA, 20 bp, Artificial
  CRISPR gRNA sequence
cttatcccatcctctggtta

SEQ ID NO: 19237 - DNA, 20 bp, Artificial
  CRISPR gRNA sequence
ttatcccatcctctggttaa

SEQ ID NO: 19238 - DNA, 20 bp, Artificial
  CRISPR gRNA sequence
ccatcctctggttaaaggtt

SEQ ID NO: 19239 - DNA, 20 bp, Artificial
  CRISPR gRNA sequence
tggctccctactgcctccct

SEQ ID NO: 19240 - DNA, 20 bp, Artificial
  CRISPR gRNA sequence
ctccctactgcctccctgag

SEQ ID NO: 19241 - DNA, 20 bp, Artificial
  CRISPR gRNA sequence
tccctactgcctccctgagc

SEQ ID NO: 19242 - DNA, 20 bp, Artificial
  CRISPR gRNA sequence
ccctactgcctccctgagca

SEQ ID NO: 19243 - DNA, 20 bp, Artificial
  CRISPR gRNA sequence
cctgagcagggccccccgcc

SEQ ID NO: 19244 - DNA, 20 bp, Artificial
  CRISPR gRNA sequence
tgagcagggccccccgcctg

SEQ ID NO: 19245 - DNA, 20 bp, Artificial
  CRISPR gRNA sequence
agcagggccccccgcctgga

SEQ ID NO: 19246 - DNA, 20 bp, Artificial
  CRISPR gRNA sequence
gcctggagagcccaataccc

SEQ ID NO: 19247 - DNA, 20 bp, Artificial
  CRISPR gRNA sequence
gagcccaatacccaagattc

SEQ ID NO: 19248 - DNA, 20 bp, Artificial
  CRISPR gRNA sequence
gcccaatacccaagattcca

SEQ ID NO: 19249 - DNA, 20 bp, Artificial
  CRISPR gRNA sequence
aatacccaagattccagagt

SEQ ID NO: 19250 - DNA, 20 bp, Artificial
  CRISPR gRNA sequence
tacccaagattccagagtta

SEQ ID NO: 19251 - DNA, 20 bp, Artificial
  CRISPR gRNA sequence
caagattccagagttagaga

SEQ ID NO: 19252 - DNA, 20 bp, Artificial
  CRISPR gRNA sequence
agagatggaatatgacccaa

SEQ ID NO: 19253 - DNA, 20 bp, Artificial
  CRISPR gRNA sequence
gagatggaatatgacccaac

SEQ ID NO: 19254 - DNA, 20 bp, Artificial
  CRISPR gRNA sequence
agatggaatatgacccaaca

SEQ ID NO: 19255 - DNA, 20 bp, Artificial
  CRISPR gRNA sequence
ggaatatgacccaacaggga

SEQ ID NO: 19256 - DNA, 20 bp, Artificial
  CRISPR gRNA sequence
atgacccaacagggaaagtg

SEQ ID NO: 19257 - DNA, 20 bp, Artificial
  CRISPR gRNA sequence
ccaacagggaaagtgaagct

SEQ ID NO: 19258 - DNA, 20 bp, Artificial
  CRISPR gRNA sequence
caacagggaaagtgaagctc

SEQ ID NO: 19259 - DNA, 20 bp, Artificial
  CRISPR gRNA sequence
aacagggaaagtgaagctca

SEQ ID NO: 19260 - DNA, 20 bp, Artificial
  CRISPR gRNA sequence
ggaaagtgaagctcagggaa

SEQ ID NO: 19261 - DNA, 20 bp, Artificial
  CRISPR gRNA sequence
aagtgaagctcagggaacgg

SEQ ID NO: 19262 - DNA, 20 bp, Artificial
  CRISPR gRNA sequence
agctcagggaacggcggccc

SEQ ID NO: 19263 - DNA, 20 bp, Artificial
  CRISPR gRNA sequence
ggaacggcggccctggtcca

SEQ ID NO: 19264 - DNA, 20 bp, Artificial
  CRISPR gRNA sequence
ggcggccctggtccaaagtc

SEQ ID NO: 19265 - DNA, 20 bp, Artificial
  CRISPR gRNA sequence
tggtccaaagtctggcgtac

SEQ ID NO: 19266 - DNA, 20 bp, Artificial
  CRISPR gRNA sequence
tccaaagtctggcgtacaag

SEQ ID NO: 19267 - DNA, 20 bp, Artificial
  CRISPR gRNA sequence
ccaaagtctggcgtacaaga

SEQ ID NO: 19268 - DNA, 20 bp, Artificial
  CRISPR gRNA sequence
caaagtctggcgtacaagaa

SEQ ID NO: 19269 - DNA, 20 bp, Artificial
  CRISPR gRNA sequence
aagaagggcgcgcacctctg

SEQ ID NO: 19270 - DNA, 20 bp, Artificial
  CRISPR gRNA sequence
agaagggcgcgcacctctgc

SEQ ID NO: 19271 - DNA, 20 bp, Artificial
  CRISPR gRNA sequence
cgcgcacctctgcaggatcc

SEQ ID NO: 19272 - DNA, 20 bp, Artificial
  CRISPR gRNA sequence
gcgcacctctgcaggatccc

SEQ ID NO: 19273 - DNA, 20 bp, Artificial
  CRISPR gRNA sequence
tctgcaggatcccgggcgcg

SEQ ID NO: 19274 - DNA, 20 bp, Artificial
  CRISPR gRNA sequence
tgcaggatcccgggcgcgcg

SEQ ID NO: 19275 - DNA, 20 bp, Artificial
  CRISPR gRNA sequence
ggatcccgggcgcgcggagt

SEQ ID NO: 19276 - DNA, 20 bp, Artificial
  CRISPR gRNA sequence
ccgggcgcgcggagtcggcc

SEQ ID NO: 19277 - DNA, 20 bp, Artificial
  CRISPR gRNA sequence
cgggcgcgcggagtcggcca

SEQ ID NO: 19278 - DNA, 20 bp, Artificial
  CRISPR gRNA sequence
gggcgcgcggagtcggccaa

SEQ ID NO: 19279 - DNA, 20 bp, Artificial
  CRISPR gRNA sequence
cgcgcggagtcggccaaggg

SEQ ID NO: 19280 - DNA, 20 bp, Artificial
  CRISPR gRNA sequence
cggagtcggccaagggtggc

SEQ ID NO: 19281 - DNA, 20 bp, Artificial
  CRISPR gRNA sequence
ggagtcggccaagggtggcc

SEQ ID NO: 19282 - DNA, 20 bp, Artificial
  CRISPR gRNA sequence
gagtcggccaagggtggccg

SEQ ID NO: 19283 - DNA, 20 bp, Artificial
  CRISPR gRNA sequence
agtcggccaagggtggccgg

SEQ ID NO: 19284 - DNA, 20 bp, Artificial
  CRISPR gRNA sequence
tcggccaagggtggccgggg

SEQ ID NO: 19285 - DNA, 20 bp, Artificial
  CRISPR gRNA sequence
gtgtgtctgctccgcgctcc

SEQ ID NO: 19286 - DNA, 20 bp, Artificial
  CRISPR gRNA sequence
cgcgctcccagtctgcgctc

SEQ ID NO: 19287 - DNA, 20 bp, Artificial
  CRISPR gRNA sequence
tctgcgctccggcttctctg

SEQ ID NO: 19288 - DNA, 20 bp, Artificial
  CRISPR gRNA sequence
gcgctccggcttctctgcag

SEQ ID NO: 19289 - DNA, 20 bp, Artificial
  CRISPR gRNA sequence
ttctctgcagaagctgccgc

SEQ ID NO: 19290 - DNA, 20 bp, Artificial
  CRISPR gRNA sequence
tctctgcagaagctgccgcc

SEQ ID NO: 19291 - DNA, 20 bp, Artificial
  CRISPR gRNA sequence
gctttcctgccacccgccca

SEQ ID NO: 19292 - DNA, 20 bp, Artificial
  CRISPR gRNA sequence
ctgccacccgcccacggccc

SEQ ID NO: 19293 - DNA, 20 bp, Artificial
  CRISPR gRNA sequence
gccacccgcccacggccccg

SEQ ID NO: 19294 - DNA, 20 bp, Artificial
  CRISPR gRNA sequence
cgcccacggccccggagctc

SEQ ID NO: 19295 - DNA, 20 bp, Artificial
  CRISPR gRNA sequence
gcccacggccccggagctct

SEQ ID NO: 19296 - DNA, 20 bp, Artificial
  CRISPR gRNA sequence
cggccccggagctctgggca

SEQ ID NO: 19297 - DNA, 20 bp, Artificial
  CRISPR gRNA sequence
cccggagctctgggcacagc

SEQ ID NO: 19298 - DNA, 20 bp, Artificial
  CRISPR gRNA sequence
agctctgggcacagcaagcc

SEQ ID NO: 19299 - DNA, 20 bp, Artificial
  CRISPR gRNA sequence
gggcacagcaagccaagctc

SEQ ID NO: 19300 - DNA, 20 bp, Artificial
  CRISPR gRNA sequence
ggcacagcaagccaagctcc

SEQ ID NO: 19301 - DNA, 20 bp, Artificial
  CRISPR gRNA sequence
caagccaagctccgggttcc

SEQ ID NO: 19302 - DNA, 20 bp, Artificial
  CRISPR gRNA sequence
agctccgggttcccggctcc

SEQ ID NO: 19303 - DNA, 20 bp, Artificial
  CRISPR gRNA sequence
cccggctcctggttcccgcg

SEQ ID NO: 19304 - DNA, 20 bp, Artificial
  CRISPR gRNA sequence
cggctcctggttcccgcgca

SEQ ID NO: 19305 - DNA, 20 bp, Artificial
  CRISPR gRNA sequence
gttcccgcgcagagtcgttg

SEQ ID NO: 19306 - DNA, 20 bp, Artificial
  CRISPR gRNA sequence
ttcccgcgcagagtcgttgc

SEQ ID NO: 19307 - DNA, 20 bp, Artificial
  CRISPR gRNA sequence
tcccgcgcagagtcgttgcg

SEQ ID NO: 19308 - DNA, 20 bp, Artificial
  CRISPR gRNA sequence
cagagtcgttgcggggatgc

SEQ ID NO: 19309 - DNA, 20 bp, Artificial
  CRISPR gRNA sequence
gttgcggggatgctggaaac

SEQ ID NO: 19310 - DNA, 20 bp, Artificial
  CRISPR gRNA sequence
ttgcggggatgctggaaacg

SEQ ID NO: 19311 - DNA, 20 bp, Artificial
  CRISPR gRNA sequence
gctggaaacgaggtgtttcc

SEQ ID NO: 19312 - DNA, 20 bp, Artificial
  CRISPR gRNA sequence
attccatccccccatcctcc

SEQ ID NO: 19313 - DNA, 20 bp, Artificial
  CRISPR gRNA sequence
cagacttgctgtgtgacctt

SEQ ID NO: 19314 - DNA, 20 bp, Artificial
  CRISPR gRNA sequence
cttgctgtgtgaccttgagc

SEQ ID NO: 19315 - DNA, 20 bp, Artificial
  CRISPR gRNA sequence
gctgtgtgaccttgagcaag

SEQ ID NO: 19316 - DNA, 20 bp, Artificial
  CRISPR gRNA sequence
gaccttgagcaagtagctga

SEQ ID NO: 19317 - DNA, 20 bp, Artificial
  CRISPR gRNA sequence
gagcaagtagctgacagtct

SEQ ID NO: 19318 - DNA, 20 bp, Artificial
  CRISPR gRNA sequence
gcaagtagctgacagtctcg

SEQ ID NO: 19319 - DNA, 20 bp, Artificial
  CRISPR gRNA sequence
agtctcggagcctcgattct

SEQ ID NO: 19320 - DNA, 20 bp, Artificial
  CRISPR gRNA sequence
ctcgattctcagcccgacct

SEQ ID NO: 19321 - DNA, 20 bp, Artificial
  CRISPR gRNA sequence
tcgattctcagcccgacctt

SEQ ID NO: 19322 - DNA, 20 bp, Artificial
  CRISPR gRNA sequence
cgattctcagcccgacctta

SEQ ID NO: 19323 - DNA, 20 bp, Artificial
  CRISPR gRNA sequence
gattctcagcccgaccttag

SEQ ID NO: 19324 - DNA, 20 bp, Artificial
  CRISPR gRNA sequence
cagcccgaccttaggggtta

SEQ ID NO: 19325 - DNA, 20 bp, Artificial
  CRISPR gRNA sequence
gcccgaccttaggggttaca

SEQ ID NO: 19326 - DNA, 20 bp, Artificial
  CRISPR gRNA sequence
cccgaccttaggggttacag

SEQ ID NO: 19327 - DNA, 20 bp, Artificial
  CRISPR gRNA sequence
cgaccttaggggttacagag

SEQ ID NO: 19328 - DNA, 20 bp, Artificial
  CRISPR gRNA sequence
aggggttacagaggagactt

SEQ ID NO: 19329 - DNA, 20 bp, Artificial
  CRISPR gRNA sequence
ggtcacctaccgctgttccc

SEQ ID NO: 19330 - DNA, 20 bp, Artificial
  CRISPR gRNA sequence
gtcacctaccgctgttcccc

SEQ ID NO: 19331 - DNA, 20 bp, Artificial
  CRISPR gRNA sequence
cgggctcccgcgcgcgctgc

SEQ ID NO: 19332 - DNA, 20 bp, Artificial
  CRISPR gRNA sequence
gctcccgcgcgcgctgctgg

SEQ ID NO: 19333 - DNA, 20 bp, Artificial
  CRISPR gRNA sequence
tggtggcctctccctcccgc

SEQ ID NO: 19334 - DNA, 20 bp, Artificial
  CRISPR gRNA sequence
cctctccctcccgccagctc

SEQ ID NO: 19335 - DNA, 20 bp, Artificial
  CRISPR gRNA sequence
ctctccctcccgccagctct

SEQ ID NO: 19336 - DNA, 20 bp, Artificial
  CRISPR gRNA sequence
tctccctcccgccagctctg

SEQ ID NO: 19337 - DNA, 20 bp, Artificial
  CRISPR gRNA sequence
tcccgccagctctggggccg

SEQ ID NO: 19338 - DNA, 20 bp, Artificial
  CRISPR gRNA sequence
gccagctctggggccgcggc

SEQ ID NO: 19339 - DNA, 20 bp, Artificial
  CRISPR gRNA sequence
ctggggccgcggcaagtctg

SEQ ID NO: 19340 - DNA, 20 bp, Artificial
  CRISPR gRNA sequence
gggccgcggcaagtctgtgg

SEQ ID NO: 19341 - DNA, 20 bp, Artificial
  CRISPR gRNA sequence
gtctgtggcagctcgtccgc

SEQ ID NO: 19342 - DNA, 20 bp, Artificial
  CRISPR gRNA sequence
cctacctccccgcctccccg

SEQ ID NO: 19343 - DNA, 20 bp, Artificial
  CRISPR gRNA sequence
tccctttcactttctttctg

SEQ ID NO: 19344 - DNA, 20 bp, Artificial
  CRISPR gRNA sequence
cactttctttctgcagcgct

SEQ ID NO: 19345 - DNA, 20 bp, Artificial
  CRISPR gRNA sequence
tctttctgcagcgctgagct

SEQ ID NO: 19346 - DNA, 20 bp, Artificial
  CRISPR gRNA sequence
ctttctgcagcgctgagctc

SEQ ID NO: 19347 - DNA, 20 bp, Artificial
  CRISPR gRNA sequence
ctgcagcgctgagctcgggc

SEQ ID NO: 19348 - DNA, 20 bp, Artificial
  CRISPR gRNA sequence
tgcagcgctgagctcgggcc

SEQ ID NO: 19349 - DNA, 20 bp, Artificial
  CRISPR gRNA sequence
gctgagctcgggccaggctg

SEQ ID NO: 19350 - DNA, 20 bp, Artificial
  CRISPR gRNA sequence
tgagctcgggccaggctgtg

SEQ ID NO: 19351 - DNA, 20 bp, Artificial
  CRISPR gRNA sequence
ggccaggctgtggagcaacc

SEQ ID NO: 19352 - DNA, 20 bp, Artificial
  CRISPR gRNA sequence
gagcaaccaagcacctactg

SEQ ID NO: 19353 - DNA, 20 bp, Artificial
  CRISPR gRNA sequence
gtggccaccacgtgctttat

SEQ ID NO: 19354 - DNA, 20 bp, Artificial
  CRISPR gRNA sequence
gccaccacgtgctttatcag

SEQ ID NO: 19355 - DNA, 20 bp, Artificial
  CRISPR gRNA sequence
accacgtgctttatcagaag

SEQ ID NO: 19356 - DNA, 20 bp, Artificial
  CRISPR gRNA sequence
gaagtggcatcccaactgcc

SEQ ID NO: 19357 - DNA, 20 bp, Artificial
  CRISPR gRNA sequence
aagtggcatcccaactgcct

SEQ ID NO: 19358 - DNA, 20 bp, Artificial
  CRISPR gRNA sequence
agtggcatcccaactgcctg

SEQ ID NO: 19359 - DNA, 20 bp, Artificial
  CRISPR gRNA sequence
cccaactgcctggggcatcc

SEQ ID NO: 19360 - DNA, 20 bp, Artificial
  CRISPR gRNA sequence
caactgcctggggcatccaa

SEQ ID NO: 19361 - DNA, 20 bp, Artificial
  CRISPR gRNA sequence
aactgcctggggcatccaag

SEQ ID NO: 19362 - DNA, 20 bp, Artificial
  CRISPR gRNA sequence
atccaagaggtccctgcctc

SEQ ID NO: 19363 - DNA, 20 bp, Artificial
  CRISPR gRNA sequence
aagaggtccctgcctccagt

SEQ ID NO: 19364 - DNA, 20 bp, Artificial
  CRISPR gRNA sequence
tgcctccagtcggttcctca

SEQ ID NO: 19365 - DNA, 20 bp, Artificial
  CRISPR gRNA sequence
ctccagtcggttcctcacag

SEQ ID NO: 19366 - DNA, 20 bp, Artificial
  CRISPR gRNA sequence
agtcggttcctcacagtggc

SEQ ID NO: 19367 - DNA, 20 bp, Artificial
  CRISPR gRNA sequence
cacagtggccagccccactt

SEQ ID NO: 19368 - DNA, 20 bp, Artificial
  CRISPR gRNA sequence
acagtggccagccccacttc

SEQ ID NO: 19369 - DNA, 20 bp, Artificial
  CRISPR gRNA sequence
cagtggccagccccacttcg

SEQ ID NO: 19370 - DNA, 20 bp, Artificial
  CRISPR gRNA sequence
gtggccagccccacttcggg

SEQ ID NO: 19371 - DNA, 20 bp, Artificial
  CRISPR gRNA sequence
ggccagccccacttcgggga

SEQ ID NO: 19372 - DNA, 20 bp, Artificial
  CRISPR gRNA sequence
ccccacttcggggagagtcc

SEQ ID NO: 19373 - DNA, 20 bp, Artificial
  CRISPR gRNA sequence
cccacttcggggagagtccc

SEQ ID NO: 19374 - DNA, 20 bp, Artificial
  CRISPR gRNA sequence
tcggggagagtcccaggccc

SEQ ID NO: 19375 - DNA, 20 bp, Artificial
  CRISPR gRNA sequence
cggggagagtcccaggcccc

SEQ ID NO: 19376 - DNA, 20 bp, Artificial
  CRISPR gRNA sequence
gagagtcccaggccccgggc

SEQ ID NO: 19377 - DNA, 20 bp, Artificial
  CRISPR gRNA sequence
agagtcccaggccccgggcc

SEQ ID NO: 19378 - DNA, 20 bp, Artificial
  CRISPR gRNA sequence
agtcccaggccccgggccag

SEQ ID NO: 19379 - DNA, 20 bp, Artificial
  CRISPR gRNA sequence
ccaggccccgggccaggagc

SEQ ID NO: 19380 - DNA, 20 bp, Artificial
  CRISPR gRNA sequence
caggccccgggccaggagcc

SEQ ID NO: 19381 - DNA, 20 bp, Artificial
  CRISPR gRNA sequence
ggccccgggccaggagccag

SEQ ID NO: 19382 - DNA, 20 bp, Artificial
  CRISPR gRNA sequence
ccgggccaggagccaggagc

SEQ ID NO: 19383 - DNA, 20 bp, Artificial
  CRISPR gRNA sequence
cgggccaggagccaggagct

SEQ ID NO: 19384 - DNA, 20 bp, Artificial
  CRISPR gRNA sequence
gggccaggagccaggagcta

SEQ ID NO: 19385 - DNA, 20 bp, Artificial
  CRISPR gRNA sequence
gccaggagccaggagctagg

SEQ ID NO: 19386 - DNA, 20 bp, Artificial
  CRISPR gRNA sequence
ccaggagctagggagccact

SEQ ID NO: 19387 - DNA, 20 bp, Artificial
  CRISPR gRNA sequence
caggagctagggagccactt

SEQ ID NO: 19388 - DNA, 20 bp, Artificial
  CRISPR gRNA sequence
agctagggagccacttgggc

SEQ ID NO: 19389 - DNA, 20 bp, Artificial
  CRISPR gRNA sequence
cacttgggcaagtgatctgc

SEQ ID NO: 19390 - DNA, 20 bp, Artificial
  CRISPR gRNA sequence
gcaagtgatctgcaagtcct

SEQ ID NO: 19391 - DNA, 20 bp, Artificial
  CRISPR gRNA sequence
gatctgcaagtcctgagttg

SEQ ID NO: 19392 - DNA, 20 bp, Artificial
  CRISPR gRNA sequence
atctgcaagtcctgagttgc

SEQ ID NO: 19393 - DNA, 20 bp, Artificial
  CRISPR gRNA sequence
tctgcaagtcctgagttgca

SEQ ID NO: 19394 - DNA, 20 bp, Artificial
  CRISPR gRNA sequence
tgcaagtcctgagttgcagg

SEQ ID NO: 19395 - DNA, 20 bp, Artificial
  CRISPR gRNA sequence
agggagcttgtccccacccc

SEQ ID NO: 19396 - DNA, 20 bp, Artificial
  CRISPR gRNA sequence
gggagcttgtccccacccct

SEQ ID NO: 19397 - DNA, 20 bp, Artificial
  CRISPR gRNA sequence
agcttgtccccacccctggg

SEQ ID NO: 19398 - DNA, 20 bp, Artificial
  CRISPR gRNA sequence
gcttgtccccacccctgggt

SEQ ID NO: 19399 - DNA, 20 bp, Artificial
  CRISPR gRNA sequence
gtctctgtttctctccaact

SEQ ID NO: 19400 - DNA, 20 bp, Artificial
  CRISPR gRNA sequence
ccaactcagtccaaccgtga

SEQ ID NO: 19401 - DNA, 20 bp, Artificial
  CRISPR gRNA sequence
actcagtccaaccgtgaaag

SEQ ID NO: 19402 - DNA, 20 bp, Artificial
  CRISPR gRNA sequence
gaaagtggcaaaccacctcc

SEQ ID NO: 19403 - DNA, 20 bp, Artificial
  CRISPR gRNA sequence
aaagtggcaaaccacctccg

SEQ ID NO: 19404 - DNA, 20 bp, Artificial
  CRISPR gRNA sequence
aagtggcaaaccacctccga

SEQ ID NO: 19405 - DNA, 20 bp, Artificial
  CRISPR gRNA sequence
aaaccacctccgagggcaca

SEQ ID NO: 19406 - DNA, 20 bp, Artificial
  CRISPR gRNA sequence
tccgagggcacatggcccct

SEQ ID NO: 19407 - DNA, 20 bp, Artificial
  CRISPR gRNA sequence
gggcacatggcccctgagat

SEQ ID NO: 19408 - DNA, 20 bp, Artificial
  CRISPR gRNA sequence
gcccctgagatgagctaact

SEQ ID NO: 19409 - DNA, 20 bp, Artificial
  CRISPR gRNA sequence
gctattcactcctctgatgc

SEQ ID NO: 19410 - DNA, 20 bp, Artificial
  CRISPR gRNA sequence
cactcctctgatgctggccc

SEQ ID NO: 19411 - DNA, 20 bp, Artificial
  CRISPR gRNA sequence
actcctctgatgctggccct

SEQ ID NO: 19412 - DNA, 20 bp, Artificial
  CRISPR gRNA sequence
ctcctctgatgctggcccta

SEQ ID NO: 19413 - DNA, 20 bp, Artificial
  CRISPR gRNA sequence
cctctgatgctggccctagg

SEQ ID NO: 19414 - DNA, 20 bp, Artificial
  CRISPR gRNA sequence
ctctgatgctggccctaggg

SEQ ID NO: 19415 - DNA, 20 bp, Artificial
  CRISPR gRNA sequence
tgatgctggccctagggagg

SEQ ID NO: 19416 - DNA, 20 bp, Artificial
  CRISPR gRNA sequence
atgctggccctagggaggaa

SEQ ID NO: 19417 - DNA, 20 bp, Artificial
  CRISPR gRNA sequence
gggaggaagagaaaatccct

SEQ ID NO: 19418 - DNA, 20 bp, Artificial
  CRISPR gRNA sequence
ggaggaagagaaaatccctc

SEQ ID NO: 19419 - DNA, 20 bp, Artificial
  CRISPR gRNA sequence
aatccctcaggtaccttcca

SEQ ID NO: 19420 - DNA, 20 bp, Artificial
  CRISPR gRNA sequence
cctcaggtaccttccatgga

SEQ ID NO: 19421 - DNA, 20 bp, Artificial
  CRISPR gRNA sequence
tgttaccatgaccacacccc

SEQ ID NO: 19422 - DNA, 20 bp, Artificial
  CRISPR gRNA sequence
catgaccacacccccagccg

SEQ ID NO: 19423 - DNA, 20 bp, Artificial
  CRISPR gRNA sequence
accacacccccagccgtggc

SEQ ID NO: 19424 - DNA, 20 bp, Artificial
  CRISPR gRNA sequence
cacacccccagccgtggcaa

SEQ ID NO: 19425 - DNA, 20 bp, Artificial
  CRISPR gRNA sequence
agccgtggcaagagccctgc

SEQ ID NO: 19426 - DNA, 20 bp, Artificial
  CRISPR gRNA sequence
agagccctgccggtcctttt

SEQ ID NO: 19427 - DNA, 20 bp, Artificial
  CRISPR gRNA sequence
agccctgccggtccttttca

SEQ ID NO: 19428 - DNA, 20 bp, Artificial
  CRISPR gRNA sequence
gccctgccggtccttttcag

SEQ ID NO: 19429 - DNA, 20 bp, Artificial
  CRISPR gRNA sequence
ccggtccttttcagaggtct

SEQ ID NO: 19430 - DNA, 20 bp, Artificial
  CRISPR gRNA sequence
cagaggtcttggattcctgc

SEQ ID NO: 19431 - DNA, 20 bp, Artificial
  CRISPR gRNA sequence
agaggtcttggattcctgct

SEQ ID NO: 19432 - DNA, 20 bp, Artificial
  CRISPR gRNA sequence
ggattcctgctgggtcctcc

SEQ ID NO: 19433 - DNA, 20 bp, Artificial
  CRISPR gRNA sequence
gattcctgctgggtcctcca

SEQ ID NO: 19434 - DNA, 20 bp, Artificial
  CRISPR gRNA sequence
tgctgggtcctccaaggcat

SEQ ID NO: 19435 - DNA, 20 bp, Artificial
  CRISPR gRNA sequence
cctccaaggcatgagacttt

SEQ ID NO: 19436 - DNA, 20 bp, Artificial
  CRISPR gRNA sequence
ctccaaggcatgagactttg

SEQ ID NO: 19437 - DNA, 20 bp, Artificial
  CRISPR gRNA sequence
caaggcatgagactttgagg

SEQ ID NO: 19438 - DNA, 20 bp, Artificial
  CRISPR gRNA sequence
aggtggtcactttccctttt

SEQ ID NO: 19439 - DNA, 20 bp, Artificial
  CRISPR gRNA sequence
ggtggtcactttcccttttc

SEQ ID NO: 19440 - DNA, 20 bp, Artificial
  CRISPR gRNA sequence
caggcctgaatttcctcatc

SEQ ID NO: 19441 - DNA, 20 bp, Artificial
  CRISPR gRNA sequence
gaatttcctcatctggaatt

SEQ ID NO: 19442 - DNA, 20 bp, Artificial
  CRISPR gRNA sequence
aatttcctcatctggaattg

SEQ ID NO: 19443 - DNA, 20 bp, Artificial
  CRISPR gRNA sequence
atttcctcatctggaattga

SEQ ID NO: 19444 - DNA, 20 bp, Artificial
  CRISPR gRNA sequence
ttcctcatctggaattgagg

SEQ ID NO: 19445 - DNA, 20 bp, Artificial
  CRISPR gRNA sequence
tcctcatctggaattgaggg

SEQ ID NO: 19446 - DNA, 20 bp, Artificial
  CRISPR gRNA sequence
cctcatctggaattgaggga

SEQ ID NO: 19447 - DNA, 20 bp, Artificial
  CRISPR gRNA sequence
ctcatctggaattgagggag

SEQ ID NO: 19448 - DNA, 20 bp, Artificial
  CRISPR gRNA sequence
tcatctggaattgagggagg

SEQ ID NO: 19449 - DNA, 20 bp, Artificial
  CRISPR gRNA sequence
ctggaattgagggagggggc

SEQ ID NO: 19450 - DNA, 20 bp, Artificial
  CRISPR gRNA sequence
tggaattgagggagggggca

SEQ ID NO: 19451 - DNA, 20 bp, Artificial
  CRISPR gRNA sequence
ccccctccaacactttcccg

SEQ ID NO: 19452 - DNA, 20 bp, Artificial
  CRISPR gRNA sequence
acactttcccgtagcaactt

SEQ ID NO: 19453 - DNA, 20 bp, Artificial
  CRISPR gRNA sequence
cactttcccgtagcaactta

SEQ ID NO: 19454 - DNA, 20 bp, Artificial
  CRISPR gRNA sequence
aaggctgcacccaaccacac

SEQ ID NO: 19455 - DNA, 20 bp, Artificial
  CRISPR gRNA sequence
gctgcacccaaccacaccgg

SEQ ID NO: 19456 - DNA, 20 bp, Artificial
  CRISPR gRNA sequence
cacaccggcagacctgtcat

SEQ ID NO: 19457 - DNA, 20 bp, Artificial
  CRISPR gRNA sequence
gcagacctgtcatcagtctc

SEQ ID NO: 19458 - DNA, 20 bp, Artificial
  CRISPR gRNA sequence
cagacctgtcatcagtctct

SEQ ID NO: 19459 - DNA, 20 bp, Artificial
  CRISPR gRNA sequence
gtcatcagtctctgggttca

SEQ ID NO: 19460 - DNA, 20 bp, Artificial
  CRISPR gRNA sequence
tcaaagcaaaccatacattt

SEQ ID NO: 19461 - DNA, 20 bp, Artificial
  CRISPR gRNA sequence
caaagcaaaccatacatttc

SEQ ID NO: 19462 - DNA, 20 bp, Artificial
  CRISPR gRNA sequence
aaagcaaaccatacatttca

SEQ ID NO: 19463 - DNA, 20 bp, Artificial
  CRISPR gRNA sequence
aagcaaaccatacatttcag

SEQ ID NO: 19464 - DNA, 20 bp, Artificial
  CRISPR gRNA sequence
gcaaaccatacatttcaggg

SEQ ID NO: 19465 - DNA, 20 bp, Artificial
  CRISPR gRNA sequence
catacatttcaggggagtct

SEQ ID NO: 19466 - DNA, 20 bp, Artificial
  CRISPR gRNA sequence
atttcaggggagtctgagaa

SEQ ID NO: 19467 - DNA, 20 bp, Artificial
  CRISPR gRNA sequence
tttcaggggagtctgagaaa

SEQ ID NO: 19468 - DNA, 20 bp, Artificial
  CRISPR gRNA sequence
ttcaggggagtctgagaaaa

SEQ ID NO: 19469 - DNA, 20 bp, Artificial
  CRISPR gRNA sequence
cccctttaaccatccaacaa

SEQ ID NO: 19470 - DNA, 20 bp, Artificial
  CRISPR gRNA sequence
acagcaatgccaataaaatt

SEQ ID NO: 19471 - DNA, 20 bp, Artificial
  CRISPR gRNA sequence
caataaaattgagctcctat

SEQ ID NO: 19472 - DNA, 20 bp, Artificial
  CRISPR gRNA sequence
agctcctatgagctcaattc

SEQ ID NO: 19473 - DNA, 20 bp, Artificial
  CRISPR gRNA sequence
ttccagttcctataaaatat

SEQ ID NO: 19474 - DNA, 20 bp, Artificial
  CRISPR gRNA sequence
taaaatattggacactgtgc

SEQ ID NO: 19475 - DNA, 20 bp, Artificial
  CRISPR gRNA sequence
aaaatattggacactgtgct

SEQ ID NO: 19476 - DNA, 20 bp, Artificial
  CRISPR gRNA sequence
ctcatcattaccctttcata

SEQ ID NO: 19477 - DNA, 20 bp, Artificial
  CRISPR gRNA sequence
tcatcattaccctttcatac

SEQ ID NO: 19478 - DNA, 20 bp, Artificial
  CRISPR gRNA sequence
ctttcatacaggctttccca

SEQ ID NO: 19479 - DNA, 20 bp, Artificial
  CRISPR gRNA sequence
tttcatacaggctttcccac

SEQ ID NO: 19480 - DNA, 20 bp, Artificial
  CRISPR gRNA sequence
cacaggtccattgtacactc

SEQ ID NO: 19481 - DNA, 20 bp, Artificial
  CRISPR gRNA sequence
acaggtccattgtacactcc

SEQ ID NO: 19482 - DNA, 20 bp, Artificial
  CRISPR gRNA sequence
cactccaggaaaattgactc

SEQ ID NO: 19483 - DNA, 20 bp, Artificial
  CRISPR gRNA sequence
gagaatgtaaacgacttctt

SEQ ID NO: 19484 - DNA, 20 bp, Artificial
  CRISPR gRNA sequence
agaatgtaaacgacttcttc

SEQ ID NO: 19485 - DNA, 20 bp, Artificial
  CRISPR gRNA sequence
gaatgtaaacgacttcttca

SEQ ID NO: 19486 - DNA, 20 bp, Artificial
  CRISPR gRNA sequence
aatgtaaacgacttcttcag

SEQ ID NO: 19487 - DNA, 20 bp, Artificial
  CRISPR gRNA sequence
cttcaggggcacacccttcc

SEQ ID NO: 19488 - DNA, 20 bp, Artificial
  CRISPR gRNA sequence
ggcacacccttcccagccaa

SEQ ID NO: 19489 - DNA, 20 bp, Artificial
  CRISPR gRNA sequence
acccttcccagccaacggtg

SEQ ID NO: 19490 - DNA, 20 bp, Artificial
  CRISPR gRNA sequence
tgtagctgccatgctgcctt

SEQ ID NO: 19491 - DNA, 20 bp, Artificial
  CRISPR gRNA sequence
tagctgccatgctgccttca

SEQ ID NO: 19492 - DNA, 20 bp, Artificial
  CRISPR gRNA sequence
tgccatgctgccttcagagc

SEQ ID NO: 19493 - DNA, 20 bp, Artificial
  CRISPR gRNA sequence
gctgccttcagagccggtgc

SEQ ID NO: 19494 - DNA, 20 bp, Artificial
  CRISPR gRNA sequence
ctgccttcagagccggtgcc

SEQ ID NO: 19495 - DNA, 20 bp, Artificial
  CRISPR gRNA sequence
ccctttttaaacaacaccat

SEQ ID NO: 19496 - DNA, 20 bp, Artificial
  CRISPR gRNA sequence
cctttttaaacaacaccatt

SEQ ID NO: 19497 - DNA, 20 bp, Artificial
  CRISPR gRNA sequence
aaacaacaccattaggaaac

SEQ ID NO: 19498 - DNA, 20 bp, Artificial
  CRISPR gRNA sequence
aacaacaccattaggaaact

SEQ ID NO: 19499 - DNA, 20 bp, Artificial
  CRISPR gRNA sequence
acaacaccattaggaaactg

SEQ ID NO: 19500 - DNA, 20 bp, Artificial
  CRISPR gRNA sequence
caacaccattaggaaactgg

SEQ ID NO: 19501 - DNA, 20 bp, Artificial
  CRISPR gRNA sequence
aacaccattaggaaactggg

SEQ ID NO: 19502 - DNA, 20 bp, Artificial
  CRISPR gRNA sequence
caccattaggaaactggggg

SEQ ID NO: 19503 - DNA, 20 bp, Artificial
  CRISPR gRNA sequence
accattaggaaactgggggg

SEQ ID NO: 19504 - DNA, 20 bp, Artificial
  CRISPR gRNA sequence
ccattaggaaactgggggga

SEQ ID NO: 19505 - DNA, 20 bp, Artificial
  CRISPR gRNA sequence
ttaggaaactggggggaggg

SEQ ID NO: 19506 - DNA, 20 bp, Artificial
  CRISPR gRNA sequence
ggggggagggcagcatccgc

SEQ ID NO: 19507 - DNA, 20 bp, Artificial
  CRISPR gRNA sequence
cagcatccgccagctctccc

SEQ ID NO: 19508 - DNA, 20 bp, Artificial
  CRISPR gRNA sequence
gccagctctccccagctgct

SEQ ID NO: 19509 - DNA, 20 bp, Artificial
  CRISPR gRNA sequence
ccagctctccccagctgctg

SEQ ID NO: 19510 - DNA, 20 bp, Artificial
  CRISPR gRNA sequence
cagctctccccagctgctga

SEQ ID NO: 19511 - DNA, 20 bp, Artificial
  CRISPR gRNA sequence
cccagctgctgagggctcaa

SEQ ID NO: 19512 - DNA, 20 bp, Artificial
  CRISPR gRNA sequence
gggctcaacagctacacctc

SEQ ID NO: 19513 - DNA, 20 bp, Artificial
  CRISPR gRNA sequence
ggctcaacagctacacctca

SEQ ID NO: 19514 - DNA, 20 bp, Artificial
  CRISPR gRNA sequence
ctcaaggctgactccaattt

SEQ ID NO: 19515 - DNA, 20 bp, Artificial
  CRISPR gRNA sequence
ttttggtttccctgcttctc

SEQ ID NO: 19516 - DNA, 20 bp, Artificial
  CRISPR gRNA sequence
tttggtttccctgcttctct

SEQ ID NO: 19517 - DNA, 20 bp, Artificial
  CRISPR gRNA sequence
tttccctgcttctctgggta

SEQ ID NO: 19518 - DNA, 20 bp, Artificial
  CRISPR gRNA sequence
tccctgcttctctgggtatg

SEQ ID NO: 19519 - DNA, 20 bp, Artificial
  CRISPR gRNA sequence
ctgcttctctgggtatggag

SEQ ID NO: 19520 - DNA, 20 bp, Artificial
  CRISPR gRNA sequence
gcttctctgggtatggagtg

SEQ ID NO: 19521 - DNA, 20 bp, Artificial
  CRISPR gRNA sequence
tctgggtatggagtggagtc

SEQ ID NO: 19522 - DNA, 20 bp, Artificial
  CRISPR gRNA sequence
gggtatggagtggagtctgg

SEQ ID NO: 19523 - DNA, 20 bp, Artificial
  CRISPR gRNA sequence
gtatggagtggagtctggca

SEQ ID NO: 19524 - DNA, 20 bp, Artificial
  CRISPR gRNA sequence
tatggagtggagtctggcag

SEQ ID NO: 19525 - DNA, 20 bp, Artificial
  CRISPR gRNA sequence
ctggcagaggtcccgtcctg

SEQ ID NO: 19526 - DNA, 20 bp, Artificial
  CRISPR gRNA sequence
ggcagaggtcccgtcctgca

SEQ ID NO: 19527 - DNA, 20 bp, Artificial
  CRISPR gRNA sequence
gcagaggtcccgtcctgcag

SEQ ID NO: 19528 - DNA, 20 bp, Artificial
  CRISPR gRNA sequence
cgtcctgcagaggcacccct

SEQ ID NO: 19529 - DNA, 20 bp, Artificial
  CRISPR gRNA sequence
cacccctcagtatttaccca

SEQ ID NO: 19530 - DNA, 20 bp, Artificial
  CRISPR gRNA sequence
acccctcagtatttacccaa

SEQ ID NO: 19531 - DNA, 20 bp, Artificial
  CRISPR gRNA sequence
cccctcagtatttacccaaa

SEQ ID NO: 19532 - DNA, 20 bp, Artificial
  CRISPR gRNA sequence
cctcagtatttacccaaagg

SEQ ID NO: 19533 - DNA, 20 bp, Artificial
  CRISPR gRNA sequence
ctcagtatttacccaaaggg

SEQ ID NO: 19534 - DNA, 20 bp, Artificial
  CRISPR gRNA sequence
gtatttacccaaagggaggc

SEQ ID NO: 19535 - DNA, 20 bp, Artificial
  CRISPR gRNA sequence
tttacccaaagggaggcgag

SEQ ID NO: 19536 - DNA, 20 bp, Artificial
  CRISPR gRNA sequence
gaggcgagaagaccttgctg

SEQ ID NO: 19537 - DNA, 20 bp, Artificial
  CRISPR gRNA sequence
aggcgagaagaccttgctgt

SEQ ID NO: 19538 - DNA, 20 bp, Artificial
  CRISPR gRNA sequence
agaagaccttgctgtgggcc

SEQ ID NO: 19539 - DNA, 20 bp, Artificial
  CRISPR gRNA sequence
gaccttgctgtgggccgagc

SEQ ID NO: 19540 - DNA, 20 bp, Artificial
  CRISPR gRNA sequence
accttgctgtgggccgagcc

SEQ ID NO: 19541 - DNA, 20 bp, Artificial
  CRISPR gRNA sequence
tgctgtgggccgagccaggc

SEQ ID NO: 19542 - DNA, 20 bp, Artificial
  CRISPR gRNA sequence
ccgagccaggccagcatgct

SEQ ID NO: 19543 - DNA, 20 bp, Artificial
  CRISPR gRNA sequence
gagccaggccagcatgctga

SEQ ID NO: 19544 - DNA, 20 bp, Artificial
  CRISPR gRNA sequence
caggccagcatgctgagagt

SEQ ID NO: 19545 - DNA, 20 bp, Artificial
  CRISPR gRNA sequence
gttagtgacacactgcccga

SEQ ID NO: 19546 - DNA, 20 bp, Artificial
  CRISPR gRNA sequence
ctgcccgaaagtctgacttc

SEQ ID NO: 19547 - DNA, 20 bp, Artificial
  CRISPR gRNA sequence
gtctgacttctagaaccttt

SEQ ID NO: 19548 - DNA, 20 bp, Artificial
  CRISPR gRNA sequence
aacctttcggtgctgataca

SEQ ID NO: 19549 - DNA, 20 bp, Artificial
  CRISPR gRNA sequence
ctgatacatggttcatactc

SEQ ID NO: 19550 - DNA, 20 bp, Artificial
  CRISPR gRNA sequence
tggttcatactccagacacc

SEQ ID NO: 19551 - DNA, 20 bp, Artificial
  CRISPR gRNA sequence
ccagacacctggctgacctg

SEQ ID NO: 19552 - DNA, 20 bp, Artificial
  CRISPR gRNA sequence
gctgacctgaagtctccctc

SEQ ID NO: 19553 - DNA, 20 bp, Artificial
  CRISPR gRNA sequence
gacctgaagtctccctccgg

SEQ ID NO: 19554 - DNA, 20 bp, Artificial
  CRISPR gRNA sequence
ctgaagtctccctccggtgg

SEQ ID NO: 19555 - DNA, 20 bp, Artificial
  CRISPR gRNA sequence
tgaagtctccctccggtgga

SEQ ID NO: 19556 - DNA, 20 bp, Artificial
  CRISPR gRNA sequence
ctccctccggtggaaggaaa

SEQ ID NO: 19557 - DNA, 20 bp, Artificial
  CRISPR gRNA sequence
aactctttcacatcttccaa

SEQ ID NO: 19558 - DNA, 20 bp, Artificial
  CRISPR gRNA sequence
catcttccaatggcctgccc

SEQ ID NO: 19559 - DNA, 20 bp, Artificial
  CRISPR gRNA sequence
cttccaatggcctgccccag

SEQ ID NO: 19560 - DNA, 20 bp, Artificial
  CRISPR gRNA sequence
ttccaatggcctgccccagc

SEQ ID NO: 19561 - DNA, 20 bp, Artificial
  CRISPR gRNA sequence
tggcctgccccagcaggaca

SEQ ID NO: 19562 - DNA, 20 bp, Artificial
  CRISPR gRNA sequence
cctcacccccatccccaatt

SEQ ID NO: 19563 - DNA, 20 bp, Artificial
  CRISPR gRNA sequence
cccccatccccaattcagaa

SEQ ID NO: 19564 - DNA, 20 bp, Artificial
  CRISPR gRNA sequence
gaatggtttctctgtttatc

SEQ ID NO: 19565 - DNA, 20 bp, Artificial
  CRISPR gRNA sequence
gtttctctgtttatctggaa

SEQ ID NO: 19566 - DNA, 20 bp, Artificial
  CRISPR gRNA sequence
tctctgtttatctggaatgg

SEQ ID NO: 19567 - DNA, 20 bp, Artificial
  CRISPR gRNA sequence
ctctgtttatctggaatggc

SEQ ID NO: 19568 - DNA, 20 bp, Artificial
  CRISPR gRNA sequence
tttatctggaatggcaggac

SEQ ID NO: 19569 - DNA, 20 bp, Artificial
  CRISPR gRNA sequence
ctggaatggcaggaccagct

SEQ ID NO: 19570 - DNA, 20 bp, Artificial
  CRISPR gRNA sequence
ctgagactgcacgctaaatt

SEQ ID NO: 19571 - DNA, 20 bp, Artificial
  CRISPR gRNA sequence
gctaaattaagatgctttcc

SEQ ID NO: 19572 - DNA, 20 bp, Artificial
  CRISPR gRNA sequence
ctttcccggcctttttacct

SEQ ID NO: 19573 - DNA, 20 bp, Artificial
  CRISPR gRNA sequence
tttcccggcctttttacctt

SEQ ID NO: 19574 - DNA, 20 bp, Artificial
  CRISPR gRNA sequence
ttcccggcctttttaccttg

SEQ ID NO: 19575 - DNA, 20 bp, Artificial
  CRISPR gRNA sequence
tttttaccttggggctctga

SEQ ID NO: 19576 - DNA, 20 bp, Artificial
  CRISPR gRNA sequence
ttttaccttggggctctgac

SEQ ID NO: 19577 - DNA, 20 bp, Artificial
  CRISPR gRNA sequence
taccttggggctctgacagg

SEQ ID NO: 19578 - DNA, 20 bp, Artificial
  CRISPR gRNA sequence
accttggggctctgacaggt

SEQ ID NO: 19579 - DNA, 20 bp, Artificial
  CRISPR gRNA sequence
gggctctgacaggtaggacc

SEQ ID NO: 19580 - DNA, 20 bp, Artificial
  CRISPR gRNA sequence
ctctgacaggtaggacccag

SEQ ID NO: 19581 - DNA, 20 bp, Artificial
  CRISPR gRNA sequence
tctgacaggtaggacccagc

SEQ ID NO: 19582 - DNA, 20 bp, Artificial
  CRISPR gRNA sequence
ctgacaggtaggacccagca

SEQ ID NO: 19583 - DNA, 20 bp, Artificial
  CRISPR gRNA sequence
aggtaggacccagcagggcg

SEQ ID NO: 19584 - DNA, 20 bp, Artificial
  CRISPR gRNA sequence
gtaggacccagcagggcgtg

SEQ ID NO: 19585 - DNA, 20 bp, Artificial
  CRISPR gRNA sequence
gacccagcagggcgtggagc

SEQ ID NO: 19586 - DNA, 20 bp, Artificial
  CRISPR gRNA sequence
acccagcagggcgtggagcc

SEQ ID NO: 19587 - DNA, 20 bp, Artificial
  CRISPR gRNA sequence
gagccaggcaacgcattgtg

SEQ ID NO: 19588 - DNA, 20 bp, Artificial
  CRISPR gRNA sequence
agccaggcaacgcattgtgt

SEQ ID NO: 19589 - DNA, 20 bp, Artificial
  CRISPR gRNA sequence
aacgcattgtgtaggaatcc

SEQ ID NO: 19590 - DNA, 20 bp, Artificial
  CRISPR gRNA sequence
cattgtgtaggaatcccagc

SEQ ID NO: 19591 - DNA, 20 bp, Artificial
  CRISPR gRNA sequence
attgtgtaggaatcccagcc

SEQ ID NO: 19592 - DNA, 20 bp, Artificial
  CRISPR gRNA sequence
gtgtaggaatcccagccagg

SEQ ID NO: 19593 - DNA, 20 bp, Artificial
  CRISPR gRNA sequence
taggaatcccagccaggcag

SEQ ID NO: 19594 - DNA, 20 bp, Artificial
  CRISPR gRNA sequence
cccagccaggcagcagctcc

SEQ ID NO: 19595 - DNA, 20 bp, Artificial
  CRISPR gRNA sequence
cagccaggcagcagctcccg

SEQ ID NO: 19596 - DNA, 20 bp, Artificial
  CRISPR gRNA sequence
aggcagcagctcccggagtc

SEQ ID NO: 19597 - DNA, 20 bp, Artificial
  CRISPR gRNA sequence
cagcagctcccggagtctgg

SEQ ID NO: 19598 - DNA, 20 bp, Artificial
  CRISPR gRNA sequence
gcagcccctcctcgtgccct

SEQ ID NO: 19599 - DNA, 20 bp, Artificial
  CRISPR gRNA sequence
ctcgtgccctcagcttcccc

SEQ ID NO: 19600 - DNA, 20 bp, Artificial
  CRISPR gRNA sequence
tcgtgccctcagcttcccca

SEQ ID NO: 19601 - DNA, 20 bp, Artificial
  CRISPR gRNA sequence
agcttccccaaggatgcctt

SEQ ID NO: 19602 - DNA, 20 bp, Artificial
  CRISPR gRNA sequence
caaggatgccttcggatgcc

SEQ ID NO: 19603 - DNA, 20 bp, Artificial
  CRISPR gRNA sequence
atgccttcggatgcccagct

SEQ ID NO: 19604 - DNA, 20 bp, Artificial
  CRISPR gRNA sequence
ccttcggatgcccagctcag

SEQ ID NO: 19605 - DNA, 20 bp, Artificial
  CRISPR gRNA sequence
tccgggagctgctgcctggc

SEQ ID NO: 19606 - DNA, 20 bp, Artificial
  CRISPR gRNA sequence
ttgcctggctccacgccctg

SEQ ID NO: 19607 - DNA, 20 bp, Artificial
  CRISPR gRNA sequence
agataaacagagaaaccatt

SEQ ID NO: 19608 - DNA, 20 bp, Artificial
  CRISPR gRNA sequence
cagagaaaccattctgaatt

SEQ ID NO: 19609 - DNA, 20 bp, Artificial
  CRISPR gRNA sequence
aaccattctgaattggggat

SEQ ID NO: 19610 - DNA, 20 bp, Artificial
  CRISPR gRNA sequence
tctgaattggggatgggggt

SEQ ID NO: 19611 - DNA, 20 bp, Artificial
  CRISPR gRNA sequence
atgggggtgaggatgggaac

SEQ ID NO: 19612 - DNA, 20 bp, Artificial
  CRISPR gRNA sequence
caggccattggaagatgtga

SEQ ID NO: 19613 - DNA, 20 bp, Artificial
  CRISPR gRNA sequence
cttcaggtcagccaggtgtc

SEQ ID NO: 19614 - DNA, 20 bp, Artificial
  CRISPR gRNA sequence
caaggtcttctcgcctccct

SEQ ID NO: 19615 - DNA, 20 bp, Artificial
  CRISPR gRNA sequence
ctccctttgggtaaatactg

SEQ ID NO: 19616 - DNA, 20 bp, Artificial
  CRISPR gRNA sequence
agaagcagggaaaccaaaat

SEQ ID NO: 19617 - DNA, 20 bp, Artificial
  CRISPR gRNA sequence
tcagcagctggggagagctg

SEQ ID NO: 19618 - DNA, 20 bp, Artificial
  CRISPR gRNA sequence
tcctaatggtgttgtttaaa

SEQ ID NO: 19619 - DNA, 20 bp, Artificial
  CRISPR gRNA sequence
cagctacaccgttggctggg

SEQ ID NO: 19620 - DNA, 20 bp, Artificial
  CRISPR gRNA sequence
tgaagaagtcgtttacattc

SEQ ID NO: 19621 - DNA, 20 bp, Artificial
  CRISPR gRNA sequence
cattctcgagtcaattttcc

SEQ ID NO: 19622 - DNA, 20 bp, Artificial
  CRISPR gRNA sequence
ctgtgggaaagcctgtatga

SEQ ID NO: 19623 - DNA, 20 bp, Artificial
  CRISPR gRNA sequence
gtccaatattttataggaac

SEQ ID NO: 19624 - DNA, 20 bp, Artificial
  CRISPR gRNA sequence
ttttattggcattgctgttg

SEQ ID NO: 19625 - DNA, 20 bp, Artificial
  CRISPR gRNA sequence
tgctgttgttggatggttaa

SEQ ID NO: 19626 - DNA, 20 bp, Artificial
  CRISPR gRNA sequence
tgacaggtctgccggtgtgg

SEQ ID NO: 19627 - DNA, 20 bp, Artificial
  CRISPR gRNA sequence
catgccttggaggacccagc

SEQ ID NO: 19628 - DNA, 20 bp, Artificial
  CRISPR gRNA sequence
gcagggctcttgccacggct

SEQ ID NO: 19629 - DNA, 20 bp, Artificial
  CRISPR gRNA sequence
ccatccatggaaggtacctg

SEQ ID NO: 19630 - DNA, 20 bp, Artificial
  CRISPR gRNA sequence
ctccctagggccagcatcag

SEQ ID NO: 19631 - DNA, 20 bp, Artificial
  CRISPR gRNA sequence
ctagggccagcatcagagga

SEQ ID NO: 19632 - DNA, 20 bp, Artificial
  CRISPR gRNA sequence
ttgccactttcacggttgga

SEQ ID NO: 19633 - DNA, 20 bp, Artificial
  CRISPR gRNA sequence
agagaaacagagacccaccc

SEQ ID NO: 19634 - DNA, 20 bp, Artificial
  CRISPR gRNA sequence
cgactggaggcagggacctc

SEQ ID NO: 19635 - DNA, 20 bp, Artificial
  CRISPR gRNA sequence
tcttggatgccccaggcagt

SEQ ID NO: 19636 - DNA, 20 bp, Artificial
  CRISPR gRNA sequence
actgcggggaggcggggagg

SEQ ID NO: 19637 - DNA, 20 bp, Artificial
  CRISPR gRNA sequence
gtaacccctaaggtcgggct

SEQ ID NO: 19638 - DNA, 20 bp, Artificial
  CRISPR gRNA sequence
aggtcacacagcaagtctgg

SEQ ID NO: 19639 - DNA, 20 bp, Artificial
  CRISPR gRNA sequence
cagcaagtctgggaggatgg

SEQ ID NO: 19640 - DNA, 20 bp, Artificial
  CRISPR gRNA sequence
agtctgggaggatgggggga

SEQ ID NO: 19641 - DNA, 20 bp, Artificial
  CRISPR gRNA sequence
ccagagctccggggccgtgg

SEQ ID NO: 19642 - DNA, 20 bp, Artificial
  CRISPR gRNA sequence
cttggccgactccgcgcgcc

SEQ ID NO: 19643 - DNA, 20 bp, Artificial
  CRISPR gRNA sequence
cctgagcttcactttccctg

SEQ ID NO: 19644 - DNA, 20 bp, Artificial
  CRISPR gRNA sequence
tcatattccatctctaactc

SEQ ID NO: 19645 - DNA, 20 bp, Artificial
  CRISPR gRNA sequence
ccatctctaactctggaatc

SEQ ID NO: 19646 - DNA, 20 bp, Artificial
  CRISPR gRNA sequence
gggagccaaacctttaacca

SEQ ID NO: 19647 - DNA, 20 bp, Artificial
  CRISPR gRNA sequence
ccaaacctttaaccagagga

SEQ ID NO: 19648 - DNA, 20 bp, Artificial
  CRISPR gRNA sequence
cgaaggtgtgtgttgttggg

SEQ ID NO: 19649 - DNA, 20 bp, Artificial
  CRISPR gRNA sequence
gttgttgggaggggtggggg

SEQ ID NO: 19650 - DNA, 20 bp, Artificial
  CRISPR gRNA sequence
ctctacctcgctttggggcc

SEQ ID NO: 19651 - DNA, 20 bp, Artificial
  CRISPR gRNA sequence
gcgccccggaaagccagcgt

SEQ ID NO: 19652 - DNA, 20 bp, Artificial
  CRISPR gRNA sequence
gaaagccagcgtgcgaatgc

SEQ ID NO: 19653 - DNA, 20 bp, Artificial
  CRISPR gRNA sequence
cagcgtgcgaatgccggggt

SEQ ID NO: 19654 - DNA, 20 bp, Artificial
  CRISPR gRNA sequence
gccggggtgggagtgggaga

SEQ ID NO: 19655 - DNA, 20 bp, Artificial
  CRISPR gRNA sequence
agtgggagattggatctccc

SEQ ID NO: 19656 - DNA, 20 bp, Artificial
  CRISPR gRNA sequence
tccctggggtccaggaaagc

SEQ ID NO: 19657 - DNA, 20 bp, Artificial
  CRISPR gRNA sequence
tcttaaaagccgcggtcctc

SEQ ID NO: 19658 - DNA, 20 bp, Artificial
  CRISPR gRNA sequence
ctccctccccagccgcagcc

SEQ ID NO: 19659 - DNA, 20 bp, Artificial
  CRISPR gRNA sequence
aaaataaataaatacttctc

SEQ ID NO: 19660 - DNA, 20 bp, Artificial
  CRISPR gRNA sequence
gcaaacccccggctccctta

SEQ ID NO: 19661 - DNA, 20 bp, Artificial
  CRISPR gRNA sequence
aatctcagagcgtttggagg

SEQ ID NO: 19662 - DNA, 20 bp, Artificial
  CRISPR gRNA sequence
ggcagggtctttggagatga

SEQ ID NO: 19663 - DNA, 20 bp, Artificial
  CRISPR gRNA sequence
tctttggagatgactgagtg

SEQ ID NO: 19664 - DNA, 20 bp, Artificial
  CRISPR gRNA sequence
ccccacacatgaacatcacc

SEQ ID NO: 19665 - DNA, 20 bp, Artificial
  CRISPR gRNA sequence
cctgggatgatcaacctgtt

SEQ ID NO: 19666 - DNA, 20 bp, Artificial
  CRISPR gRNA sequence
caggcccggttggctaggcc

SEQ ID NO: 19667 - DNA, 20 bp, Artificial
  CRISPR gRNA sequence
tacaaaacctctatcagaaa

SEQ ID NO: 19668 - DNA, 20 bp, Artificial
  CRISPR gRNA sequence
tagcaagcagtttgcagacg

SEQ ID NO: 19669 - DNA, 20 bp, Artificial
  CRISPR gRNA sequence
ctcagataccttgagaagag

SEQ ID NO: 19670 - DNA, 20 bp, Artificial
  CRISPR gRNA sequence
gaaattaacccaaggaaact

SEQ ID NO: 19671 - DNA, 20 bp, Artificial
  CRISPR gRNA sequence
gacttagcctcagatttgcc

SEQ ID NO: 19672 - DNA, 20 bp, Artificial
  CRISPR gRNA sequence
ctctgaggttcatctgtaaa

SEQ ID NO: 19673 - DNA, 20 bp, Artificial
  CRISPR gRNA sequence
agcactttagaaaaccacca

SEQ ID NO: 19674 - DNA, 20 bp, Artificial
  CRISPR gRNA sequence
ccaaagaatattcatgcatt

SEQ ID NO: 19675 - DNA, 20 bp, Artificial
  CRISPR gRNA sequence
ataattattatagatcctaa

SEQ ID NO: 19676 - DNA, 20 bp, Artificial
  CRISPR gRNA sequence
tagcactttgggaggccgag

SEQ ID NO: 19677 - DNA, 20 bp, Artificial
  CRISPR gRNA sequence
actttgggaggccgaggcgg

SEQ ID NO: 19678 - DNA, 20 bp, Artificial
  CRISPR gRNA sequence
cgggtggattgcttgaggcc

SEQ ID NO: 19679 - DNA, 20 bp, Artificial
  CRISPR gRNA sequence
tacttgggaggctgaggcac

SEQ ID NO: 19680 - DNA, 20 bp, Artificial
  CRISPR gRNA sequence
aatcacttgaacccaagagg

SEQ ID NO: 19681 - DNA, 20 bp, Artificial
  CRISPR gRNA sequence
ctctagacaccgcctataaa

SEQ ID NO: 19682 - DNA, 20 bp, Artificial
  CRISPR gRNA sequence
tgtgtaattcctttctatgg

SEQ ID NO: 19683 - DNA, 20 bp, Artificial
  CRISPR gRNA sequence
gcggaatagtattctaatat

SEQ ID NO: 19684 - DNA, 20 bp, Artificial
  CRISPR gRNA sequence
attcatttgttgatagacac

SEQ ID NO: 19685 - DNA, 20 bp, Artificial
  CRISPR gRNA sequence
gttcctacctcttgactatt

SEQ ID NO: 19686 - DNA, 20 bp, Artificial
  CRISPR gRNA sequence
tgaataatcttgctaggtac

SEQ ID NO: 19687 - DNA, 20 bp, Artificial
  CRISPR gRNA sequence
aaaaattgtaaagatggaag

SEQ ID NO: 19688 - DNA, 20 bp, Artificial
  CRISPR gRNA sequence
aatgcctgcagtttgggaaa

SEQ ID NO: 19689 - DNA, 20 bp, Artificial
  CRISPR gRNA sequence
gctattgtaaaatctatgct

SEQ ID NO: 19690 - DNA, 20 bp, Artificial
  CRISPR gRNA sequence
acttcaggaaggaaagatat

SEQ ID NO: 19691 - DNA, 20 bp, Artificial
  CRISPR gRNA sequence
atcaccttgggaggtcaagg

SEQ ID NO: 19692 - DNA, 20 bp, Artificial
  CRISPR gRNA sequence
caggatgatggcttgagacc

SEQ ID NO: 19693 - DNA, 20 bp, Artificial
  CRISPR gRNA sequence
actttgggaggctgaggccg

SEQ ID NO: 19694 - DNA, 20 bp, Artificial
  CRISPR gRNA sequence
gctgaggccggtggatcacc

SEQ ID NO: 19695 - DNA, 20 bp, Artificial
  CRISPR gRNA sequence
ccggtggatcacctgggatc

SEQ ID NO: 19696 - DNA, 20 bp, Artificial
  CRISPR gRNA sequence
tcctaaaaatacaaaattag

SEQ ID NO: 19697 - DNA, 20 bp, Artificial
  CRISPR gRNA sequence
tactcggtaggctggtggag

SEQ ID NO: 19698 - DNA, 20 bp, Artificial
  CRISPR gRNA sequence
tgcactccagcctgggcaac

SEQ ID NO: 19699 - DNA, 20 bp, Artificial
  CRISPR gRNA sequence
tgggcccggctgcagactcc

SEQ ID NO: 19700 - DNA, 20 bp, Artificial
  CRISPR gRNA sequence
ccggctgcagactccctgaa

SEQ ID NO: 19701 - DNA, 20 bp, Artificial
  CRISPR gRNA sequence
actccctgaatagaatcact

SEQ ID NO: 19702 - DNA, 20 bp, Artificial
  CRISPR gRNA sequence
gactggctcgtggttcatct

SEQ ID NO: 19703 - DNA, 20 bp, Artificial
  CRISPR gRNA sequence
ttggggtctccagcacccag

SEQ ID NO: 19704 - DNA, 20 bp, Artificial
  CRISPR gRNA sequence
ggggactgtgttaagtagag

SEQ ID NO: 19705 - DNA, 20 bp, Artificial
  CRISPR gRNA sequence
actgtgttaagtagagccgg

SEQ ID NO: 19706 - DNA, 20 bp, Artificial
  CRISPR gRNA sequence
agagccggatgggtcaggac

SEQ ID NO: 19707 - DNA, 20 bp, Artificial
  CRISPR gRNA sequence
tccaccccctaccccagcac

SEQ ID NO: 19708 - DNA, 20 bp, Artificial
  CRISPR gRNA sequence
ccaggtcattgactgcagtt

SEQ ID NO: 19709 - DNA, 20 bp, Artificial
  CRISPR gRNA sequence
agctggagatgatggcccat

SEQ ID NO: 19710 - DNA, 20 bp, Artificial
  CRISPR gRNA sequence
ggcatctgtggtgtcttttg

SEQ ID NO: 19711 - DNA, 20 bp, Artificial
  CRISPR gRNA sequence
gtgtcttttgtggggtcctg

SEQ ID NO: 19712 - DNA, 20 bp, Artificial
  CRISPR gRNA sequence
cgaaggaaaagggaagaaag

SEQ ID NO: 19713 - DNA, 20 bp, Artificial
  CRISPR gRNA sequence
aagcagggttgggaagcagc

SEQ ID NO: 19714 - DNA, 20 bp, Artificial
  CRISPR gRNA sequence
ggtccatggtttgtttacat

SEQ ID NO: 19715 - DNA, 20 bp, Artificial
  CRISPR gRNA sequence
ctcttggtgttgtacattct

SEQ ID NO: 19716 - DNA, 20 bp, Artificial
  CRISPR gRNA sequence
tgctgagaagccctttggct

SEQ ID NO: 19717 - DNA, 20 bp, Artificial
  CRISPR gRNA sequence
ggaaatccattcaacggtgc

SEQ ID NO: 19718 - DNA, 20 bp, Artificial
  CRISPR gRNA sequence
ccattcaacggtgctggaat

SEQ ID NO: 19719 - DNA, 20 bp, Artificial
  CRISPR gRNA sequence
tctcactctgttgcccaggt

SEQ ID NO: 19720 - DNA, 20 bp, Artificial
  CRISPR gRNA sequence
atcttttatttctgaagaga

SEQ ID NO: 19721 - DNA, 20 bp, Artificial
  CRISPR gRNA sequence
tcctcagcctcccaaagtgc

SEQ ID NO: 19722 - DNA, 20 bp, Artificial
  CRISPR gRNA sequence
tctgtgtggaactggcctgt

SEQ ID NO: 19723 - DNA, 20 bp, Artificial
  CRISPR gRNA sequence
cattgcaggacaggacataa

SEQ ID NO: 19724 - DNA, 20 bp, Artificial
  CRISPR gRNA sequence
cctgcaagggcctccaagcc

SEQ ID NO: 19725 - DNA, 20 bp, Artificial
  CRISPR gRNA sequence
tgtccaggcagaaggcaata

SEQ ID NO: 19726 - DNA, 20 bp, Artificial
  CRISPR gRNA sequence
aaaacaaataggcctatcga

SEQ ID NO: 19727 - DNA, 20 bp, Artificial
  CRISPR gRNA sequence
aggagcttgcaggtcagaaa

SEQ ID NO: 19728 - DNA, 20 bp, Artificial
  CRISPR gRNA sequence
cactccaggaagtgaaagtc

SEQ ID NO: 19729 - DNA, 20 bp, Artificial
  CRISPR gRNA sequence
ctctctctgtctcgttctcc

SEQ ID NO: 19730 - DNA, 20 bp, Artificial
  CRISPR gRNA sequence
ggtttgcaaacagcaggctg

SEQ ID NO: 19731 - DNA, 20 bp, Artificial
  CRISPR gRNA sequence
agccatcaccagacagcctg

SEQ ID NO: 19732 - DNA, 20 bp, Artificial
  CRISPR gRNA sequence
agaggtaccaacctcacccc

SEQ ID NO: 19733 - DNA, 20 bp, Artificial
  CRISPR gRNA sequence
ctatgatctttggttcacat

SEQ ID NO: 19734 - DNA, 20 bp, Artificial
  CRISPR gRNA sequence
taatgtccctatttcccata

SEQ ID NO: 19735 - DNA, 20 bp, Artificial
  CRISPR gRNA sequence
cttttttttttttttttaga

SEQ ID NO: 19736 - DNA, 20 bp, Artificial
  CRISPR gRNA sequence
gtctcactctgtcacccagg

SEQ ID NO: 19737 - DNA, 20 bp, Artificial
  CRISPR gRNA sequence
ttttctatttttagtagaga

SEQ ID NO: 19738 - DNA, 20 bp, Artificial
  CRISPR gRNA sequence
gcctcggcctcccaaagtgc

SEQ ID NO: 19739 - DNA, 20 bp, Artificial
  CRISPR gRNA sequence
aaagtgctggaattacaggt

SEQ ID NO: 19740 - DNA, 20 bp, Artificial
  CRISPR gRNA sequence
tgcattctgtactatgtttt

SEQ ID NO: 19741 - DNA, 20 bp, Artificial
  CRISPR gRNA sequence
atcacggacattgttctcta

SEQ ID NO: 19742 - DNA, 20 bp, Artificial
  CRISPR gRNA sequence
cattgttctctatggagtgc

SEQ ID NO: 19743 - DNA, 20 bp, Artificial
  CRISPR gRNA sequence
acagcagtaaccatcctcag

SEQ ID NO: 19744 - DNA, 20 bp, Artificial
  CRISPR gRNA sequence
tcctcagatgggttctcctg

SEQ ID NO: 19745 - DNA, 20 bp, Artificial
  CRISPR gRNA sequence
gagttgtgggaacatttctt

SEQ ID NO: 19746 - DNA, 20 bp, Artificial
  CRISPR gRNA sequence
aggatatatagacccaagag

SEQ ID NO: 19747 - DNA, 20 bp, Artificial
  CRISPR gRNA sequence
agagctgaattgccaggtgg

SEQ ID NO: 19748 - DNA, 20 bp, Artificial
  CRISPR gRNA sequence
tcactttgctgttttatttt

SEQ ID NO: 19749 - DNA, 20 bp, Artificial
  CRISPR gRNA sequence
gattctgtgactcagagagg

SEQ ID NO: 19750 - DNA, 20 bp, Artificial
  CRISPR gRNA sequence
tctctctcctaaaatatcat

SEQ ID NO: 19751 - DNA, 20 bp, Artificial
  CRISPR gRNA sequence
tgagctcagtgactttctta

SEQ ID NO: 19752 - DNA, 20 bp, Artificial
  CRISPR gRNA sequence
actttcttacggggtgctca

SEQ ID NO: 19753 - DNA, 20 bp, Artificial
  CRISPR gRNA sequence
gaaaagtgagagatgtttct

SEQ ID NO: 19754 - DNA, 20 bp, Artificial
  CRISPR gRNA sequence
agagtttatctggaggacta

SEQ ID NO: 19755 - DNA, 20 bp, Artificial
  CRISPR gRNA sequence
acccccacaaagaagctgtt

SEQ ID NO: 19756 - DNA, 20 bp, Artificial
  CRISPR gRNA sequence
gagaagactgccaggcaacg

SEQ ID NO: 19757 - DNA, 20 bp, Artificial
  CRISPR gRNA sequence
actgccaggcaacgaggaat

SEQ ID NO: 19758 - DNA, 20 bp, Artificial
  CRISPR gRNA sequence
gagggctaaggtaatgtact

SEQ ID NO: 19759 - DNA, 20 bp, Artificial
  CRISPR gRNA sequence
aggaggagaagttcatggtc

SEQ ID NO: 19760 - DNA, 20 bp, Artificial
  CRISPR gRNA sequence
ttttttttttttgtctgaga

SEQ ID NO: 19761 - DNA, 20 bp, Artificial
  CRISPR gRNA sequence
tcttgctctgtcaccgaggc

SEQ ID NO: 19762 - DNA, 20 bp, Artificial
  CRISPR gRNA sequence
gcctcagcctcccaagtagc

SEQ ID NO: 19763 - DNA, 20 bp, Artificial
  CRISPR gRNA sequence
tttttgtatttttgcagaga

SEQ ID NO: 19764 - DNA, 20 bp, Artificial
  CRISPR gRNA sequence
gcctcggcctctcaaagtgc

SEQ ID NO: 19765 - DNA, 20 bp, Artificial
  CRISPR gRNA sequence
gagcagtgctggaggctttt

SEQ ID NO: 19766 - DNA, 20 bp, Artificial
  CRISPR gRNA sequence
ctataataacaacaatctcc

SEQ ID NO: 19767 - DNA, 20 bp, Artificial
  CRISPR gRNA sequence
gttgccgttaacagttgaaa

SEQ ID NO: 19768 - DNA, 20 bp, Artificial
  CRISPR gRNA sequence
aacttaactcccctaatcct

SEQ ID NO: 19769 - DNA, 20 bp, Artificial
  CRISPR gRNA sequence
attgtagtgcgttggtaggt

SEQ ID NO: 19770 - DNA, 20 bp, Artificial
  CRISPR gRNA sequence
gatcttcagatagtttaagt

SEQ ID NO: 19771 - DNA, 20 bp, Artificial
  CRISPR gRNA sequence
ttccctcgggggagagagag

SEQ ID NO: 19772 - DNA, 20 bp, Artificial
  CRISPR gRNA sequence
tcctgcatgcagtgtgaagt

SEQ ID NO: 19773 - DNA, 20 bp, Artificial
  CRISPR gRNA sequence
cttttgatggcaaaaagatc

SEQ ID NO: 19774 - DNA, 20 bp, Artificial
  CRISPR gRNA sequence
aaaagatcaggaatattttc

SEQ ID NO: 19775 - DNA, 20 bp, Artificial
  CRISPR gRNA sequence
atcaggaatattttctcgag

SEQ ID NO: 19776 - DNA, 20 bp, Artificial
  CRISPR gRNA sequence
ccacccacgccttccctcgc

SEQ ID NO: 19777 - DNA, 20 bp, Artificial
  CRISPR gRNA sequence
acagcaattcaaaaaggcta

SEQ ID NO: 19778 - DNA, 20 bp, Artificial
  CRISPR gRNA sequence
agtgggctgagactttggag

SEQ ID NO: 19779 - DNA, 20 bp, Artificial
  CRISPR gRNA sequence
tgtctcttcatctgaaaaac

SEQ ID NO: 19780 - DNA, 20 bp, Artificial
  CRISPR gRNA sequence
gatgtgtaagttagaccaaa

SEQ ID NO: 19781 - DNA, 20 bp, Artificial
  CRISPR gRNA sequence
gaccaaatggggtaatgcct

SEQ ID NO: 19782 - DNA, 20 bp, Artificial
  CRISPR gRNA sequence
cctggcacttgctggacact

SEQ ID NO: 19783 - DNA, 20 bp, Artificial
  CRISPR gRNA sequence
tctagttctatatcattgcc

SEQ ID NO: 19784 - DNA, 20 bp, Artificial
  CRISPR gRNA sequence
gctgggagaaggtgagctag

SEQ ID NO: 19785 - DNA, 20 bp, Artificial
  CRISPR gRNA sequence
aagggctctctctcctgcca

SEQ ID NO: 19786 - DNA, 20 bp, Artificial
  CRISPR gRNA sequence
gacataggaaacttggctct

SEQ ID NO: 19787 - DNA, 20 bp, Artificial
  CRISPR gRNA sequence
tgtggcgttgtggggaaacc

SEQ ID NO: 19788 - DNA, 20 bp, Artificial
  CRISPR gRNA sequence
ggaaacctagagtcttgggc

SEQ ID NO: 19789 - DNA, 20 bp, Artificial
  CRISPR gRNA sequence
tctcactttgtcgcccaggc

SEQ ID NO: 19790 - DNA, 20 bp, Artificial
  CRISPR gRNA sequence
gcctcagcctcccaagtagc

SEQ ID NO: 19791 - DNA, 20 bp, Artificial
  CRISPR gRNA sequence
ttttgtatttttagtagaga

SEQ ID NO: 19792 - DNA, 20 bp, Artificial
  CRISPR gRNA sequence
cttggctaaggcatcacagc

SEQ ID NO: 19793 - DNA, 20 bp, Artificial
  CRISPR gRNA sequence
ttgggaactcagatggtgtg

SEQ ID NO: 19794 - DNA, 20 bp, Artificial
  CRISPR gRNA sequence
tgtattgggggcttctggga

SEQ ID NO: 19795 - DNA, 20 bp, Artificial
  CRISPR gRNA sequence
tctggctctatcacccaggc

SEQ ID NO: 19796 - DNA, 20 bp, Artificial
  CRISPR gRNA sequence
tatcctcccacctcagcctc

SEQ ID NO: 19797 - DNA, 20 bp, Artificial
  CRISPR gRNA sequence
gccttggactcccaaagtgc

SEQ ID NO: 19798 - DNA, 20 bp, Artificial
  CRISPR gRNA sequence
tcttgttcctatgaagtctg

SEQ ID NO: 19799 - DNA, 20 bp, Artificial
  CRISPR gRNA sequence
ctcggaagaaatggaaggga

SEQ ID NO: 19800 - DNA, 20 bp, Artificial
  CRISPR gRNA sequence
acttaactcccctaatcctt

SEQ ID NO: 19801 - DNA, 20 bp, Artificial
  CRISPR gRNA sequence
gttacagtgtgttggtaggt

SEQ ID NO: 19802 - DNA, 20 bp, Artificial
  CRISPR gRNA sequence
aaccacacagcagtgtcatc

SEQ ID NO: 19803 - DNA, 20 bp, Artificial
  CRISPR gRNA sequence
agcagagctcatcaataagt

SEQ ID NO: 19804 - DNA, 20 bp, Artificial
  CRISPR gRNA sequence
tgcttgagcccagacaggac

SEQ ID NO: 19805 - DNA, 20 bp, Artificial
  CRISPR gRNA sequence
gggggaaagagcaccagcct

SEQ ID NO: 19806 - DNA, 20 bp, Artificial
  CRISPR gRNA sequence
agcctgggagtcttggcagg

SEQ ID NO: 19807 - DNA, 20 bp, Artificial
  CRISPR gRNA sequence
tgtgcaagtcacgtccttcc

SEQ ID NO: 19808 - DNA, 20 bp, Artificial
  CRISPR gRNA sequence
ggtctcagtcttgtcatctg

SEQ ID NO: 19809 - DNA, 20 bp, Artificial
  CRISPR gRNA sequence
cccaatgccctgtgagaaaa

SEQ ID NO: 19810 - DNA, 20 bp, Artificial
  CRISPR gRNA sequence
gccctgtgagaaaactgagt

SEQ ID NO: 19811 - DNA, 20 bp, Artificial
  CRISPR gRNA sequence
aacttattattttatagata

SEQ ID NO: 19812 - DNA, 20 bp, Artificial
  CRISPR gRNA sequence
ttatagaaatgttatagata

SEQ ID NO: 19813 - DNA, 20 bp, Artificial
  CRISPR gRNA sequence
aaagtcacacaactcattca

SEQ ID NO: 19814 - DNA, 20 bp, Artificial
  CRISPR gRNA sequence
caactcattcacggagttgc

SEQ ID NO: 19815 - DNA, 20 bp, Artificial
  CRISPR gRNA sequence
gtaggttcttaataaagagc

SEQ ID NO: 19816 - DNA, 20 bp, Artificial
  CRISPR gRNA sequence
ttcttaataaagagcatggg

SEQ ID NO: 19817 - DNA, 20 bp, Artificial
  CRISPR gRNA sequence
ttcctctagtcatggttggc

SEQ ID NO: 19818 - DNA, 20 bp, Artificial
  CRISPR gRNA sequence
tcgctgcaagccggttatgt

SEQ ID NO: 19819 - DNA, 20 bp, Artificial
  CRISPR gRNA sequence
gatcattctctgtgacatcc

SEQ ID NO: 19820 - DNA, 20 bp, Artificial
  CRISPR gRNA sequence
ctccccaggcagtgaaagct

SEQ ID NO: 19821 - DNA, 20 bp, Artificial
  CRISPR gRNA sequence
ctgtggatgcgtgaaagaaa

SEQ ID NO: 19822 - DNA, 20 bp, Artificial
  CRISPR gRNA sequence
aaagaaaatgggtctctggg

SEQ ID NO: 19823 - DNA, 20 bp, Artificial
  CRISPR gRNA sequence
cagcactttgggaggccaag

SEQ ID NO: 19824 - DNA, 20 bp, Artificial
  CRISPR gRNA sequence
actttgggaggccaaggcgg

SEQ ID NO: 19825 - DNA, 20 bp, Artificial
  CRISPR gRNA sequence
cgggtggatcacctgaggtc

SEQ ID NO: 19826 - DNA, 20 bp, Artificial
  CRISPR gRNA sequence
aaaattagccaggcatggtg

SEQ ID NO: 19827 - DNA, 20 bp, Artificial
  CRISPR gRNA sequence
tacttgggaggttgaagcag

SEQ ID NO: 19828 - DNA, 20 bp, Artificial
  CRISPR gRNA sequence
ggttgaagcaggagaattgc

SEQ ID NO: 19829 - DNA, 20 bp, Artificial
  CRISPR gRNA sequence
ctgcactccagcctgggcga

SEQ ID NO: 19830 - DNA, 20 bp, Artificial
  CRISPR gRNA sequence
aaaaaaaaaagaaaaagaaa

SEQ ID NO: 19831 - DNA, 20 bp, Artificial
  CRISPR gRNA sequence
agaaaaagaaaatgagtctc

SEQ ID NO: 19832 - DNA, 20 bp, Artificial
  CRISPR gRNA sequence
aagaaaatgagtctcaggaa

SEQ ID NO: 19833 - DNA, 20 bp, Artificial
  CRISPR gRNA sequence
ctcaggaatggggtggcaag

SEQ ID NO: 19834 - DNA, 20 bp, Artificial
  CRISPR gRNA sequence
tcatctgcatgtcatgtgtg

SEQ ID NO: 19835 - DNA, 20 bp, Artificial
  CRISPR gRNA sequence
agtgtgactttatttgggaa

SEQ ID NO: 19836 - DNA, 20 bp, Artificial
  CRISPR gRNA sequence
gggaaaagggtctttgcaga

SEQ ID NO: 19837 - DNA, 20 bp, Artificial
  CRISPR gRNA sequence
gatagaattaagttaagggg

SEQ ID NO: 19838 - DNA, 20 bp, Artificial
  CRISPR gRNA sequence
actttgggaagctgagattg

SEQ ID NO: 19839 - DNA, 20 bp, Artificial
  CRISPR gRNA sequence
ttggaggatcacctgaggtc

SEQ ID NO: 19840 - DNA, 20 bp, Artificial
  CRISPR gRNA sequence
tactcaggagactggggcag

SEQ ID NO: 19841 - DNA, 20 bp, Artificial
  CRISPR gRNA sequence
gtctcaaaagaaggcaaaaa

SEQ ID NO: 19842 - DNA, 20 bp, Artificial
  CRISPR gRNA sequence
gatcttgaaatgacatcatc

SEQ ID NO: 19843 - DNA, 20 bp, Artificial
  CRISPR gRNA sequence
catcatcctggattatctag

SEQ ID NO: 19844 - DNA, 20 bp, Artificial
  CRISPR gRNA sequence
agaaagagacttgctacatg

SEQ ID NO: 19845 - DNA, 20 bp, Artificial
  CRISPR gRNA sequence
aggtgatgtggccactaaag

SEQ ID NO: 19846 - DNA, 20 bp, Artificial
  CRISPR gRNA sequence
gtggccactaaagctgagtt

SEQ ID NO: 19847 - DNA, 20 bp, Artificial
  CRISPR gRNA sequence
cagccacaagaccacaagtc

SEQ ID NO: 19848 - DNA, 20 bp, Artificial
  CRISPR gRNA sequence
tctggcctccagaaccatga

SEQ ID NO: 19849 - DNA, 20 bp, Artificial
  CRISPR gRNA sequence
gtgctgttgttctgagctac

SEQ ID NO: 19850 - DNA, 20 bp, Artificial
  CRISPR gRNA sequence
tgtttcagcagccctgggaa

SEQ ID NO: 19851 - DNA, 20 bp, Artificial
  CRISPR gRNA sequence
tggaaacatggacctgaacc

SEQ ID NO: 19852 - DNA, 20 bp, Artificial
  CRISPR gRNA sequence
gaggaagctgcttgtcttct

SEQ ID NO: 19853 - DNA, 20 bp, Artificial
  CRISPR gRNA sequence
ttgggaggccgaggagacag

SEQ ID NO: 19854 - DNA, 20 bp, Artificial
  CRISPR gRNA sequence
caggcggatcacttgaggtc

SEQ ID NO: 19855 - DNA, 20 bp, Artificial
  CRISPR gRNA sequence
actaaaaatgcaaaaattag

SEQ ID NO: 19856 - DNA, 20 bp, Artificial
  CRISPR gRNA sequence
aaaattagccgggtgtggtg

SEQ ID NO: 19857 - DNA, 20 bp, Artificial
  CRISPR gRNA sequence
tgctcaggaggctgaggcag

SEQ ID NO: 19858 - DNA, 20 bp, Artificial
  CRISPR gRNA sequence
ttgcacccctgcactccagc

SEQ ID NO: 19859 - DNA, 20 bp, Artificial
  CRISPR gRNA sequence
aaaaaaaaaaaaaaaaaaag

SEQ ID NO: 19860 - DNA, 20 bp, Artificial
  CRISPR gRNA sequence
gtagagttcagtgttctttt

SEQ ID NO: 19861 - DNA, 20 bp, Artificial
  CRISPR gRNA sequence
tgttcttttgggaatactca

SEQ ID NO: 19862 - DNA, 20 bp, Artificial
  CRISPR gRNA sequence
gtctcagcctcccaaagtgc

SEQ ID NO: 19863 - DNA, 20 bp, Artificial
  CRISPR gRNA sequence
ccctcctactttatgtctcc

SEQ ID NO: 19864 - DNA, 20 bp, Artificial
  CRISPR gRNA sequence
ttttggtcatttcaaataaa

SEQ ID NO: 19865 - DNA, 20 bp, Artificial
  CRISPR gRNA sequence
gtgctttctccctttaatgg

SEQ ID NO: 19866 - DNA, 20 bp, Artificial
  CRISPR gRNA sequence
gtttatccatttattttttg

SEQ ID NO: 19867 - DNA, 20 bp, Artificial
  CRISPR gRNA sequence
gtttttatattttggctatt

SEQ ID NO: 19868 - DNA, 20 bp, Artificial
  CRISPR gRNA sequence
attcgtgtataggtttttgt

SEQ ID NO: 19869 - DNA, 20 bp, Artificial
  CRISPR gRNA sequence
cataatatgatacatattta

SEQ ID NO: 19870 - DNA, 20 bp, Artificial
  CRISPR gRNA sequence
tacatatttatggggtatat

SEQ ID NO: 19871 - DNA, 20 bp, Artificial
  CRISPR gRNA sequence
agaaggtataatgatcatgt

SEQ ID NO: 19872 - DNA, 20 bp, Artificial
  CRISPR gRNA sequence
atatttgaggtatccacatt

SEQ ID NO: 19873 - DNA, 20 bp, Artificial
  CRISPR gRNA sequence
aacaaatgatgaggaaatct

SEQ ID NO: 19874 - DNA, 20 bp, Artificial
  CRISPR gRNA sequence
caggacttcagtcagactgt

SEQ ID NO: 19875 - DNA, 20 bp, Artificial
  CRISPR gRNA sequence
aatcctggttccacttggac

SEQ ID NO: 19876 - DNA, 20 bp, Artificial
  CRISPR gRNA sequence
agttttctcatatgcaaagt

SEQ ID NO: 19877 - DNA, 20 bp, Artificial
  CRISPR gRNA sequence
ttccttacatggttactgat

SEQ ID NO: 19878 - DNA, 20 bp, Artificial
  CRISPR gRNA sequence
atggcattgccaaatgtggg

SEQ ID NO: 19879 - DNA, 20 bp, Artificial
  CRISPR gRNA sequence
actctctggtgtgagattga

SEQ ID NO: 19880 - DNA, 20 bp, Artificial
  CRISPR gRNA sequence
ccagttcccttttctacctc

SEQ ID NO: 19881 - DNA, 20 bp, Artificial
  CRISPR gRNA sequence
ttgtaagttccttggaggaa

SEQ ID NO: 19882 - DNA, 20 bp, Artificial
  CRISPR gRNA sequence
cgctgagcatataagaggtg

SEQ ID NO: 19883 - DNA, 20 bp, Artificial
  CRISPR gRNA sequence
atccccagccctcaccagct

SEQ ID NO: 19884 - DNA, 20 bp, Artificial
  CRISPR gRNA sequence
cagctcacagtgtgccacca

SEQ ID NO: 19885 - DNA, 20 bp, Artificial
  CRISPR gRNA sequence
gtgggacgctctctgcagat

SEQ ID NO: 19886 - DNA, 20 bp, Artificial
  CRISPR gRNA sequence
agaaaaggacaatcaagggc

SEQ ID NO: 19887 - DNA, 20 bp, Artificial
  CRISPR gRNA sequence
cccacagaaatcattgcaag

SEQ ID NO: 19888 - DNA, 20 bp, Artificial
  CRISPR gRNA sequence
tttgtaataactagcattta

SEQ ID NO: 19889 - DNA, 20 bp, Artificial
  CRISPR gRNA sequence
gctgtccatacattatcatc

SEQ ID NO: 19890 - DNA, 20 bp, Artificial
  CRISPR gRNA sequence
ccacaaaaaaagaaagtgtc

SEQ ID NO: 19891 - DNA, 20 bp, Artificial
  CRISPR gRNA sequence
tgttttttgggggagagacg

SEQ ID NO: 19892 - DNA, 20 bp, Artificial
  CRISPR gRNA sequence
tgggggagagacgtgggata

SEQ ID NO: 19893 - DNA, 20 bp, Artificial
  CRISPR gRNA sequence
aaaaaagtggcctttttctg

SEQ ID NO: 19894 - DNA, 20 bp, Artificial
  CRISPR gRNA sequence
ttggctagcaaagtgcaagc

SEQ ID NO: 19895 - DNA, 20 bp, Artificial
  CRISPR gRNA sequence
gactgcttccttcccttcct

SEQ ID NO: 19896 - DNA, 20 bp, Artificial
  CRISPR gRNA sequence
cacaactggaggcagtcatt

SEQ ID NO: 19897 - DNA, 20 bp, Artificial
  CRISPR gRNA sequence
ttaaggatttgggcatgtca

SEQ ID NO: 19898 - DNA, 20 bp, Artificial
  CRISPR gRNA sequence
atttgggcatgtcataggat

SEQ ID NO: 19899 - DNA, 20 bp, Artificial
  CRISPR gRNA sequence
ttaaaacaacatacctgaca

SEQ ID NO: 19900 - DNA, 20 bp, Artificial
  CRISPR gRNA sequence
ttactggtgaggactctctg

SEQ ID NO: 19901 - DNA, 20 bp, Artificial
  CRISPR gRNA sequence
gtttatccactaatccatga

SEQ ID NO: 19902 - DNA, 20 bp, Artificial
  CRISPR gRNA sequence
cctctcaatactgccacata

SEQ ID NO: 19903 - DNA, 20 bp, Artificial
  CRISPR gRNA sequence
ataggggattacatttatac

SEQ ID NO: 19904 - DNA, 20 bp, Artificial
  CRISPR gRNA sequence
caagtctgctcctcaagtct

SEQ ID NO: 19905 - DNA, 20 bp, Artificial
  CRISPR gRNA sequence
aataatcacacccaccatca

SEQ ID NO: 19906 - DNA, 20 bp, Artificial
  CRISPR gRNA sequence
atcacgggatggttgtaaga

SEQ ID NO: 19907 - DNA, 20 bp, Artificial
  CRISPR gRNA sequence
atgtgtaaagcatttagaaa

SEQ ID NO: 19908 - DNA, 20 bp, Artificial
  CRISPR gRNA sequence
atttagaaaaggaatttgca

SEQ ID NO: 19909 - DNA, 20 bp, Artificial
  CRISPR gRNA sequence
taccaccgtcacctatctct

SEQ ID NO: 19910 - DNA, 20 bp, Artificial
  CRISPR gRNA sequence
catctttcaaggcctggttc

SEQ ID NO: 19911 - DNA, 20 bp, Artificial
  CRISPR gRNA sequence
tatatagttaccactattta

SEQ ID NO: 19912 - DNA, 20 bp, Artificial
  CRISPR gRNA sequence
actgtataccagctactgtg

SEQ ID NO: 19913 - DNA, 20 bp, Artificial
  CRISPR gRNA sequence
ctaattatcaccatcgattc

SEQ ID NO: 19914 - DNA, 20 bp, Artificial
  CRISPR gRNA sequence
gggctagtggaaagtagagg

SEQ ID NO: 19915 - DNA, 20 bp, Artificial
  CRISPR gRNA sequence
gtagcagtagataagttttc

SEQ ID NO: 19916 - DNA, 20 bp, Artificial
  CRISPR gRNA sequence
ttgattagattaagggcccc

SEQ ID NO: 19917 - DNA, 20 bp, Artificial
  CRISPR gRNA sequence
attcattcaacaaacatttc

SEQ ID NO: 19918 - DNA, 20 bp, Artificial
  CRISPR gRNA sequence
acattttcagtaagtttgtg

SEQ ID NO: 19919 - DNA, 20 bp, Artificial
  CRISPR gRNA sequence
atttcctgccttgttccctg

SEQ ID NO: 19920 - DNA, 20 bp, Artificial
  CRISPR gRNA sequence
gtcagacccctctccccaag

SEQ ID NO: 19921 - DNA, 20 bp, Artificial
  CRISPR gRNA sequence
cttgggctttcattgattgt

SEQ ID NO: 19922 - DNA, 20 bp, Artificial
  CRISPR gRNA sequence
gaccagatgaagtgatcggt

SEQ ID NO: 19923 - DNA, 20 bp, Artificial
  CRISPR gRNA sequence
gcagaaaagtcagaaaagac

SEQ ID NO: 19924 - DNA, 20 bp, Artificial
  CRISPR gRNA sequence
ccttgactccaaagcctgct

SEQ ID NO: 19925 - DNA, 20 bp, Artificial
  CRISPR gRNA sequence
cagttgctatagtctctatc

SEQ ID NO: 19926 - DNA, 20 bp, Artificial
  CRISPR gRNA sequence
tcttcccatggctgactcct

SEQ ID NO: 19927 - DNA, 20 bp, Artificial
  CRISPR gRNA sequence
agcacctcagtagatatctg

SEQ ID NO: 19928 - DNA, 20 bp, Artificial
  CRISPR gRNA sequence
tgaatgaaaacatctgtaaa

SEQ ID NO: 19929 - DNA, 20 bp, Artificial
  CRISPR gRNA sequence
aaaatgggtgtaacagttaa

SEQ ID NO: 19930 - DNA, 20 bp, Artificial
  CRISPR gRNA sequence
cagttaactgagtacttatt

SEQ ID NO: 19931 - DNA, 20 bp, Artificial
  CRISPR gRNA sequence
tttattcagttcttaaacag

SEQ ID NO: 19932 - DNA, 20 bp, Artificial
  CRISPR gRNA sequence
ttaaacaggtgaatcgcaca

SEQ ID NO: 19933 - DNA, 20 bp, Artificial
  CRISPR gRNA sequence
tatgagattttaaaagtgca

SEQ ID NO: 19934 - DNA, 20 bp, Artificial
  CRISPR gRNA sequence
agtttgggaggccaaggggg

SEQ ID NO: 19935 - DNA, 20 bp, Artificial
  CRISPR gRNA sequence
gggacggatcacttgaggtc

SEQ ID NO: 19936 - DNA, 20 bp, Artificial
  CRISPR gRNA sequence
ccaaaaaatacaaaaattag

SEQ ID NO: 19937 - DNA, 20 bp, Artificial
  CRISPR gRNA sequence
tactcgggaggctgaggcag

SEQ ID NO: 19938 - DNA, 20 bp, Artificial
  CRISPR gRNA sequence
tcacgccactgcactccagc

SEQ ID NO: 19939 - DNA, 20 bp, Artificial
  CRISPR gRNA sequence
ctgcactccagcctgggtgg

SEQ ID NO: 19940 - DNA, 20 bp, Artificial
  CRISPR gRNA sequence
tctcaaacaacaacaaccaa

SEQ ID NO: 19941 - DNA, 20 bp, Artificial
  CRISPR gRNA sequence
ctggcagatcacctgaggtc

SEQ ID NO: 19942 - DNA, 20 bp, Artificial
  CRISPR gRNA sequence
atcccagctaccagggaggc

SEQ ID NO: 19943 - DNA, 20 bp, Artificial
  CRISPR gRNA sequence
taccagggaggctagggtgg

SEQ ID NO: 19944 - DNA, 20 bp, Artificial
  CRISPR gRNA sequence
tcaagatacaataaaagtga

SEQ ID NO: 19945 - DNA, 20 bp, Artificial
  CRISPR gRNA sequence
ttttgattctacaattaatg

SEQ ID NO: 19946 - DNA, 20 bp, Artificial
  CRISPR gRNA sequence
taaggccatgcagtgtttcg

SEQ ID NO: 19947 - DNA, 20 bp, Artificial
  CRISPR gRNA sequence
agtcccttgctaagggacac

SEQ ID NO: 19948 - DNA, 20 bp, Artificial
  CRISPR gRNA sequence
tgggtttttaatctgttgct

SEQ ID NO: 19949 - DNA, 20 bp, Artificial
  CRISPR gRNA sequence
ctgcctggtatggtttgaga

SEQ ID NO: 19950 - DNA, 20 bp, Artificial
  CRISPR gRNA sequence
ggtatggtttgagatggggt

SEQ ID NO: 19951 - DNA, 20 bp, Artificial
  CRISPR gRNA sequence
ttgggttcaagccaaggagc

SEQ ID NO: 19952 - DNA, 20 bp, Artificial
  CRISPR gRNA sequence
tcaagccaaggagctggggt

SEQ ID NO: 19953 - DNA, 20 bp, Artificial
  CRISPR gRNA sequence
gttaaggccgtatagcctgc

SEQ ID NO: 19954 - DNA, 20 bp, Artificial
  CRISPR gRNA sequence
ggtgtgcagggcaggtgggc

SEQ ID NO: 19955 - DNA, 20 bp, Artificial
  CRISPR gRNA sequence
gcaggtgggctggggttggg

SEQ ID NO: 19956 - DNA, 20 bp, Artificial
  CRISPR gRNA sequence
gtgggctggggttgggaagg

SEQ ID NO: 19957 - DNA, 20 bp, Artificial
  CRISPR gRNA sequence
aagggtggatgccttgggga

SEQ ID NO: 19958 - DNA, 20 bp, Artificial
  CRISPR gRNA sequence
actcctggcccaagtctgat

SEQ ID NO: 19959 - DNA, 20 bp, Artificial
  CRISPR gRNA sequence
ggtgcagcccctgcccttct

SEQ ID NO: 19960 - DNA, 20 bp, Artificial
  CRISPR gRNA sequence
ttgggtagaggctgagagct

SEQ ID NO: 19961 - DNA, 20 bp, Artificial
  CRISPR gRNA sequence
gctgagagcttggggtccct

SEQ ID NO: 19962 - DNA, 20 bp, Artificial
  CRISPR gRNA sequence
agctctccgtgtggaggccc

SEQ ID NO: 19963 - DNA, 20 bp, Artificial
  CRISPR gRNA sequence
agtatgttagggggcttgga

SEQ ID NO: 19964 - DNA, 20 bp, Artificial
  CRISPR gRNA sequence
ggctttctccctcttgggag

SEQ ID NO: 19965 - DNA, 20 bp, Artificial
  CRISPR gRNA sequence
tccctcttgggaggtggata

SEQ ID NO: 19966 - DNA, 20 bp, Artificial
  CRISPR gRNA sequence
catccgtgcgagcatcagga

SEQ ID NO: 19967 - DNA, 20 bp, Artificial
  CRISPR gRNA sequence
caactgctctgctaggtgct

SEQ ID NO: 19968 - DNA, 20 bp, Artificial
  CRISPR gRNA sequence
gggaaattagggccctttag

SEQ ID NO: 19969 - DNA, 20 bp, Artificial
  CRISPR gRNA sequence
attaatcaaataagcaaaag

SEQ ID NO: 19970 - DNA, 20 bp, Artificial
  CRISPR gRNA sequence
ccagttcctcgttgagctgc

SEQ ID NO: 19971 - DNA, 20 bp, Artificial
  CRISPR gRNA sequence
caaatctctgaggctggaac

SEQ ID NO: 19972 - DNA, 20 bp, Artificial
  CRISPR gRNA sequence
cagtatattcatctaccatg

SEQ ID NO: 19973 - DNA, 20 bp, Artificial
  CRISPR gRNA sequence
gcagagattcctgaggtggt

SEQ ID NO: 19974 - DNA, 20 bp, Artificial
  CRISPR gRNA sequence
ggtggtctgggtgcatgacc

SEQ ID NO: 19975 - DNA, 20 bp, Artificial
  CRISPR gRNA sequence
taatgacaagtgatgtttac

SEQ ID NO: 19976 - DNA, 20 bp, Artificial
  CRISPR gRNA sequence
cactcttttagtatactgat

SEQ ID NO: 19977 - DNA, 20 bp, Artificial
  CRISPR gRNA sequence
cctactgacccaccacactg

SEQ ID NO: 19978 - DNA, 20 bp, Artificial
  CRISPR gRNA sequence
gaaggtgtgtttgggctgtc

SEQ ID NO: 19979 - DNA, 20 bp, Artificial
  CRISPR gRNA sequence
gctgtcagggatgagaccag

SEQ ID NO: 19980 - DNA, 20 bp, Artificial
  CRISPR gRNA sequence
agcactgaccacacagcagg

SEQ ID NO: 19981 - DNA, 20 bp, Artificial
  CRISPR gRNA sequence
ctgagctccacagcccagtt

SEQ ID NO: 19982 - DNA, 20 bp, Artificial
  CRISPR gRNA sequence
tccacagcccagtttggagt

SEQ ID NO: 19983 - DNA, 20 bp, Artificial
  CRISPR gRNA sequence
gggtgacccaagtgcatttc

SEQ ID NO: 19984 - DNA, 20 bp, Artificial
  CRISPR gRNA sequence
cagccaagtaccccctccca

SEQ ID NO: 19985 - DNA, 20 bp, Artificial
  CRISPR gRNA sequence
cctgtgagaggtactagaag

SEQ ID NO: 19986 - DNA, 20 bp, Artificial
  CRISPR gRNA sequence
caggatcgaggccctgggga

SEQ ID NO: 19987 - DNA, 20 bp, Artificial
  CRISPR gRNA sequence
agggacaacaggtcatgttt

SEQ ID NO: 19988 - DNA, 20 bp, Artificial
  CRISPR gRNA sequence
taggggtcagtcgggacagg

SEQ ID NO: 19989 - DNA, 20 bp, Artificial
  CRISPR gRNA sequence
cgggacagggagggtctcca

SEQ ID NO: 19990 - DNA, 20 bp, Artificial
  CRISPR gRNA sequence
gagtggaggcatggttgtgg

SEQ ID NO: 19991 - DNA, 20 bp, Artificial
  CRISPR gRNA sequence
tgtgggggaatggacagcta

SEQ ID NO: 19992 - DNA, 20 bp, Artificial
  CRISPR gRNA sequence
ttatttatttattgttgaga

SEQ ID NO: 19993 - DNA, 20 bp, Artificial
  CRISPR gRNA sequence
tctcactctgttgcccaggc

SEQ ID NO: 19994 - DNA, 20 bp, Artificial
  CRISPR gRNA sequence
gcctcagcctccggagcagc

SEQ ID NO: 19995 - DNA, 20 bp, Artificial
  CRISPR gRNA sequence
gcctcgacctcccaaagtgc

SEQ ID NO: 19996 - DNA, 20 bp, Artificial
  CRISPR gRNA sequence
tgcgattttcttttttaaac

SEQ ID NO: 19997 - DNA, 20 bp, Artificial
  CRISPR gRNA sequence
ttggccaaagaaagacatat

SEQ ID NO: 19998 - DNA, 20 bp, Artificial
  CRISPR gRNA sequence
actaagtggcccagagggag

SEQ ID NO: 19999 - DNA, 20 bp, Artificial
  CRISPR gRNA sequence
ccagagggaggggggtcccc

SEQ ID NO: 20000 - DNA, 20 bp, Artificial
  CRISPR gRNA sequence
caagcttccaaaatggcctg

SEQ ID NO: 20001 - DNA, 20 bp, Artificial
  CRISPR gRNA sequence
aaatggcctggtgagtgatg

SEQ ID NO: 20002 - DNA, 20 bp, Artificial
  CRISPR gRNA sequence
tgatgcgggatctctctgcc

SEQ ID NO: 20003 - DNA, 20 bp, Artificial
  CRISPR gRNA sequence
tgcccttcaataagcctgca

SEQ ID NO: 20004 - DNA, 20 bp, Artificial
  CRISPR gRNA sequence
acacttcattgtcaggctga

SEQ ID NO: 20005 - DNA, 20 bp, Artificial
  CRISPR gRNA sequence
ttcattgtcaggctgagaga

SEQ ID NO: 20006 - DNA, 20 bp, Artificial
  CRISPR gRNA sequence
agagaatgaatgaggggcaa

SEQ ID NO: 20007 - DNA, 20 bp, Artificial
  CRISPR gRNA sequence
aggggcaagcgaatgatgaa

SEQ ID NO: 20008 - DNA, 20 bp, Artificial
  CRISPR gRNA sequence
gcaagcgaatgatgaagtga

SEQ ID NO: 20009 - DNA, 20 bp, Artificial
  CRISPR gRNA sequence
gcgaatgatgaagtgagtga

SEQ ID NO: 20010 - DNA, 20 bp, Artificial
  CRISPR gRNA sequence
ggatgaagtgagaagttgat

SEQ ID NO: 20011 - DNA, 20 bp, Artificial
  CRISPR gRNA sequence
ggatgggagcaatggaaagt

SEQ ID NO: 20012 - DNA, 20 bp, Artificial
  CRISPR gRNA sequence
tggaaagtgggaataaacca

SEQ ID NO: 20013 - DNA, 20 bp, Artificial
  CRISPR gRNA sequence
gggaataaaccagtgaataa

SEQ ID NO: 20014 - DNA, 20 bp, Artificial
  CRISPR gRNA sequence
atgaggctactgaggcatgg

SEQ ID NO: 20015 - DNA, 20 bp, Artificial
  CRISPR gRNA sequence
ggtgggatgtatagcatgct

SEQ ID NO: 20016 - DNA, 20 bp, Artificial
  CRISPR gRNA sequence
gctccagcaagtggtagaac

SEQ ID NO: 20017 - DNA, 20 bp, Artificial
  CRISPR gRNA sequence
cctcccatgacctccccatg

SEQ ID NO: 20018 - DNA, 20 bp, Artificial
  CRISPR gRNA sequence
ccatgacctccccatggtga

SEQ ID NO: 20019 - DNA, 20 bp, Artificial
  CRISPR gRNA sequence
tcaagcgaagaaaaagctta

SEQ ID NO: 20020 - DNA, 20 bp, Artificial
  CRISPR gRNA sequence
aaagcttagtgagtaaatga

SEQ ID NO: 20021 - DNA, 20 bp, Artificial
  CRISPR gRNA sequence
actttgggaggccaaggcag

SEQ ID NO: 20022 - DNA, 20 bp, Artificial
  CRISPR gRNA sequence
caggtggatcacctgaggtc

SEQ ID NO: 20023 - DNA, 20 bp, Artificial
  CRISPR gRNA sequence
aaaattagccagacgtggta

SEQ ID NO: 20024 - DNA, 20 bp, Artificial
  CRISPR gRNA sequence
tacttggcaggccgaggcag

SEQ ID NO: 20025 - DNA, 20 bp, Artificial
  CRISPR gRNA sequence
ctccagcctggggcacaggg

SEQ ID NO: 20026 - DNA, 20 bp, Artificial
  CRISPR gRNA sequence
aaagagagaaaaggtctaaa

SEQ ID NO: 20027 - DNA, 20 bp, Artificial
  CRISPR gRNA sequence
acacttaaacaagagagacg

SEQ ID NO: 20028 - DNA, 20 bp, Artificial
  CRISPR gRNA sequence
acaagagagacgatgagtga

SEQ ID NO: 20029 - DNA, 20 bp, Artificial
  CRISPR gRNA sequence
gagagacgatgagtgaagga

SEQ ID NO: 20030 - DNA, 20 bp, Artificial
  CRISPR gRNA sequence
gtgaaggaatgggtgtggaa

SEQ ID NO: 20031 - DNA, 20 bp, Artificial
  CRISPR gRNA sequence
gtgtggaaatgagtgaacta

SEQ ID NO: 20032 - DNA, 20 bp, Artificial
  CRISPR gRNA sequence
ggaaatgagtgaactaatga

SEQ ID NO: 20033 - DNA, 20 bp, Artificial
  CRISPR gRNA sequence
agtgaactaatgaatgagtg

SEQ ID NO: 20034 - DNA, 20 bp, Artificial
  CRISPR gRNA sequence
aatgaatgagtggtgggtga

SEQ ID NO: 20035 - DNA, 20 bp, Artificial
  CRISPR gRNA sequence
tactcaggaggctgaggtgg

SEQ ID NO: 20036 - DNA, 20 bp, Artificial
  CRISPR gRNA sequence
ggtcccagctacttgggagg

SEQ ID NO: 20037 - DNA, 20 bp, Artificial
  CRISPR gRNA sequence
tacttgggaggtggagtcag

SEQ ID NO: 20038 - DNA, 20 bp, Artificial
  CRISPR gRNA sequence
atggtgccgagcccgcaggc

SEQ ID NO: 20039 - DNA, 20 bp, Artificial
  CRISPR gRNA sequence
cggatggcatcctagtggag

SEQ ID NO: 20040 - DNA, 20 bp, Artificial
  CRISPR gRNA sequence
caccggcggccgcgtgagac

SEQ ID NO: 20041 - DNA, 20 bp, Artificial
  CRISPR gRNA sequence
gccattgcttgaaccgtccg

SEQ ID NO: 20042 - DNA, 20 bp, Artificial
  CRISPR gRNA sequence
cgggggatgcctatggcctg

SEQ ID NO: 20043 - DNA, 20 bp, Artificial
  CRISPR gRNA sequence
atgcgctactttgagagctc

SEQ ID NO: 20044 - DNA, 20 bp, Artificial
  CRISPR gRNA sequence
ccaacacccaccgcgggccg

SEQ ID NO: 20045 - DNA, 20 bp, Artificial
  CRISPR gRNA sequence
tgggggccctgtggctggct

SEQ ID NO: 20046 - DNA, 20 bp, Artificial
  CRISPR gRNA sequence
gcccacgaggccgaggaggc

SEQ ID NO: 20047 - DNA, 20 bp, Artificial
  CRISPR gRNA sequence
cagcactggcatttgcccct

SEQ ID NO: 20048 - DNA, 20 bp, Artificial
  CRISPR gRNA sequence
gctgtgtcacccgtttcagg

SEQ ID NO: 20049 - DNA, 20 bp, Artificial
  CRISPR gRNA sequence
gtgccaagcccagtgctctg

SEQ ID NO: 20050 - DNA, 20 bp, Artificial
  CRISPR gRNA sequence
tcttttagtatgcagagcag

SEQ ID NO: 20051 - DNA, 20 bp, Artificial
  CRISPR gRNA sequence
tgcagagcagccgggtgggg

SEQ ID NO: 20052 - DNA, 20 bp, Artificial
  CRISPR gRNA sequence
gagcagccgggtggggcaga

SEQ ID NO: 20053 - DNA, 20 bp, Artificial
  CRISPR gRNA sequence
attctctccatttttaagat

SEQ ID NO: 20054 - DNA, 20 bp, Artificial
  CRISPR gRNA sequence
gcccgccatgtgccagtcac

SEQ ID NO: 20055 - DNA, 20 bp, Artificial
  CRISPR gRNA sequence
gccagtcactggggtatgtc

SEQ ID NO: 20056 - DNA, 20 bp, Artificial
  CRISPR gRNA sequence
cgccaccgttttcttatgct

SEQ ID NO: 20057 - DNA, 20 bp, Artificial
  CRISPR gRNA sequence
cagaccaatcttctcagaac

SEQ ID NO: 20058 - DNA, 20 bp, Artificial
  CRISPR gRNA sequence
cagggacactccaccactgt

SEQ ID NO: 20059 - DNA, 20 bp, Artificial
  CRISPR gRNA sequence
gcatttcagcttaatcgcca

SEQ ID NO: 20060 - DNA, 20 bp, Artificial
  CRISPR gRNA sequence
aagggaaagaaaaccactgt

SEQ ID NO: 20061 - DNA, 20 bp, Artificial
  CRISPR gRNA sequence
tgtgtgagttgtgagaaagt

SEQ ID NO: 20062 - DNA, 20 bp, Artificial
  CRISPR gRNA sequence
aagtaggaatcaataaaggc

SEQ ID NO: 20063 - DNA, 20 bp, Artificial
  CRISPR gRNA sequence
gtctagcctggtcaccgtgc

SEQ ID NO: 20064 - DNA, 20 bp, Artificial
  CRISPR gRNA sequence
gagcgacacggtggcgctgt

SEQ ID NO: 20065 - DNA, 20 bp, Artificial
  CRISPR gRNA sequence
ctttcaaagccaagtccctg

SEQ ID NO: 20066 - DNA, 20 bp, Artificial
  CRISPR gRNA sequence
actcagaggtgagaggagag

SEQ ID NO: 20067 - DNA, 20 bp, Artificial
  CRISPR gRNA sequence
ctttctgggcaatggctaac

SEQ ID NO: 20068 - DNA, 20 bp, Artificial
  CRISPR gRNA sequence
cgctgcccaggcggagcctc

SEQ ID NO: 20069 - DNA, 20 bp, Artificial
  CRISPR gRNA sequence
tggagaacctctccccttct

SEQ ID NO: 20070 - DNA, 20 bp, Artificial
  CRISPR gRNA sequence
ctccccttctaggagttaac

SEQ ID NO: 20071 - DNA, 20 bp, Artificial
  CRISPR gRNA sequence
agcgcctcttaagtgctgtc

SEQ ID NO: 20072 - DNA, 20 bp, Artificial
  CRISPR gRNA sequence
tttttattatttcttaaaga

SEQ ID NO: 20073 - DNA, 20 bp, Artificial
  CRISPR gRNA sequence
tctcgctgtgtctaccaggc

SEQ ID NO: 20074 - DNA, 20 bp, Artificial
  CRISPR gRNA sequence
gcctcagcctcccaagtagc

SEQ ID NO: 20075 - DNA, 20 bp, Artificial
  CRISPR gRNA sequence
tataggtgcacgtcatcaca

SEQ ID NO: 20076 - DNA, 20 bp, Artificial
  CRISPR gRNA sequence
ttttaagtttttgtagacac

SEQ ID NO: 20077 - DNA, 20 bp, Artificial
  CRISPR gRNA sequence
caaggaaagcaatccccctg

SEQ ID NO: 20078 - DNA, 20 bp, Artificial
  CRISPR gRNA sequence
gggcagccatcatgggaccc

SEQ ID NO: 20079 - DNA, 20 bp, Artificial
  CRISPR gRNA sequence
tgttcgggacctaaagaaac

SEQ ID NO: 20080 - DNA, 20 bp, Artificial
  CRISPR gRNA sequence
actggagtttgcgtaagcaa

SEQ ID NO: 20081 - DNA, 20 bp, Artificial
  CRISPR gRNA sequence
gagtttgcgtaagcaaaggg

SEQ ID NO: 20082 - DNA, 20 bp, Artificial
  CRISPR gRNA sequence
gcaaaggggtggattgtctt

SEQ ID NO: 20083 - DNA, 20 bp, Artificial
  CRISPR gRNA sequence
attagctgggcttgtaccac

SEQ ID NO: 20084 - DNA, 20 bp, Artificial
  CRISPR gRNA sequence
cctgaatggagatagatctc

SEQ ID NO: 20085 - DNA, 20 bp, Artificial
  CRISPR gRNA sequence
tcaacagaggtattgagcac

SEQ ID NO: 20086 - DNA, 20 bp, Artificial
  CRISPR gRNA sequence
atctgcactgaagcttcagt

SEQ ID NO: 20087 - DNA, 20 bp, Artificial
  CRISPR gRNA sequence
ctgaagcttcagtgaggata

SEQ ID NO: 20088 - DNA, 20 bp, Artificial
  CRISPR gRNA sequence
cagtgaggataaggaatgag

SEQ ID NO: 20089 - DNA, 20 bp, Artificial
  CRISPR gRNA sequence
aatgagctgagtggggagag

SEQ ID NO: 20090 - DNA, 20 bp, Artificial
  CRISPR gRNA sequence
gggagtaagaaaggctttcc

SEQ ID NO: 20091 - DNA, 20 bp, Artificial
  CRISPR gRNA sequence
ccaggaattgtaatttcgcc

SEQ ID NO: 20092 - DNA, 20 bp, Artificial
  CRISPR gRNA sequence
gtgtccccaaccttccatag

SEQ ID NO: 20093 - DNA, 20 bp, Artificial
  CRISPR gRNA sequence
ggaggatgccactatgacta

SEQ ID NO: 20094 - DNA, 20 bp, Artificial
  CRISPR gRNA sequence
cttgtttacttccacagcca

SEQ ID NO: 20095 - DNA, 20 bp, Artificial
  CRISPR gRNA sequence
caagggatggcctccccagg

SEQ ID NO: 20096 - DNA, 20 bp, Artificial
  CRISPR gRNA sequence
aggagcttttgatgtgcagc

SEQ ID NO: 20097 - DNA, 20 bp, Artificial
  CRISPR gRNA sequence
cacaccctaggcagtgttgc

SEQ ID NO: 20098 - DNA, 20 bp, Artificial
  CRISPR gRNA sequence
gagacctaggcaaggctcta

SEQ ID NO: 20099 - DNA, 20 bp, Artificial
  CRISPR gRNA sequence
tctagggagtccagttgtgt

SEQ ID NO: 20100 - DNA, 20 bp, Artificial
  CRISPR gRNA sequence
attattatatttagatctgt

SEQ ID NO: 20101 - DNA, 20 bp, Artificial
  CRISPR gRNA sequence
ttttcttttctttcttgagg

SEQ ID NO: 20102 - DNA, 20 bp, Artificial
  CRISPR gRNA sequence
tcttactctgtccctcaggc

SEQ ID NO: 20103 - DNA, 20 bp, Artificial
  CRISPR gRNA sequence
ttttgtattttttgtagaga

SEQ ID NO: 20104 - DNA, 20 bp, Artificial
  CRISPR gRNA sequence
acctcagcctcccaaagtgc

SEQ ID NO: 20105 - DNA, 20 bp, Artificial
  CRISPR gRNA sequence
ccttccacagaaaaagctaa

SEQ ID NO: 20106 - DNA, 20 bp, Artificial
  CRISPR gRNA sequence
atgaatgtttgttccttggt

SEQ ID NO: 20107 - DNA, 20 bp, Artificial
  CRISPR gRNA sequence
agatcatctaatgattagga

SEQ ID NO: 20108 - DNA, 20 bp, Artificial
  CRISPR gRNA sequence
gtgctgtttttttttggaga

SEQ ID NO: 20109 - DNA, 20 bp, Artificial
  CRISPR gRNA sequence
tcttgctctgtcacccaggc

SEQ ID NO: 20110 - DNA, 20 bp, Artificial
  CRISPR gRNA sequence
aattttcctgcctcagcctc

SEQ ID NO: 20111 - DNA, 20 bp, Artificial
  CRISPR gRNA sequence
gcctcagcctcccgagtagc

SEQ ID NO: 20112 - DNA, 20 bp, Artificial
  CRISPR gRNA sequence
acctcagcctcccaaagtgc

SEQ ID NO: 20113 - DNA, 20 bp, Artificial
  CRISPR gRNA sequence
gctctggggaacagcggcca

SEQ ID NO: 20114 - DNA, 20 bp, Artificial
  CRISPR gRNA sequence
tggggtggaacagcctagag

SEQ ID NO: 20115 - DNA, 20 bp, Artificial
  CRISPR gRNA sequence
acctcatctgtctgtcaaat

SEQ ID NO: 20116 - DNA, 20 bp, Artificial
  CRISPR gRNA sequence
acagggacttcgtttgtaca

SEQ ID NO: 20117 - DNA, 20 bp, Artificial
  CRISPR gRNA sequence
acccttatctcctacactcg

SEQ ID NO: 20118 - DNA, 20 bp, Artificial
  CRISPR gRNA sequence
caccggctgtgccctctgcc

SEQ ID NO: 20119 - DNA, 20 bp, Artificial
  CRISPR gRNA sequence
ttctttttctttttttgagg

SEQ ID NO: 20120 - DNA, 20 bp, Artificial
  CRISPR gRNA sequence
tctcgctctgtcacccaggc

SEQ ID NO: 20121 - DNA, 20 bp, Artificial
  CRISPR gRNA sequence
gattctcttgcctcagcctc

SEQ ID NO: 20122 - DNA, 20 bp, Artificial
  CRISPR gRNA sequence
ttttgtatttttagtagaga

SEQ ID NO: 20123 - DNA, 20 bp, Artificial
  CRISPR gRNA sequence
cggggtttcaccgtgttagc

SEQ ID NO: 20124 - DNA, 20 bp, Artificial
  CRISPR gRNA sequence
acctcggcctcccaaagtgc

SEQ ID NO: 20125 - DNA, 20 bp, Artificial
  CRISPR gRNA sequence
actttgggaggccgaggcag

SEQ ID NO: 20126 - DNA, 20 bp, Artificial
  CRISPR gRNA sequence
ggcaggtggatcacaaggcc

SEQ ID NO: 20127 - DNA, 20 bp, Artificial
  CRISPR gRNA sequence
tacttgggaggctgaggcag

SEQ ID NO: 20128 - DNA, 20 bp, Artificial
  CRISPR gRNA sequence
tcacgccactgcagtccagc

SEQ ID NO: 20129 - DNA, 20 bp, Artificial
  CRISPR gRNA sequence
ctgcagtccagcttggatga

SEQ ID NO: 20130 - DNA, 20 bp, Artificial
  CRISPR gRNA sequence
tatctgtctatcttcccccc

SEQ ID NO: 20131 - DNA, 20 bp, Artificial
  CRISPR gRNA sequence
aatgtcagcacccagaaggc

SEQ ID NO: 20132 - DNA, 20 bp, Artificial
  CRISPR gRNA sequence
caagcggtcaatatttaaca

SEQ ID NO: 20133 - DNA, 20 bp, Artificial
  CRISPR gRNA sequence
tccaagaacccccataagat

SEQ ID NO: 20134 - DNA, 20 bp, Artificial
  CRISPR gRNA sequence
atttgaggagatcaagactt

SEQ ID NO: 20135 - DNA, 20 bp, Artificial
  CRISPR gRNA sequence
agatcaagacttaagggtga

SEQ ID NO: 20136 - DNA, 20 bp, Artificial
  CRISPR gRNA sequence
gggagccaaatgccagatcc

SEQ ID NO: 20137 - DNA, 20 bp, Artificial
  CRISPR gRNA sequence
aggccagtgttctcagactt

SEQ ID NO: 20138 - DNA, 20 bp, Artificial
  CRISPR gRNA sequence
ttcagaggccgagaacattt

SEQ ID NO: 20139 - DNA, 20 bp, Artificial
  CRISPR gRNA sequence
gaggccgagaacatttcgga

SEQ ID NO: 20140 - DNA, 20 bp, Artificial
  CRISPR gRNA sequence
gagaacatttcggaatgaat

SEQ ID NO: 20141 - DNA, 20 bp, Artificial
  CRISPR gRNA sequence
actgttttttaatgtttatc

SEQ ID NO: 20142 - DNA, 20 bp, Artificial
  CRISPR gRNA sequence
ctggcaccataattttacca

SEQ ID NO: 20143 - DNA, 20 bp, Artificial
  CRISPR gRNA sequence
aagttcaaaggacataattg

SEQ ID NO: 20144 - DNA, 20 bp, Artificial
  CRISPR gRNA sequence
ataaaagacagctctttata

SEQ ID NO: 20145 - DNA, 20 bp, Artificial
  CRISPR gRNA sequence
ggagataagagcccatagct

SEQ ID NO: 20146 - DNA, 20 bp, Artificial
  CRISPR gRNA sequence
gcccatagctcagagtcttg

SEQ ID NO: 20147 - DNA, 20 bp, Artificial
  CRISPR gRNA sequence
tccccaggctgcggcgggag

SEQ ID NO: 20148 - DNA, 20 bp, Artificial
  CRISPR gRNA sequence
gcggcgggagaagggtatct

SEQ ID NO: 20149 - DNA, 20 bp, Artificial
  CRISPR gRNA sequence
gggtatctgtggatgttggg

SEQ ID NO: 20150 - DNA, 20 bp, Artificial
  CRISPR gRNA sequence
gttttttttcttttttgaga

SEQ ID NO: 20151 - DNA, 20 bp, Artificial
  CRISPR gRNA sequence
ggtctcgctcttacccaggc

SEQ ID NO: 20152 - DNA, 20 bp, Artificial
  CRISPR gRNA sequence
tattgtgttttttgtagaga

SEQ ID NO: 20153 - DNA, 20 bp, Artificial
  CRISPR gRNA sequence
accttggcctcccaaaatgc

SEQ ID NO: 20154 - DNA, 20 bp, Artificial
  CRISPR gRNA sequence
ctaccccaagcagaaaagat

SEQ ID NO: 20155 - DNA, 20 bp, Artificial
  CRISPR gRNA sequence
aagattggggtcctacgtgg

SEQ ID NO: 20156 - DNA, 20 bp, Artificial
  CRISPR gRNA sequence
gttgcagggacctaagaggc

SEQ ID NO: 20157 - DNA, 20 bp, Artificial
  CRISPR gRNA sequence
gtctctgccccaccctgggg

SEQ ID NO: 20158 - DNA, 20 bp, Artificial
  CRISPR gRNA sequence
caggctttccccaaactggt

SEQ ID NO: 20159 - DNA, 20 bp, Artificial
  CRISPR gRNA sequence
cttttcctccctgcagcatc

SEQ ID NO: 20160 - DNA, 20 bp, Artificial
  CRISPR gRNA sequence
tcctccctgcagcatctgga

SEQ ID NO: 20161 - DNA, 20 bp, Artificial
  CRISPR gRNA sequence
ggaccccttcctctcaacat

SEQ ID NO: 20162 - DNA, 20 bp, Artificial
  CRISPR gRNA sequence
gatcatagctcactgcagcc

SEQ ID NO: 20163 - DNA, 20 bp, Artificial
  CRISPR gRNA sequence
agtcctcctgcctcagcctc

SEQ ID NO: 20164 - DNA, 20 bp, Artificial
  CRISPR gRNA sequence
gctacagtgcccagcaacct

SEQ ID NO: 20165 - DNA, 20 bp, Artificial
  CRISPR gRNA sequence
atcctcaatgtggctggcac

SEQ ID NO: 20166 - DNA, 20 bp, Artificial
  CRISPR gRNA sequence
gagatgacgccacatcagat

SEQ ID NO: 20167 - DNA, 20 bp, Artificial
  CRISPR gRNA sequence
tctcagcaattcagctgggg

SEQ ID NO: 20168 - DNA, 20 bp, Artificial
  CRISPR gRNA sequence
tagttcctaagaagctaaac

SEQ ID NO: 20169 - DNA, 20 bp, Artificial
  CRISPR gRNA sequence
aacagggattcaagtccatc

SEQ ID NO: 20170 - DNA, 20 bp, Artificial
  CRISPR gRNA sequence
agtcctcgtctgaaaagctc

SEQ ID NO: 20171 - DNA, 20 bp, Artificial
  CRISPR gRNA sequence
cctatggtgtattagagctg

SEQ ID NO: 20172 - DNA, 20 bp, Artificial
  CRISPR gRNA sequence
agggctgaggaggccctcac

SEQ ID NO: 20173 - DNA, 20 bp, Artificial
  CRISPR gRNA sequence
gaggccctcactgggatggg

SEQ ID NO: 20174 - DNA, 20 bp, Artificial
  CRISPR gRNA sequence
catctgattccacctgcagc

SEQ ID NO: 20175 - DNA, 20 bp, Artificial
  CRISPR gRNA sequence
ccacctgcagcctggatgcg

SEQ ID NO: 20176 - DNA, 20 bp, Artificial
  CRISPR gRNA sequence
gtgagaacaagatcggggac

SEQ ID NO: 20177 - DNA, 20 bp, Artificial
  CRISPR gRNA sequence
aagtccttggaaaccctcaa

SEQ ID NO: 20178 - DNA, 20 bp, Artificial
  CRISPR gRNA sequence
agctgggcctgcccttcctg

SEQ ID NO: 20179 - DNA, 20 bp, Artificial
  CRISPR gRNA sequence
gctcgctgtgtcacccaggc

SEQ ID NO: 20180 - DNA, 20 bp, Artificial
  CRISPR gRNA sequence
gccttgaactcctggcctca

SEQ ID NO: 20181 - DNA, 20 bp, Artificial
  CRISPR gRNA sequence
acctccgcttcccaaagtgc

SEQ ID NO: 20182 - DNA, 20 bp, Artificial
  CRISPR gRNA sequence
acttaccatgcccagcccca

SEQ ID NO: 20183 - DNA, 20 bp, Artificial
  CRISPR gRNA sequence
caaataaatcccctgacctc

SEQ ID NO: 20184 - DNA, 20 bp, Artificial
  CRISPR gRNA sequence
ggtgacagaaaattatactg

SEQ ID NO: 20185 - DNA, 20 bp, Artificial
  CRISPR gRNA sequence
gtgaaataggagagatagat

SEQ ID NO: 20186 - DNA, 20 bp, Artificial
  CRISPR gRNA sequence
tgggctctgggaagttggag

SEQ ID NO: 20187 - DNA, 20 bp, Artificial
  CRISPR gRNA sequence
tggagatggataagatacag

SEQ ID NO: 20188 - DNA, 20 bp, Artificial
  CRISPR gRNA sequence
caaggtctcgctctgtcacc

SEQ ID NO: 20189 - DNA, 20 bp, Artificial
  CRISPR gRNA sequence
tctcgctctgtcacccaggg

SEQ ID NO: 20190 - DNA, 20 bp, Artificial
  CRISPR gRNA sequence
aatcctcccatctcaacctt

SEQ ID NO: 20191 - DNA, 20 bp, Artificial
  CRISPR gRNA sequence
gcctctgcctcccaaagtac

SEQ ID NO: 20192 - DNA, 20 bp, Artificial
  CRISPR gRNA sequence
aaagtactgggattacaggc

SEQ ID NO: 20193 - DNA, 20 bp, Artificial
  CRISPR gRNA sequence
agtcactgtgcctggttcaa

SEQ ID NO: 20194 - DNA, 20 bp, Artificial
  CRISPR gRNA sequence
ttttttttttttttttgaca

SEQ ID NO: 20195 - DNA, 20 bp, Artificial
  CRISPR gRNA sequence
tctcgctctgtagcccaggc

SEQ ID NO: 20196 - DNA, 20 bp, Artificial
  CRISPR gRNA sequence
tttattgcaaacttcacctc

SEQ ID NO: 20197 - DNA, 20 bp, Artificial
  CRISPR gRNA sequence
acctcagcctcccaagtagc

SEQ ID NO: 20198 - DNA, 20 bp, Artificial
  CRISPR gRNA sequence
ttttgtatttttagtagaga

SEQ ID NO: 20199 - DNA, 20 bp, Artificial
  CRISPR gRNA sequence
acctcagcctcccaaagtgc

SEQ ID NO: 20200 - DNA, 20 bp, Artificial
  CRISPR gRNA sequence
atgattttttactgaaccta

SEQ ID NO: 20201 - DNA, 20 bp, Artificial
  CRISPR gRNA sequence
ccccctcacaaccaaggtct

SEQ ID NO: 20202 - DNA, 20 bp, Artificial
  CRISPR gRNA sequence
aggatggccaaataatttac

SEQ ID NO: 20203 - DNA, 20 bp, Artificial
  CRISPR gRNA sequence
cctggcagtgctctaggcac

SEQ ID NO: 20204 - DNA, 20 bp, Artificial
  CRISPR gRNA sequence
gaagcccacaacccggcaga

SEQ ID NO: 20205 - DNA, 20 bp, Artificial
  CRISPR gRNA sequence
agtggcgcagagggaaaaga

SEQ ID NO: 20206 - DNA, 20 bp, Artificial
  CRISPR gRNA sequence
catgggacaggtgggggcag

SEQ ID NO: 20207 - DNA, 20 bp, Artificial
  CRISPR gRNA sequence
cccagaacaacatcactgac

SEQ ID NO: 20208 - DNA, 20 bp, Artificial
  CRISPR gRNA sequence
gcatccctgctcaggctaag

SEQ ID NO: 20209 - DNA, 20 bp, Artificial
  CRISPR gRNA sequence
aggctaaggtgagtggggcc

SEQ ID NO: 20210 - DNA, 20 bp, Artificial
  CRISPR gRNA sequence
atcaccacagccctgaacaa

SEQ ID NO: 20211 - DNA, 20 bp, Artificial
  CRISPR gRNA sequence
aatattgctccttttccccc

SEQ ID NO: 20212 - DNA, 20 bp, Artificial
  CRISPR gRNA sequence
ccaggctttttccggaacct

SEQ ID NO: 20213 - DNA, 20 bp, Artificial
  CRISPR gRNA sequence
tggcatagcacctcttgctt

SEQ ID NO: 20214 - DNA, 20 bp, Artificial
  CRISPR gRNA sequence
cttcacttactgaggacaac

SEQ ID NO: 20215 - DNA, 20 bp, Artificial
  CRISPR gRNA sequence
tttaatttctgtttttgaga

SEQ ID NO: 20216 - DNA, 20 bp, Artificial
  CRISPR gRNA sequence
tctcgctctgtcacccaggc

SEQ ID NO: 20217 - DNA, 20 bp, Artificial
  CRISPR gRNA sequence
tattcgcctgcctcagtgct

SEQ ID NO: 20218 - DNA, 20 bp, Artificial
  CRISPR gRNA sequence
gcctcagtgctccgagtagc

SEQ ID NO: 20219 - DNA, 20 bp, Artificial
  CRISPR gRNA sequence
ttttatatttttagtagaga

SEQ ID NO: 20220 - DNA, 20 bp, Artificial
  CRISPR gRNA sequence
acctgcctcggcctcccaaa

SEQ ID NO: 20221 - DNA, 20 bp, Artificial
  CRISPR gRNA sequence
cggcctcccaaagtgagtac

SEQ ID NO: 20222 - DNA, 20 bp, Artificial
  CRISPR gRNA sequence
tttatttatttatttggaga

SEQ ID NO: 20223 - DNA, 20 bp, Artificial
  CRISPR gRNA sequence
tctcacccaggttgtagtgc

SEQ ID NO: 20224 - DNA, 20 bp, Artificial
  CRISPR gRNA sequence
cacctcagccttccaagtag

SEQ ID NO: 20225 - DNA, 20 bp, Artificial
  CRISPR gRNA sequence
aagaaactcagaagcaaaaa

SEQ ID NO: 20226 - DNA, 20 bp, Artificial
  CRISPR gRNA sequence
gacagatgtcgttcttgctt

SEQ ID NO: 20227 - DNA, 20 bp, Artificial
  CRISPR gRNA sequence
tttgagtttctttgcgtagt

SEQ ID NO: 20228 - DNA, 20 bp, Artificial
  CRISPR gRNA sequence
aggaaactaacaagccccag

SEQ ID NO: 20229 - DNA, 20 bp, Artificial
  CRISPR gRNA sequence
gggaaaaggggctgtgtttt

SEQ ID NO: 20230 - DNA, 20 bp, Artificial
  CRISPR gRNA sequence
ggccactgtggctgtgtgta

SEQ ID NO: 20231 - DNA, 20 bp, Artificial
  CRISPR gRNA sequence
gtggaagtaggggaggtcag

SEQ ID NO: 20232 - DNA, 20 bp, Artificial
  CRISPR gRNA sequence
gatcacacagggaggccctt

SEQ ID NO: 20233 - DNA, 20 bp, Artificial
  CRISPR gRNA sequence
ggtatttgcagtttttcagt

SEQ ID NO: 20234 - DNA, 20 bp, Artificial
  CRISPR gRNA sequence
ctcactgcaagcactgcctc

SEQ ID NO: 20235 - DNA, 20 bp, Artificial
  CRISPR gRNA sequence
gcctcagcctcccaagtagc

SEQ ID NO: 20236 - DNA, 20 bp, Artificial
  CRISPR gRNA sequence
acctcagccttccaaagtgc

SEQ ID NO: 20237 - DNA, 20 bp, Artificial
  CRISPR gRNA sequence
ccttccaaagtgctgggatt

SEQ ID NO: 20238 - DNA, 20 bp, Artificial
  CRISPR gRNA sequence
ttaagaaacatcatatttca

SEQ ID NO: 20239 - DNA, 20 bp, Artificial
  CRISPR gRNA sequence
tggtcagattactctccctg

SEQ ID NO: 20240 - DNA, 20 bp, Artificial
  CRISPR gRNA sequence
ctctccctgtggggtggagg

SEQ ID NO: 20241 - DNA, 20 bp, Artificial
  CRISPR gRNA sequence
tggggtggaggaagggtctc

SEQ ID NO: 20242 - DNA, 20 bp, Artificial
  CRISPR gRNA sequence
ggtaccggccgacccgtgat

SEQ ID NO: 20243 - DNA, 20 bp, Artificial
  CRISPR gRNA sequence
gtgatgtgagttgatttagc

SEQ ID NO: 20244 - DNA, 20 bp, Artificial
  CRISPR gRNA sequence
tttttctttttttttcgaga

SEQ ID NO: 20245 - DNA, 20 bp, Artificial
  CRISPR gRNA sequence
ttcgctcttgttgccaaggc

SEQ ID NO: 20246 - DNA, 20 bp, Artificial
  CRISPR gRNA sequence
gttcactgcaactccgcctc

SEQ ID NO: 20247 - DNA, 20 bp, Artificial
  CRISPR gRNA sequence
cctcagcctctcaagtagct

SEQ ID NO: 20248 - DNA, 20 bp, Artificial
  CRISPR gRNA sequence
ttttgtatttttagtagaga

SEQ ID NO: 20249 - DNA, 20 bp, Artificial
  CRISPR gRNA sequence
cgcctcggcctccaaagtgt

SEQ ID NO: 20250 - DNA, 20 bp, Artificial
  CRISPR gRNA sequence
ttttatatgcagccctgcaa

SEQ ID NO: 20251 - DNA, 20 bp, Artificial
  CRISPR gRNA sequence
cctgcaagggagttctgagg

SEQ ID NO: 20252 - DNA, 20 bp, Artificial
  CRISPR gRNA sequence
tgttaaaaggctgcttggtg

SEQ ID NO: 20253 - DNA, 20 bp, Artificial
  CRISPR gRNA sequence
cactgctactaatgctggtt

SEQ ID NO: 20254 - DNA, 20 bp, Artificial
  CRISPR gRNA sequence
ccattttacagatgggcaaa

SEQ ID NO: 20255 - DNA, 20 bp, Artificial
  CRISPR gRNA sequence
atgggcaaactgagtctcag

SEQ ID NO: 20256 - DNA, 20 bp, Artificial
  CRISPR gRNA sequence
caaactgagtctcagaagag

SEQ ID NO: 20257 - DNA, 20 bp, Artificial
  CRISPR gRNA sequence
taggcagtaagaggcatagc

SEQ ID NO: 20258 - DNA, 20 bp, Artificial
  CRISPR gRNA sequence
agagaagtggtctcaactct

SEQ ID NO: 20259 - DNA, 20 bp, Artificial
  CRISPR gRNA sequence
aaatattgattccttccccc

SEQ ID NO: 20260 - DNA, 20 bp, Artificial
  CRISPR gRNA sequence
tagtgggaccaggctttttc

SEQ ID NO: 20261 - DNA, 20 bp, Artificial
  CRISPR gRNA sequence
ccaggctttttctggaatct

SEQ ID NO: 20262 - DNA, 20 bp, Artificial
  CRISPR gRNA sequence
cttccggacatggtgtccct

SEQ ID NO: 20263 - DNA, 20 bp, Artificial
  CRISPR gRNA sequence
catggtgtccctccgggtga

SEQ ID NO: 20264 - DNA, 20 bp, Artificial
  CRISPR gRNA sequence
gtgtccctccgggtgatgga

SEQ ID NO: 20265 - DNA, 20 bp, Artificial
  CRISPR gRNA sequence
ccgggtgatggagtgagtgt

SEQ ID NO: 20266 - DNA, 20 bp, Artificial
  CRISPR gRNA sequence
tgagtgtgggagtctgggcg

SEQ ID NO: 20267 - DNA, 20 bp, Artificial
  CRISPR gRNA sequence
gggcggtgggtggctcagcc

SEQ ID NO: 20268 - DNA, 20 bp, Artificial
  CRISPR gRNA sequence
tccctggtgtcctggaagag

SEQ ID NO: 20269 - DNA, 20 bp, Artificial
  CRISPR gRNA sequence
gtcctggaagagctggatgt

SEQ ID NO: 20270 - DNA, 20 bp, Artificial
  CRISPR gRNA sequence
gtggccttggtctggagctg

SEQ ID NO: 20271 - DNA, 20 bp, Artificial
  CRISPR gRNA sequence
cccaagggccaggccccaag

SEQ ID NO: 20272 - DNA, 20 bp, Artificial
  CRISPR gRNA sequence
cgtaagtccaggcaaccctg

SEQ ID NO: 20273 - DNA, 20 bp, Artificial
  CRISPR gRNA sequence
cccttcaccaatctgcaacc

SEQ ID NO: 20274 - DNA, 20 bp, Artificial
  CRISPR gRNA sequence
ctcacctcttctaagacgca

SEQ ID NO: 20275 - DNA, 20 bp, Artificial
  CRISPR gRNA sequence
cctcttctaagacgcacagg

SEQ ID NO: 20276 - DNA, 20 bp, Artificial
  CRISPR gRNA sequence
gagcagttaactaacctttc

SEQ ID NO: 20277 - DNA, 20 bp, Artificial
  CRISPR gRNA sequence
agtcagctgcagaaccataa

SEQ ID NO: 20278 - DNA, 20 bp, Artificial
  CRISPR gRNA sequence
aaagtccccaacgttctagg

SEQ ID NO: 20279 - DNA, 20 bp, Artificial
  CRISPR gRNA sequence
gttctaggctgggtggaagg

SEQ ID NO: 20280 - DNA, 20 bp, Artificial
  CRISPR gRNA sequence
ctctctcctctaacctggct

SEQ ID NO: 20281 - DNA, 20 bp, Artificial
  CRISPR gRNA sequence
ctgagtcccatccccccttg

SEQ ID NO: 20282 - DNA, 20 bp, Artificial
  CRISPR gRNA sequence
tccaggaacacctgcaacaa

SEQ ID NO: 20283 - DNA, 20 bp, Artificial
  CRISPR gRNA sequence
cacctgcaacaacaggattc

SEQ ID NO: 20284 - DNA, 20 bp, Artificial
  CRISPR gRNA sequence
gatcccagctgtgctctgga

SEQ ID NO: 20285 - DNA, 20 bp, Artificial
  CRISPR gRNA sequence
tgtgctctggacagggtaac

SEQ ID NO: 20286 - DNA, 20 bp, Artificial
  CRISPR gRNA sequence
cttgggaggggagagccgca

SEQ ID NO: 20287 - DNA, 20 bp, Artificial
  CRISPR gRNA sequence
taccctgtccagagcacagc

SEQ ID NO: 20288 - DNA, 20 bp, Artificial
  CRISPR gRNA sequence
ggatcatctcaggctgatcc

SEQ ID NO: 20289 - DNA, 20 bp, Artificial
  CRISPR gRNA sequence
gttgcaggtgttcctggaca

SEQ ID NO: 20290 - DNA, 20 bp, Artificial
  CRISPR gRNA sequence
aggtgttcctggacactgaa

SEQ ID NO: 20291 - DNA, 20 bp, Artificial
  CRISPR gRNA sequence
ggcgtccacatcctgcaagg

SEQ ID NO: 20292 - DNA, 20 bp, Artificial
  CRISPR gRNA sequence
ctggcaagataccgaccggt

SEQ ID NO: 20293 - DNA, 20 bp, Artificial
  CRISPR gRNA sequence
ttattttcctcatctgtaaa

SEQ ID NO: 20294 - DNA, 20 bp, Artificial
  CRISPR gRNA sequence
ccctgtgcgtcttagaagag

SEQ ID NO: 20295 - DNA, 20 bp, Artificial
  CRISPR gRNA sequence
tggagataaaagtgctttga

SEQ ID NO: 20296 - DNA, 20 bp, Artificial
  CRISPR gRNA sequence
gccaattttacaggtcaaaa

SEQ ID NO: 20297 - DNA, 20 bp, Artificial
  CRISPR gRNA sequence
attttacaggtcaaaaatgg

SEQ ID NO: 20298 - DNA, 20 bp, Artificial
  CRISPR gRNA sequence
tttaagcctcacaaaacctc

SEQ ID NO: 20299 - DNA, 20 bp, Artificial
  CRISPR gRNA sequence
agcctcacaaaacctcttgg

SEQ ID NO: 20300 - DNA, 20 bp, Artificial
  CRISPR gRNA sequence
gggggaagtgtctgctcacc

SEQ ID NO: 20301 - DNA, 20 bp, Artificial
  CRISPR gRNA sequence
gaagagcatgatttgagctc

SEQ ID NO: 20302 - DNA, 20 bp, Artificial
  CRISPR gRNA sequence
cacactgggccacacgcctg

SEQ ID NO: 20303 - DNA, 20 bp, Artificial
  CRISPR gRNA sequence
ctgggccacacgcctgggga

SEQ ID NO: 20304 - DNA, 20 bp, Artificial
  CRISPR gRNA sequence
gtgagttgttctccacccac

SEQ ID NO: 20305 - DNA, 20 bp, Artificial
  CRISPR gRNA sequence
cggaaacagaggccaggggg

SEQ ID NO: 20306 - DNA, 20 bp, Artificial
  CRISPR gRNA sequence
gtcccactatccctggggga

SEQ ID NO: 20307 - DNA, 20 bp, Artificial
  CRISPR gRNA sequence
caagtacttacataggccat

SEQ ID NO: 20308 - DNA, 20 bp, Artificial
  CRISPR gRNA sequence
tagatatgaaaatagaggct

SEQ ID NO: 20309 - DNA, 20 bp, Artificial
  CRISPR gRNA sequence
tatgaaaatagaggctagga

SEQ ID NO: 20310 - DNA, 20 bp, Artificial
  CRISPR gRNA sequence
agggctgtggtgattgcttc

SEQ ID NO: 20311 - DNA, 20 bp, Artificial
  CRISPR gRNA sequence
agcctggaggtcagccccgt

SEQ ID NO: 20312 - DNA, 20 bp, Artificial
  CRISPR gRNA sequence
ccgtgggagtcaccacctac

SEQ ID NO: 20313 - DNA, 20 bp, Artificial
  CRISPR gRNA sequence
gacaggcaaaccaagaccca

SEQ ID NO: 20314 - DNA, 20 bp, Artificial
  CRISPR gRNA sequence
catctgtaaaatgggcatga

SEQ ID NO: 20315 - DNA, 20 bp, Artificial
  CRISPR gRNA sequence
atgatagagtcattgtgggg

SEQ ID NO: 20316 - DNA, 20 bp, Artificial
  CRISPR gRNA sequence
gtcattgtggggaggagtaa

SEQ ID NO: 20317 - DNA, 20 bp, Artificial
  CRISPR gRNA sequence
ttagaacatgccttggtgcc

SEQ ID NO: 20318 - DNA, 20 bp, Artificial
  CRISPR gRNA sequence
tacatcacaggaacattggt

SEQ ID NO: 20319 - DNA, 20 bp, Artificial
  CRISPR gRNA sequence
ggaacattggtgagggtcgc

SEQ ID NO: 20320 - DNA, 20 bp, Artificial
  CRISPR gRNA sequence
gggtcgcatgagttaacata

SEQ ID NO: 20321 - DNA, 20 bp, Artificial
  CRISPR gRNA sequence
gtagcagtgaaaatagcatg

SEQ ID NO: 20322 - DNA, 20 bp, Artificial
  CRISPR gRNA sequence
ttaacaggtcaggtgctgct

SEQ ID NO: 20323 - DNA, 20 bp, Artificial
  CRISPR gRNA sequence
ctaacactttggaggccgag

SEQ ID NO: 20324 - DNA, 20 bp, Artificial
  CRISPR gRNA sequence
cactttggaggccgaggcgg

SEQ ID NO: 20325 - DNA, 20 bp, Artificial
  CRISPR gRNA sequence
cgggtggatcacctaaggtc

SEQ ID NO: 20326 - DNA, 20 bp, Artificial
  CRISPR gRNA sequence
tactaaaaatacaaaattag

SEQ ID NO: 20327 - DNA, 20 bp, Artificial
  CRISPR gRNA sequence
tacttgagaggctgaggcag

SEQ ID NO: 20328 - DNA, 20 bp, Artificial
  CRISPR gRNA sequence
aattgcttgaactcgggagg

SEQ ID NO: 20329 - DNA, 20 bp, Artificial
  CRISPR gRNA sequence
caggtttacactgctgccaa

SEQ ID NO: 20330 - DNA, 20 bp, Artificial
  CRISPR gRNA sequence
aggctaaatcaactcacatc

SEQ ID NO: 20331 - DNA, 20 bp, Artificial
  CRISPR gRNA sequence
taccagtgcagaaactagat

SEQ ID NO: 20332 - DNA, 20 bp, Artificial
  CRISPR gRNA sequence
cccttcctccaccccacagg

SEQ ID NO: 20333 - DNA, 20 bp, Artificial
  CRISPR gRNA sequence
caagacatatatgtcaccat

SEQ ID NO: 20334 - DNA, 20 bp, Artificial
  CRISPR gRNA sequence
catttgaatatcattgagat

SEQ ID NO: 20335 - DNA, 20 bp, Artificial
  CRISPR gRNA sequence
tttgcattttggcctcatat

SEQ ID NO: 20336 - DNA, 20 bp, Artificial
  CRISPR gRNA sequence
cctcatattggggtcttaca

SEQ ID NO: 20337 - DNA, 20 bp, Artificial
  CRISPR gRNA sequence
atgaaatatgatgtttctta

SEQ ID NO: 20338 - DNA, 20 bp, Artificial
  CRISPR gRNA sequence
cagcactttggaaggctgag

SEQ ID NO: 20339 - DNA, 20 bp, Artificial
  CRISPR gRNA sequence
actttggaaggctgaggtgg

SEQ ID NO: 20340 - DNA, 20 bp, Artificial
  CRISPR gRNA sequence
gtgggtggatcgcttgggcc

SEQ ID NO: 20341 - DNA, 20 bp, Artificial
  CRISPR gRNA sequence
tacttgggaggctgaggcat

SEQ ID NO: 20342 - DNA, 20 bp, Artificial
  CRISPR gRNA sequence
caagggcctccctgtgtgat

SEQ ID NO: 20343 - DNA, 20 bp, Artificial
  CRISPR gRNA sequence
cacctgctgttctttcttcc

SEQ ID NO: 20344 - DNA, 20 bp, Artificial
  CRISPR gRNA sequence
tcccctagagcttcccacgg

SEQ ID NO: 20345 - DNA, 20 bp, Artificial
  CRISPR gRNA sequence
ttgttagtttccttcccagc

SEQ ID NO: 20346 - DNA, 20 bp, Artificial
  CRISPR gRNA sequence
gacagattctatttttgctt

SEQ ID NO: 20347 - DNA, 20 bp, Artificial
  CRISPR gRNA sequence
aagaaattaacaaggctcag

SEQ ID NO: 20348 - DNA, 20 bp, Artificial
  CRISPR gRNA sequence
ttgcacccctgcactacaac

SEQ ID NO: 20349 - DNA, 20 bp, Artificial
  CRISPR gRNA sequence
actttgggaggccgaggcag

SEQ ID NO: 20350 - DNA, 20 bp, Artificial
  CRISPR gRNA sequence
caggtggatcacctgagatc

SEQ ID NO: 20351 - DNA, 20 bp, Artificial
  CRISPR gRNA sequence
tactcggagcactgaggcag

SEQ ID NO: 20352 - DNA, 20 bp, Artificial
  CRISPR gRNA sequence
tcacaccacttcactccagc

SEQ ID NO: 20353 - DNA, 20 bp, Artificial
  CRISPR gRNA sequence
gaccaaatgccatctttcct

SEQ ID NO: 20354 - DNA, 20 bp, Artificial
  CRISPR gRNA sequence
gagcagtttctctcagtctg

SEQ ID NO: 20355 - DNA, 20 bp, Artificial
  CRISPR gRNA sequence
agtaagaagagctggtaatg

SEQ ID NO: 20356 - DNA, 20 bp, Artificial
  CRISPR gRNA sequence
gaagagctggtaatgctgag

SEQ ID NO: 20357 - DNA, 20 bp, Artificial
  CRISPR gRNA sequence
ctctgggaccacaccagggc

SEQ ID NO: 20358 - DNA, 20 bp, Artificial
  CRISPR gRNA sequence
caagtgcttacatagaccat

SEQ ID NO: 20359 - DNA, 20 bp, Artificial
  CRISPR gRNA sequence
caggtaagaaaacagcggct

SEQ ID NO: 20360 - DNA, 20 bp, Artificial
  CRISPR gRNA sequence
taagaaaacagcggctagga

SEQ ID NO: 20361 - DNA, 20 bp, Artificial
  CRISPR gRNA sequence
gaatgaataactgacttgct

SEQ ID NO: 20362 - DNA, 20 bp, Artificial
  CRISPR gRNA sequence
agggctgtggtgattgcttc

SEQ ID NO: 20363 - DNA, 20 bp, Artificial
  CRISPR gRNA sequence
tcccctgcagccagcacgat

SEQ ID NO: 20364 - DNA, 20 bp, Artificial
  CRISPR gRNA sequence
ccactcaccttagcctgagc

SEQ ID NO: 20365 - DNA, 20 bp, Artificial
  CRISPR gRNA sequence
cgagcgaaggcagggcctcg

SEQ ID NO: 20366 - DNA, 20 bp, Artificial
  CRISPR gRNA sequence
tgcctcactttgacctcaag

SEQ ID NO: 20367 - DNA, 20 bp, Artificial
  CRISPR gRNA sequence
ctttgacctcaaggagagtt

SEQ ID NO: 20368 - DNA, 20 bp, Artificial
  CRISPR gRNA sequence
agagttctgggtcataggct

SEQ ID NO: 20369 - DNA, 20 bp, Artificial
  CRISPR gRNA sequence
agctacctctcggtaaatag

SEQ ID NO: 20370 - DNA, 20 bp, Artificial
  CRISPR gRNA sequence
ctgtggccaagtgggagggc

SEQ ID NO: 20371 - DNA, 20 bp, Artificial
  CRISPR gRNA sequence
gggagggcagggatgaggag

SEQ ID NO: 20372 - DNA, 20 bp, Artificial
  CRISPR gRNA sequence
atgaggaggtggatgggagg

SEQ ID NO: 20373 - DNA, 20 bp, Artificial
  CRISPR gRNA sequence
tggctgtgtaatcctttctg

SEQ ID NO: 20374 - DNA, 20 bp, Artificial
  CRISPR gRNA sequence
gtgctcaataaatacttaag

SEQ ID NO: 20375 - DNA, 20 bp, Artificial
  CRISPR gRNA sequence
ataaatacttaagtggggtg

SEQ ID NO: 20376 - DNA, 20 bp, Artificial
  CRISPR gRNA sequence
ctaagaccttggttgtgagg

SEQ ID NO: 20377 - DNA, 20 bp, Artificial
  CRISPR gRNA sequence
actttgggaggctgaggtgg

SEQ ID NO: 20378 - DNA, 20 bp, Artificial
  CRISPR gRNA sequence
tgggcggatcacttgaggtc

SEQ ID NO: 20379 - DNA, 20 bp, Artificial
  CRISPR gRNA sequence
actaaaaatacaaaaattag

SEQ ID NO: 20380 - DNA, 20 bp, Artificial
  CRISPR gRNA sequence
tacttgggaggctgaggtgt

SEQ ID NO: 20381 - DNA, 20 bp, Artificial
  CRISPR gRNA sequence
actttgggaggcagaggcag

SEQ ID NO: 20382 - DNA, 20 bp, Artificial
  CRISPR gRNA sequence
tactcagaaggttgagatgg

SEQ ID NO: 20383 - DNA, 20 bp, Artificial
  CRISPR gRNA sequence
ttacaccactgcactccacc

SEQ ID NO: 20384 - DNA, 20 bp, Artificial
  CRISPR gRNA sequence
tgttcattgtgtctcctcac

SEQ ID NO: 20385 - DNA, 20 bp, Artificial
  CRISPR gRNA sequence
atttaagattcctgaggtca

SEQ ID NO: 20386 - DNA, 20 bp, Artificial
  CRISPR gRNA sequence
tttatttgttttgtttaaag

SEQ ID NO: 20387 - DNA, 20 bp, Artificial
  CRISPR gRNA sequence
ttgattaaattaataaatgg

SEQ ID NO: 20388 - DNA, 20 bp, Artificial
  CRISPR gRNA sequence
ttgggtaagtaaagaaatga

SEQ ID NO: 20389 - DNA, 20 bp, Artificial
  CRISPR gRNA sequence
agaaatgattgagtgagcgg

SEQ ID NO: 20390 - DNA, 20 bp, Artificial
  CRISPR gRNA sequence
ttgagtgagcggttggatga

SEQ ID NO: 20391 - DNA, 20 bp, Artificial
  CRISPR gRNA sequence
gtaaagaaatgactgcataa

SEQ ID NO: 20392 - DNA, 20 bp, Artificial
  CRISPR gRNA sequence
agaaatgactgcataagtga

SEQ ID NO: 20393 - DNA, 20 bp, Artificial
  CRISPR gRNA sequence
atgactgcataagtgaatgg

SEQ ID NO: 20394 - DNA, 20 bp, Artificial
  CRISPR gRNA sequence
ataagtgaatggatgaatca

SEQ ID NO: 20395 - DNA, 20 bp, Artificial
  CRISPR gRNA sequence
atggatgaatcattgaatgg

SEQ ID NO: 20396 - DNA, 20 bp, Artificial
  CRISPR gRNA sequence
atgaatcattgaatggaagg

SEQ ID NO: 20397 - DNA, 20 bp, Artificial
  CRISPR gRNA sequence
atggaaggatgaatggctga

SEQ ID NO: 20398 - DNA, 20 bp, Artificial
  CRISPR gRNA sequence
atgaatggctgattgaatag

SEQ ID NO: 20399 - DNA, 20 bp, Artificial
  CRISPR gRNA sequence
atggctgattgaataggtga

SEQ ID NO: 20400 - DNA, 20 bp, Artificial
  CRISPR gRNA sequence
ctgattgaataggtgaatga

SEQ ID NO: 20401 - DNA, 20 bp, Artificial
  CRISPR gRNA sequence
ttgaataggtgaatgagtga

SEQ ID NO: 20402 - DNA, 20 bp, Artificial
  CRISPR gRNA sequence
ataggtgaatgagtgaatgg

SEQ ID NO: 20403 - DNA, 20 bp, Artificial
  CRISPR gRNA sequence
tgaggagattccttgaggcc

SEQ ID NO: 20404 - DNA, 20 bp, Artificial
  CRISPR gRNA sequence
tcatagcactatattctagc

SEQ ID NO: 20405 - DNA, 20 bp, Artificial
  CRISPR gRNA sequence
caggcccagctcactcactt

SEQ ID NO: 20406 - DNA, 20 bp, Artificial
  CRISPR gRNA sequence
cagcgcatccaggctgcagg

SEQ ID NO: 20407 - DNA, 20 bp, Artificial
  CRISPR gRNA sequence
aagtctaactcatgatggac

SEQ ID NO: 20408 - DNA, 20 bp, Artificial
  CRISPR gRNA sequence
gctccccaatccctccccag

SEQ ID NO: 20409 - DNA, 20 bp, Artificial
  CRISPR gRNA sequence
gcaaatgaggttgtgaggaa

SEQ ID NO: 20410 - DNA, 20 bp, Artificial
  CRISPR gRNA sequence
aggagtttcaaaggtcacga

SEQ ID NO: 20411 - DNA, 20 bp, Artificial
  CRISPR gRNA sequence
ctacaactttttttgtcact

SEQ ID NO: 20412 - DNA, 20 bp, Artificial
  CRISPR gRNA sequence
actcatgtgccagccacatt

SEQ ID NO: 20413 - DNA, 20 bp, Artificial
  CRISPR gRNA sequence
ttctgcaggtgccttggggg

SEQ ID NO: 20414 - DNA, 20 bp, Artificial
  CRISPR gRNA sequence
ggtgccttgggggcaggatt

SEQ ID NO: 20415 - DNA, 20 bp, Artificial
  CRISPR gRNA sequence
caggaggactacttgaggcc

SEQ ID NO: 20416 - DNA, 20 bp, Artificial
  CRISPR gRNA sequence
gcacccagatgttgagagga

SEQ ID NO: 20417 - DNA, 20 bp, Artificial
  CRISPR gRNA sequence
atgttgagaggaaggggtcc

SEQ ID NO: 20418 - DNA, 20 bp, Artificial
  CRISPR gRNA sequence
tgcagggaggaaaaggccgt

SEQ ID NO: 20419 - DNA, 20 bp, Artificial
  CRISPR gRNA sequence
cagcctaggaggcaaagagc

SEQ ID NO: 20420 - DNA, 20 bp, Artificial
  CRISPR gRNA sequence
cacagcccctcattcagccc

SEQ ID NO: 20421 - DNA, 20 bp, Artificial
  CRISPR gRNA sequence
ggaccccaatcttttctgct

SEQ ID NO: 20422 - DNA, 20 bp, Artificial
  CRISPR gRNA sequence
taagaggactgcttgagccc

SEQ ID NO: 20423 - DNA, 20 bp, Artificial
  CRISPR gRNA sequence
tcgcttgagcccaggaggtg

SEQ ID NO: 20424 - DNA, 20 bp, Artificial
  CRISPR gRNA sequence
tcacaccactgcactccagc

SEQ ID NO: 20425 - DNA, 20 bp, Artificial
  CRISPR gRNA sequence
ctcccgccgcagcctgggga

SEQ ID NO: 20426 - DNA, 20 bp, Artificial
  CRISPR gRNA sequence
aggcgatcaaatagctcaca

SEQ ID NO: 20427 - DNA, 20 bp, Artificial
  CRISPR gRNA sequence
ctcacacagggtcacacagc

SEQ ID NO: 20428 - DNA, 20 bp, Artificial
  CRISPR gRNA sequence
acatttagagcagacttcaa

SEQ ID NO: 20429 - DNA, 20 bp, Artificial
  CRISPR gRNA sequence
cctttgaactttttcaatat

SEQ ID NO: 20430 - DNA, 20 bp, Artificial
  CRISPR gRNA sequence
gtaaaattatggtgccagca

SEQ ID NO: 20431 - DNA, 20 bp, Artificial
  CRISPR gRNA sequence
ttttgttgttatttgtttgt

SEQ ID NO: 20432 - DNA, 20 bp, Artificial
  CRISPR gRNA sequence
cagtaaccgcgcacggtcac

SEQ ID NO: 20433 - DNA, 20 bp, Artificial
  CRISPR gRNA sequence
ctggcctcagcaaaaggcca

SEQ ID NO: 20434 - DNA, 20 bp, Artificial
  CRISPR gRNA sequence
tcagcaaaaggccacaggat

SEQ ID NO: 20435 - DNA, 20 bp, Artificial
  CRISPR gRNA sequence
acaggatcagagtttgactc

SEQ ID NO: 20436 - DNA, 20 bp, Artificial
  CRISPR gRNA sequence
atatttcaccccaatcttat

SEQ ID NO: 20437 - DNA, 20 bp, Artificial
  CRISPR gRNA sequence
ccccaatcttatgggggttc

SEQ ID NO: 20438 - DNA, 20 bp, Artificial
  CRISPR gRNA sequence
cagacgaaaatccctgcctt

SEQ ID NO: 20439 - DNA, 20 bp, Artificial
  CRISPR gRNA sequence
gcaagctgatgtctgagaca

SEQ ID NO: 20440 - DNA, 20 bp, Artificial
  CRISPR gRNA sequence
tggaaatatacagtggtgag

SEQ ID NO: 20441 - DNA, 20 bp, Artificial
  CRISPR gRNA sequence
atatacagtggtgaggggga

SEQ ID NO: 20442 - DNA, 20 bp, Artificial
  CRISPR gRNA sequence
gttttttttttaaccatgag

SEQ ID NO: 20443 - DNA, 20 bp, Artificial
  CRISPR gRNA sequence
ttttttaaccatgaggggaa

SEQ ID NO: 20444 - DNA, 20 bp, Artificial
  CRISPR gRNA sequence
ttatttatttatttttgaga

SEQ ID NO: 20445 - DNA, 20 bp, Artificial
  CRISPR gRNA sequence
ttttgtatatttagtagaga

SEQ ID NO: 20446 - DNA, 20 bp, Artificial
  CRISPR gRNA sequence
gcctcggcctcccaaagtgc

SEQ ID NO: 20447 - DNA, 20 bp, Artificial
  CRISPR gRNA sequence
cataagccactgcgcctggc

SEQ ID NO: 20448 - DNA, 20 bp, Artificial
  CRISPR gRNA sequence
agagttttatttttaactgt

SEQ ID NO: 20449 - DNA, 20 bp, Artificial
  CRISPR gRNA sequence
cagaaaagacctcactgagg

SEQ ID NO: 20450 - DNA, 20 bp, Artificial
  CRISPR gRNA sequence
actttgggaggccgaggtgg

SEQ ID NO: 20451 - DNA, 20 bp, Artificial
  CRISPR gRNA sequence
tactcgggaggctgaggcaa

SEQ ID NO: 20452 - DNA, 20 bp, Artificial
  CRISPR gRNA sequence
cttgggaggaggaggttgca

SEQ ID NO: 20453 - DNA, 20 bp, Artificial
  CRISPR gRNA sequence
ttgtgccactgcactccagc

SEQ ID NO: 20454 - DNA, 20 bp, Artificial
  CRISPR gRNA sequence
aaagaaaagaaaaggcctca

SEQ ID NO: 20455 - DNA, 20 bp, Artificial
  CRISPR gRNA sequence
cagcaaggaggccctgtggc

SEQ ID NO: 20456 - DNA, 20 bp, Artificial
  CRISPR gRNA sequence
tggaatggagagagcaccca

SEQ ID NO: 20457 - DNA, 20 bp, Artificial
  CRISPR gRNA sequence
acccagcgagtgtaggagat

SEQ ID NO: 20458 - DNA, 20 bp, Artificial
  CRISPR gRNA sequence
taggagataagggtgaacag

SEQ ID NO: 20459 - DNA, 20 bp, Artificial
  CRISPR gRNA sequence
gtgtacaaacgaagtccctg

SEQ ID NO: 20460 - DNA, 20 bp, Artificial
  CRISPR gRNA sequence
aacgaagtccctgtagggtt

SEQ ID NO: 20461 - DNA, 20 bp, Artificial
  CRISPR gRNA sequence
tgacagacagatgaggtcta

SEQ ID NO: 20462 - DNA, 20 bp, Artificial
  CRISPR gRNA sequence
tcagggagagctgatagctt

SEQ ID NO: 20463 - DNA, 20 bp, Artificial
  CRISPR gRNA sequence
gagattatatataaaatgca

SEQ ID NO: 20464 - DNA, 20 bp, Artificial
  CRISPR gRNA sequence
tgggaggaacatctgaggcc

SEQ ID NO: 20465 - DNA, 20 bp, Artificial
  CRISPR gRNA sequence
tcataccactgcattctagc

SEQ ID NO: 20466 - DNA, 20 bp, Artificial
  CRISPR gRNA sequence
atctccaaaaaaaaacagca

SEQ ID NO: 20467 - DNA, 20 bp, Artificial
  CRISPR gRNA sequence
ctgacctgacctttatgact

SEQ ID NO: 20468 - DNA, 20 bp, Artificial
  CRISPR gRNA sequence
tgatgacaatgcctgtagag

SEQ ID NO: 20469 - DNA, 20 bp, Artificial
  CRISPR gRNA sequence
actttgggaggctgaggtgg

SEQ ID NO: 20470 - DNA, 20 bp, Artificial
  CRISPR gRNA sequence
tactagggaggctgaggtgg

SEQ ID NO: 20471 - DNA, 20 bp, Artificial
  CRISPR gRNA sequence
ctgaactccagcctgaggga

SEQ ID NO: 20472 - DNA, 20 bp, Artificial
  CRISPR gRNA sequence
gggaaggaaagagaaagaaa

SEQ ID NO: 20473 - DNA, 20 bp, Artificial
  CRISPR gRNA sequence
gtcaccccagcaacactgcc

SEQ ID NO: 20474 - DNA, 20 bp, Artificial
  CRISPR gRNA sequence
cctgggactaaggggcttct

SEQ ID NO: 20475 - DNA, 20 bp, Artificial
  CRISPR gRNA sequence
aagactttcagttttcaaac

SEQ ID NO: 20476 - DNA, 20 bp, Artificial
  CRISPR gRNA sequence
ccaggatagtcccaggcaag

SEQ ID NO: 20477 - DNA, 20 bp, Artificial
  CRISPR gRNA sequence
gctgcacatcaaaagctcct

SEQ ID NO: 20478 - DNA, 20 bp, Artificial
  CRISPR gRNA sequence
ccccctgacctcctccagag

SEQ ID NO: 20479 - DNA, 20 bp, Artificial
  CRISPR gRNA sequence
tcaagtgctcaatacctctg

SEQ ID NO: 20480 - DNA, 20 bp, Artificial
  CRISPR gRNA sequence
gtgctcaatacctctgttga

SEQ ID NO: 20481 - DNA, 20 bp, Artificial
  CRISPR gRNA sequence
acctctgttgaatgagtgat

SEQ ID NO: 20482 - DNA, 20 bp, Artificial
  CRISPR gRNA sequence
atgaccatgttaaccagcaa

SEQ ID NO: 20483 - DNA, 20 bp, Artificial
  CRISPR gRNA sequence
atttccaaagtggtgggcaa

SEQ ID NO: 20484 - DNA, 20 bp, Artificial
  CRISPR gRNA sequence
aaagtggtgggcaagagggt

SEQ ID NO: 20485 - DNA, 20 bp, Artificial
  CRISPR gRNA sequence
ctgtcactgagcccttaccc

SEQ ID NO: 20486 - DNA, 20 bp, Artificial
  CRISPR gRNA sequence
cagtgccccaaattccccag

SEQ ID NO: 20487 - DNA, 20 bp, Artificial
  CRISPR gRNA sequence
tcttaaaaaaaaagatctgt

SEQ ID NO: 20488 - DNA, 20 bp, Artificial
  CRISPR gRNA sequence
actttgggaggctgaggcag

SEQ ID NO: 20489 - DNA, 20 bp, Artificial
  CRISPR gRNA sequence
caggaggattgcttgaggcc

SEQ ID NO: 20490 - DNA, 20 bp, Artificial
  CRISPR gRNA sequence
tacttgggaggctgaggcag

SEQ ID NO: 20491 - DNA, 20 bp, Artificial
  CRISPR gRNA sequence
caggaggatcgcttgagctc

SEQ ID NO: 20492 - DNA, 20 bp, Artificial
  CRISPR gRNA sequence
gctcaaacaatgtgtgatga

SEQ ID NO: 20493 - DNA, 20 bp, Artificial
  CRISPR gRNA sequence
aaacaatgtgtgatgaagga

SEQ ID NO: 20494 - DNA, 20 bp, Artificial
  CRISPR gRNA sequence
cagttgtcctaaatgcctca

SEQ ID NO: 20495 - DNA, 20 bp, Artificial
  CRISPR gRNA sequence
tgggcacatgatggcaggtt

SEQ ID NO: 20496 - DNA, 20 bp, Artificial
  CRISPR gRNA sequence
ctagaggctccgcctgggca

SEQ ID NO: 20497 - DNA, 20 bp, Artificial
  CRISPR gRNA sequence
cattgcccagaaagagggca

SEQ ID NO: 20498 - DNA, 20 bp, Artificial
  CRISPR gRNA sequence
gaaatgcccatgacaaactt

SEQ ID NO: 20499 - DNA, 20 bp, Artificial
  CRISPR gRNA sequence
tgcccatgacaaacttgaga

SEQ ID NO: 20500 - DNA, 20 bp, Artificial
  CRISPR gRNA sequence
atccgcctctcctctcacct

SEQ ID NO: 20501 - DNA, 20 bp, Artificial
  CRISPR gRNA sequence
aatggaagggcagctccatg

SEQ ID NO: 20502 - DNA, 20 bp, Artificial
  CRISPR gRNA sequence
attatgtaggaccttacagc

SEQ ID NO: 20503 - DNA, 20 bp, Artificial
  CRISPR gRNA sequence
gacttaatgaaaccaaatta

SEQ ID NO: 20504 - DNA, 20 bp, Artificial
  CRISPR gRNA sequence
agccttcatcctgacagtgg

SEQ ID NO: 20505 - DNA, 20 bp, Artificial
  CRISPR gRNA sequence
acagtggtggagtgtccctg

SEQ ID NO: 20506 - DNA, 20 bp, Artificial
  CRISPR gRNA sequence
gtccctgaaggattgtaagc

SEQ ID NO: 20507 - DNA, 20 bp, Artificial
  CRISPR gRNA sequence
tgaaggattgtaagcaggga

SEQ ID NO: 20508 - DNA, 20 bp, Artificial
  CRISPR gRNA sequence
tgagaagattggtctggttg

SEQ ID NO: 20509 - DNA, 20 bp, Artificial
  CRISPR gRNA sequence
tctggttgctgaatacaaaa

SEQ ID NO: 20510 - DNA, 20 bp, Artificial
  CRISPR gRNA sequence
caaaatggagtggaagagga

SEQ ID NO: 20511 - DNA, 20 bp, Artificial
  CRISPR gRNA sequence
aagaggagagaatggaggca

SEQ ID NO: 20512 - DNA, 20 bp, Artificial
  CRISPR gRNA sequence
agaaaacggtggcgtgctca

SEQ ID NO: 20513 - DNA, 20 bp, Artificial
  CRISPR gRNA sequence
tggcgtgctcagggggtgga

SEQ ID NO: 20514 - DNA, 20 bp, Artificial
  CRISPR gRNA sequence
ggccttcaaatattgactgg

SEQ ID NO: 20515 - DNA, 20 bp, Artificial
  CRISPR gRNA sequence
atcctcatcttaaaaatgga

SEQ ID NO: 20516 - DNA, 20 bp, Artificial
  CRISPR gRNA sequence
ccgcagttaatgcccaacac

SEQ ID NO: 20517 - DNA, 20 bp, Artificial
  CRISPR gRNA sequence
agcccctcaccccacctgaa

SEQ ID NO: 20518 - DNA, 20 bp, Artificial
  CRISPR gRNA sequence
acctgaaacgggtgacacag

SEQ ID NO: 20519 - DNA, 20 bp, Artificial
  CRISPR gRNA sequence
tgtgcatcaggaggcgtgag

SEQ ID NO: 20520 - DNA, 20 bp, Artificial
  CRISPR gRNA sequence
ccgaggcagccgccgatggc

SEQ ID NO: 20521 - DNA, 20 bp, Artificial
  CRISPR gRNA sequence
tcatagggcctcttcttcct

SEQ ID NO: 20522 - DNA, 20 bp, Artificial
  CRISPR gRNA sequence
ctcggactctgcggcccgcg

SEQ ID NO: 20523 - DNA, 20 bp, Artificial
  CRISPR gRNA sequence
tcgcccaggtcctcacgtct

SEQ ID NO: 20524 - DNA, 20 bp, Artificial
  CRISPR gRNA sequence
gatgggaactggtcctcctg

SEQ ID NO: 20525 - DNA, 20 bp, Artificial
  CRISPR gRNA sequence
cacggcccagcaggccgaca

SEQ ID NO: 20526 - DNA, 20 bp, Artificial
  CRISPR gRNA sequence
cggggccgggctgtgaggag

SEQ ID NO: 20527 - DNA, 20 bp, Artificial
  CRISPR gRNA sequence
tccagctcctcgaagccgtc

SEQ ID NO: 20528 - DNA, 20 bp, Artificial
  CRISPR gRNA sequence
tgaaaacctcatcggccgcc

SEQ ID NO: 20529 - DNA, 20 bp, Artificial
  CRISPR gRNA sequence
agctgccgttctgcccagtc

SEQ ID NO: 20530 - DNA, 20 bp, Artificial
  CRISPR gRNA sequence
tgcaccagatccacctccac

SEQ ID NO: 20531 - DNA, 20 bp, Artificial
  CRISPR gRNA sequence
tgcaaaggccaggggcgtgt

SEQ ID NO: 20532 - DNA, 20 bp, Artificial
  CRISPR gRNA sequence
ggccaggggcgtgtcagggt

SEQ ID NO: 20533 - DNA, 20 bp, Artificial
  CRISPR gRNA sequence
tgttttgttttgttttgaga

SEQ ID NO: 20534 - DNA, 20 bp, Artificial
  CRISPR gRNA sequence
tctggcttttttgcccaggc

SEQ ID NO: 20535 - DNA, 20 bp, Artificial
  CRISPR gRNA sequence
ttttgatttttttgtagaga

SEQ ID NO: 20536 - DNA, 20 bp, Artificial
  CRISPR gRNA sequence
aatcctcccacctcagcctc

SEQ ID NO: 20537 - DNA, 20 bp, Artificial
  CRISPR gRNA sequence
gccttggcctcccaaagtgc

SEQ ID NO: 20538 - DNA, 20 bp, Artificial
  CRISPR gRNA sequence
ctctcttttttttttttgag

SEQ ID NO: 20539 - DNA, 20 bp, Artificial
  CRISPR gRNA sequence
tcctgccctgtgccccaggc

SEQ ID NO: 20540 - DNA, 20 bp, Artificial
  CRISPR gRNA sequence
ctcacggcaacctccacctc

SEQ ID NO: 20541 - DNA, 20 bp, Artificial
  CRISPR gRNA sequence
gcctcggcctgccaagtagc

SEQ ID NO: 20542 - DNA, 20 bp, Artificial
  CRISPR gRNA sequence
tttgtattttttaatggaga

SEQ ID NO: 20543 - DNA, 20 bp, Artificial
  CRISPR gRNA sequence
gccttggcctcccaaagtgc

SEQ ID NO: 20544 - DNA, 20 bp, Artificial
  CRISPR gRNA sequence
accatggggaggtcatggga

SEQ ID NO: 20545 - DNA, 20 bp, Artificial
  CRISPR gRNA sequence
aggtcatgggagggagtgtt

SEQ ID NO: 20546 - DNA, 20 bp, Artificial
  CRISPR gRNA sequence
agacagtggagcccacgtgt

SEQ ID NO: 20547 - DNA, 20 bp, Artificial
  CRISPR gRNA sequence
agtagcctcatctggaaaat

SEQ ID NO: 20548 - DNA, 20 bp, Artificial
  CRISPR gRNA sequence
ctggaaaatggggataatat

SEQ ID NO: 20549 - DNA, 20 bp, Artificial
  CRISPR gRNA sequence
acatgcttagaccagtatgt

SEQ ID NO: 20550 - DNA, 20 bp, Artificial
  CRISPR gRNA sequence
gggcaataaatattatttga

SEQ ID NO: 20551 - DNA, 20 bp, Artificial
  CRISPR gRNA sequence
aatattatttgagggagtgg

SEQ ID NO: 20552 - DNA, 20 bp, Artificial
  CRISPR gRNA sequence
ttatttgagggagtggtgga

SEQ ID NO: 20553 - DNA, 20 bp, Artificial
  CRISPR gRNA sequence
atgatggcataatcaaataa

SEQ ID NO: 20554 - DNA, 20 bp, Artificial
  CRISPR gRNA sequence
tggcataatcaaataagtga

SEQ ID NO: 20555 - DNA, 20 bp, Artificial
  CRISPR gRNA sequence
ataatcaaataagtgaatga

SEQ ID NO: 20556 - DNA, 20 bp, Artificial
  CRISPR gRNA sequence
tcaaataagtgaatgaatga

SEQ ID NO: 20557 - DNA, 20 bp, Artificial
  CRISPR gRNA sequence
ataagtgaatgaatgaatga

SEQ ID NO: 20558 - DNA, 20 bp, Artificial
  CRISPR gRNA sequence
atgaatgaatgaataaataa

SEQ ID NO: 20559 - DNA, 20 bp, Artificial
  CRISPR gRNA sequence
agtgtgtgagccaacaaaga

SEQ ID NO: 20560 - DNA, 20 bp, Artificial
  CRISPR gRNA sequence
gtgagccaacaaagaagggg

SEQ ID NO: 20561 - DNA, 20 bp, Artificial
  CRISPR gRNA sequence
aggggttgaataagtgtcaa

SEQ ID NO: 20562 - DNA, 20 bp, Artificial
  CRISPR gRNA sequence
acctctccagctgccgggca

SEQ ID NO: 20563 - DNA, 20 bp, Artificial
  CRISPR gRNA sequence
ggagaagcaggtgccagatt

SEQ ID NO: 20564 - DNA, 20 bp, Artificial
  CRISPR gRNA sequence
gcaggtgccagatttagggt

SEQ ID NO: 20565 - DNA, 20 bp, Artificial
  CRISPR gRNA sequence
gtccttacagccttcatggg

SEQ ID NO: 20566 - DNA, 20 bp, Artificial
  CRISPR gRNA sequence
aagaaaatcgcaatatcagg

SEQ ID NO: 20567 - DNA, 20 bp, Artificial
  CRISPR gRNA sequence
actttgggaggtcgaggcag

SEQ ID NO: 20568 - DNA, 20 bp, Artificial
  CRISPR gRNA sequence
caggtggatcacttgagatc

SEQ ID NO: 20569 - DNA, 20 bp, Artificial
  CRISPR gRNA sequence
actgaaattacaaaaattgg

SEQ ID NO: 20570 - DNA, 20 bp, Artificial
  CRISPR gRNA sequence
tgctccggaggctgaggcag

SEQ ID NO: 20571 - DNA, 20 bp, Artificial
  CRISPR gRNA sequence
ctgcactctagcctgggcaa

SEQ ID NO: 20572 - DNA, 20 bp, Artificial
  CRISPR gRNA sequence
cacaatatctatgtaaaaat

SEQ ID NO: 20573 - DNA, 20 bp, Artificial
  CRISPR gRNA sequence
cacattgtctggcttttctg

SEQ ID NO: 20574 - DNA, 20 bp, Artificial
  CRISPR gRNA sequence
ctgaaggctgatggctgtat

SEQ ID NO: 20575 - DNA, 20 bp, Artificial
  CRISPR gRNA sequence
ggctgatggctgtatttgga

SEQ ID NO: 20576 - DNA, 20 bp, Artificial
  CRISPR gRNA sequence
tggctgtatttggatgggat

SEQ ID NO: 20577 - DNA, 20 bp, Artificial
  CRISPR gRNA sequence
ccctacaggcagctttgctt

SEQ ID NO: 20578 - DNA, 20 bp, Artificial
  CRISPR gRNA sequence
tagtacctctcacaggccct

SEQ ID NO: 20579 - DNA, 20 bp, Artificial
  CRISPR gRNA sequence
atgttgggaggccgtggaca

SEQ ID NO: 20580 - DNA, 20 bp, Artificial
  CRISPR gRNA sequence
ggacagtgaatccactggga

SEQ ID NO: 20581 - DNA, 20 bp, Artificial
  CRISPR gRNA sequence
tggggcacctcacctacatt

SEQ ID NO: 20582 - DNA, 20 bp, Artificial
  CRISPR gRNA sequence
cctcacctacattgggggtg

SEQ ID NO: 20583 - DNA, 20 bp, Artificial
  CRISPR gRNA sequence
ttgggggtggagagtggtgt

SEQ ID NO: 20584 - DNA, 20 bp, Artificial
  CRISPR gRNA sequence
tattgattccagaaatgcac

SEQ ID NO: 20585 - DNA, 20 bp, Artificial
  CRISPR gRNA sequence
ctcaggaagtctggagagaa

SEQ ID NO: 20586 - DNA, 20 bp, Artificial
  CRISPR gRNA sequence
cagagctgaagaaagagctc

SEQ ID NO: 20587 - DNA, 20 bp, Artificial
  CRISPR gRNA sequence
ttgcttttccaatctgtgaa

SEQ ID NO: 20588 - DNA, 20 bp, Artificial
  CRISPR gRNA sequence
actgaaactgtcttgcaacc

SEQ ID NO: 20589 - DNA, 20 bp, Artificial
  CRISPR gRNA sequence
aaactgtcttgcaaccagga

SEQ ID NO: 20590 - DNA, 20 bp, Artificial
  CRISPR gRNA sequence
caggaatggatgctctggac

SEQ ID NO: 20591 - DNA, 20 bp, Artificial
  CRISPR gRNA sequence
agtcacaacccctcagtgtg

SEQ ID NO: 20592 - DNA, 20 bp, Artificial
  CRISPR gRNA sequence
caaatcagagaaagctatgc

SEQ ID NO: 20593 - DNA, 20 bp, Artificial
  CRISPR gRNA sequence
tattcacatcagtatactaa

SEQ ID NO: 20594 - DNA, 20 bp, Artificial
  CRISPR gRNA sequence
ctaaaagagtgagagagaca

SEQ ID NO: 20595 - DNA, 20 bp, Artificial
  CRISPR gRNA sequence
aaaaaaaataaggaaaaact

SEQ ID NO: 20596 - DNA, 20 bp, Artificial
  CRISPR gRNA sequence
tcatgcacccagaccacctc

SEQ ID NO: 20597 - DNA, 20 bp, Artificial
  CRISPR gRNA sequence
agaaagttgtgctggggagg

SEQ ID NO: 20598 - DNA, 20 bp, Artificial
  CRISPR gRNA sequence
gggcaccactgccaagtgca

SEQ ID NO: 20599 - DNA, 20 bp, Artificial
  CRISPR gRNA sequence
ccaagtgcatggagtatggg

SEQ ID NO: 20600 - DNA, 20 bp, Artificial
  CRISPR gRNA sequence
ccccgcactcaccatggtag

SEQ ID NO: 20601 - DNA, 20 bp, Artificial
  CRISPR gRNA sequence
atttgccagagcccatgggg

SEQ ID NO: 20602 - DNA, 20 bp, Artificial
  CRISPR gRNA sequence
gtggagatggtggggacaaa

SEQ ID NO: 20603 - DNA, 20 bp, Artificial
  CRISPR gRNA sequence
agatggtggggacaaactgg

SEQ ID NO: 20604 - DNA, 20 bp, Artificial
  CRISPR gRNA sequence
aagagacaaaggcagtgagg

SEQ ID NO: 20605 - DNA, 20 bp, Artificial
  CRISPR gRNA sequence
ctgtttctgtcctgccctga

SEQ ID NO: 20606 - DNA, 20 bp, Artificial
  CRISPR gRNA sequence
gctccatgaagagctgatga

SEQ ID NO: 20607 - DNA, 20 bp, Artificial
  CRISPR gRNA sequence
tgaacgaataaggctggcag

SEQ ID NO: 20608 - DNA, 20 bp, Artificial
  CRISPR gRNA sequence
gattccctcctgatgctcgc

SEQ ID NO: 20609 - DNA, 20 bp, Artificial
  CRISPR gRNA sequence
tctgaggcatgttctctgcc

SEQ ID NO: 20610 - DNA, 20 bp, Artificial
  CRISPR gRNA sequence
attgagctgacgggggcccc

SEQ ID NO: 20611 - DNA, 20 bp, Artificial
  CRISPR gRNA sequence
taaaactggctggggcagag

SEQ ID NO: 20612 - DNA, 20 bp, Artificial
  CRISPR gRNA sequence
gcagaggtgagtgacactga

SEQ ID NO: 20613 - DNA, 20 bp, Artificial
  CRISPR gRNA sequence
tccaagccccctaacatact

SEQ ID NO: 20614 - DNA, 20 bp, Artificial
  CRISPR gRNA sequence
gcaggcagtggcaggcaggg

SEQ ID NO: 20615 - DNA, 20 bp, Artificial
  CRISPR gRNA sequence
gaagtgggctgtgttagaga

SEQ ID NO: 20616 - DNA, 20 bp, Artificial
  CRISPR gRNA sequence
ggtgcttggaggggccttcc

SEQ ID NO: 20617 - DNA, 20 bp, Artificial
  CRISPR gRNA sequence
tcctgggatggggagggccc

SEQ ID NO: 20618 - DNA, 20 bp, Artificial
  CRISPR gRNA sequence
ggggagggccctggagtggc

SEQ ID NO: 20619 - DNA, 20 bp, Artificial
  CRISPR gRNA sequence
ctccacacggagagctgggg

SEQ ID NO: 20620 - DNA, 20 bp, Artificial
  CRISPR gRNA sequence
atccccatcagacttgggcc

SEQ ID NO: 20621 - DNA, 20 bp, Artificial
  CRISPR gRNA sequence
gtgatcagctgccccaggga

SEQ ID NO: 20622 - DNA, 20 bp, Artificial
  CRISPR gRNA sequence
atacggccttaacttcaagg

SEQ ID NO: 20623 - DNA, 20 bp, Artificial
  CRISPR gRNA sequence
caaggctgggtagtggtctt

SEQ ID NO: 20624 - DNA, 20 bp, Artificial
  CRISPR gRNA sequence
cagtgtagcagcagaagagg

SEQ ID NO: 20625 - DNA, 20 bp, Artificial
  CRISPR gRNA sequence
gtcacaaatggggacacaac

SEQ ID NO: 20626 - DNA, 20 bp, Artificial
  CRISPR gRNA sequence
tgatctcacatctatgaaat

SEQ ID NO: 20627 - DNA, 20 bp, Artificial
  CRISPR gRNA sequence
ggtggtggttcctacattgc

SEQ ID NO: 20628 - DNA, 20 bp, Artificial
  CRISPR gRNA sequence
caggagtatgccagaaatca

SEQ ID NO: 20629 - DNA, 20 bp, Artificial
  CRISPR gRNA sequence
agtatgccagaaatcagtga

SEQ ID NO: 20630 - DNA, 20 bp, Artificial
  CRISPR gRNA sequence
cactgcatggccttaaaaga

SEQ ID NO: 20631 - DNA, 20 bp, Artificial
  CRISPR gRNA sequence
aggatgctgaagtacacgag

SEQ ID NO: 20632 - DNA, 20 bp, Artificial
  CRISPR gRNA sequence
tgaaatgtaccaaaaatata

SEQ ID NO: 20633 - DNA, 20 bp, Artificial
  CRISPR gRNA sequence
atgtaccaaaaatataatga

SEQ ID NO: 20634 - DNA, 20 bp, Artificial
  CRISPR gRNA sequence
aaaatataatgaatgggtgt

SEQ ID NO: 20635 - DNA, 20 bp, Artificial
  CRISPR gRNA sequence
tataatgaatgggtgtgtgg

SEQ ID NO: 20636 - DNA, 20 bp, Artificial
  CRISPR gRNA sequence
atgggtgtgtggatggatag

SEQ ID NO: 20637 - DNA, 20 bp, Artificial
  CRISPR gRNA sequence
atggatagagggatggacag

SEQ ID NO: 20638 - DNA, 20 bp, Artificial
  CRISPR gRNA sequence
atgaatagagatgtgataag

SEQ ID NO: 20639 - DNA, 20 bp, Artificial
  CRISPR gRNA sequence
ataaaacccaacattaattg

SEQ ID NO: 20640 - DNA, 20 bp, Artificial
  CRISPR gRNA sequence
tagaatcaaaatggtacatg

SEQ ID NO: 20641 - DNA, 20 bp, Artificial
  CRISPR gRNA sequence
atttttttttttttttgaaa

SEQ ID NO: 20642 - DNA, 20 bp, Artificial
  CRISPR gRNA sequence
tctagctctgttgcccaggc

SEQ ID NO: 20643 - DNA, 20 bp, Artificial
  CRISPR gRNA sequence
accctagcctccctggtagc

SEQ ID NO: 20644 - DNA, 20 bp, Artificial
  CRISPR gRNA sequence
ttttgtatttttagtagaga

SEQ ID NO: 20645 - DNA, 20 bp, Artificial
  CRISPR gRNA sequence
gccttggcctcccaaagtgc

SEQ ID NO: 20646 - DNA, 20 bp, Artificial
  CRISPR gRNA sequence
ggaacgtgacctcccagaca

SEQ ID NO: 20647 - DNA, 20 bp, Artificial
  CRISPR gRNA sequence
taaatgaagaaagcaaaatg

SEQ ID NO: 20648 - DNA, 20 bp, Artificial
  CRISPR gRNA sequence
aaactgagggactacagaac

SEQ ID NO: 20649 - DNA, 20 bp, Artificial
  CRISPR gRNA sequence
ggagggagatttttttttca

SEQ ID NO: 20650 - DNA, 20 bp, Artificial
  CRISPR gRNA sequence
ttggttgttgttgtttgaga

SEQ ID NO: 20651 - DNA, 20 bp, Artificial
  CRISPR gRNA sequence
tcttactctgccacccaggc

SEQ ID NO: 20652 - DNA, 20 bp, Artificial
  CRISPR gRNA sequence
ctcactgcaacctccacctc

SEQ ID NO: 20653 - DNA, 20 bp, Artificial
  CRISPR gRNA sequence
gattctcctgcctcagcctc

SEQ ID NO: 20654 - DNA, 20 bp, Artificial
  CRISPR gRNA sequence
gcctcagcctcccgagtagc

SEQ ID NO: 20655 - DNA, 20 bp, Artificial
  CRISPR gRNA sequence
cccttggcctcccaaactgc

SEQ ID NO: 20656 - DNA, 20 bp, Artificial
  CRISPR gRNA sequence
gccgctgcgcccagccttca

SEQ ID NO: 20657 - DNA, 20 bp, Artificial
  CRISPR gRNA sequence
gcgattcacctgtttaagaa

SEQ ID NO: 20658 - DNA, 20 bp, Artificial
  CRISPR gRNA sequence
taaaatatgtccagatggta

SEQ ID NO: 20659 - DNA, 20 bp, Artificial
  CRISPR gRNA sequence
aggaaaaagacacacaaggt

SEQ ID NO: 20660 - DNA, 20 bp, Artificial
  CRISPR gRNA sequence
aactgagctaatctacatgg

SEQ ID NO: 20661 - DNA, 20 bp, Artificial
  CRISPR gRNA sequence
acatggaaggatggtcagag

SEQ ID NO: 20662 - DNA, 20 bp, Artificial
  CRISPR gRNA sequence
ccaacaccagaaagattcaa

SEQ ID NO: 20663 - DNA, 20 bp, Artificial
  CRISPR gRNA sequence
cccgaggcttgaaagggcac

SEQ ID NO: 20664 - DNA, 20 bp, Artificial
  CRISPR gRNA sequence
tgaaagggcacatgggttat

SEQ ID NO: 20665 - DNA, 20 bp, Artificial
  CRISPR gRNA sequence
ctgaagtgtggtgtctcata

SEQ ID NO: 20666 - DNA, 20 bp, Artificial
  CRISPR gRNA sequence
catgtattttgtagccattg

SEQ ID NO: 20667 - DNA, 20 bp, Artificial
  CRISPR gRNA sequence
gttggacccacagcaggctt

SEQ ID NO: 20668 - DNA, 20 bp, Artificial
  CRISPR gRNA sequence
aggtctcaagcaaggctagg

SEQ ID NO: 20669 - DNA, 20 bp, Artificial
  CRISPR gRNA sequence
acaatcaatgaaagcccaag

SEQ ID NO: 20670 - DNA, 20 bp, Artificial
  CRISPR gRNA sequence
attgtacccaccttggggag

SEQ ID NO: 20671 - DNA, 20 bp, Artificial
  CRISPR gRNA sequence
aggggtctgactgcccatca

SEQ ID NO: 20672 - DNA, 20 bp, Artificial
  CRISPR gRNA sequence
cttgctcaggccctccagct

SEQ ID NO: 20673 - DNA, 20 bp, Artificial
  CRISPR gRNA sequence
ggggactcaagaaatgtttg

SEQ ID NO: 20674 - DNA, 20 bp, Artificial
  CRISPR gRNA sequence
actcaagaaatgtttgttga

SEQ ID NO: 20675 - DNA, 20 bp, Artificial
  CRISPR gRNA sequence
aagaaatgtttgttgaatga

SEQ ID NO: 20676 - DNA, 20 bp, Artificial
  CRISPR gRNA sequence
atgaatgaatgatcaaacaa

SEQ ID NO: 20677 - DNA, 20 bp, Artificial
  CRISPR gRNA sequence
ggggcccttaatctaatcaa

SEQ ID NO: 20678 - DNA, 20 bp, Artificial
  CRISPR gRNA sequence
tgctacaaagaagagcaagg

SEQ ID NO: 20679 - DNA, 20 bp, Artificial
  CRISPR gRNA sequence
agaagagcaaggcagaatgg

SEQ ID NO: 20680 - DNA, 20 bp, Artificial
  CRISPR gRNA sequence
gcagaatggtagagttactg

SEQ ID NO: 20681 - DNA, 20 bp, Artificial
  CRISPR gRNA sequence
tggtagagttactgcaggat

SEQ ID NO: 20682 - DNA, 20 bp, Artificial
  CRISPR gRNA sequence
cattttctcatctgtgtaag

SEQ ID NO: 20683 - DNA, 20 bp, Artificial
  CRISPR gRNA sequence
ataaataatgcctactaccc

SEQ ID NO: 20684 - DNA, 20 bp, Artificial
  CRISPR gRNA sequence
aaatagtggtaactatataa

SEQ ID NO: 20685 - DNA, 20 bp, Artificial
  CRISPR gRNA sequence
ggtacatggctcagagccct

SEQ ID NO: 20686 - DNA, 20 bp, Artificial
  CRISPR gRNA sequence
ccgagaaaaaaggtgtatgg

SEQ ID NO: 20687 - DNA, 20 bp, Artificial
  CRISPR gRNA sequence
agggaaggcttcctggagga

SEQ ID NO: 20688 - DNA, 20 bp, Artificial
  CRISPR gRNA sequence
ccaggccttgaaagatgagg

SEQ ID NO: 20689 - DNA, 20 bp, Artificial
  CRISPR gRNA sequence
gaaggagaacagatagcttt

SEQ ID NO: 20690 - DNA, 20 bp, Artificial
  CRISPR gRNA sequence
agctttctgggtcacagtgg

SEQ ID NO: 20691 - DNA, 20 bp, Artificial
  CRISPR gRNA sequence
gcagagtgaggaaacttgtt

SEQ ID NO: 20692 - DNA, 20 bp, Artificial
  CRISPR gRNA sequence
catagaaggcttctgagctg

SEQ ID NO: 20693 - DNA, 20 bp, Artificial
  CRISPR gRNA sequence
aaggcttctgagctgaggaa

SEQ ID NO: 20694 - DNA, 20 bp, Artificial
  CRISPR gRNA sequence
aataatgataacggtggttg

SEQ ID NO: 20695 - DNA, 20 bp, Artificial
  CRISPR gRNA sequence
ggggtagtacctaacatcta

SEQ ID NO: 20696 - DNA, 20 bp, Artificial
  CRISPR gRNA sequence
cttacaaccatcccgtgatg

SEQ ID NO: 20697 - DNA, 20 bp, Artificial
  CRISPR gRNA sequence
tagaagctaaggtcatattt

SEQ ID NO: 20698 - DNA, 20 bp, Artificial
  CRISPR gRNA sequence
catatttcaggatgctgcaa

SEQ ID NO: 20699 - DNA, 20 bp, Artificial
  CRISPR gRNA sequence
cacagacttgaggagcagac

SEQ ID NO: 20700 - DNA, 20 bp, Artificial
  CRISPR gRNA sequence
gtgaagctgcctgttatgac

SEQ ID NO: 20701 - DNA, 20 bp, Artificial
  CRISPR gRNA sequence
gtgactggggcttttccttg

SEQ ID NO: 20702 - DNA, 20 bp, Artificial
  CRISPR gRNA sequence
ctggggcttttccttgatga

SEQ ID NO: 20703 - DNA, 20 bp, Artificial
  CRISPR gRNA sequence
atgaatgggttaatccgttc

SEQ ID NO: 20704 - DNA, 20 bp, Artificial
  CRISPR gRNA sequence
gttaatccgttcatggatta

SEQ ID NO: 20705 - DNA, 20 bp, Artificial
  CRISPR gRNA sequence
ataaacaggttaataagtta

SEQ ID NO: 20706 - DNA, 20 bp, Artificial
  CRISPR gRNA sequence
ataagttaatgggttgtcgt

SEQ ID NO: 20707 - DNA, 20 bp, Artificial
  CRISPR gRNA sequence
cactgccttgggactctgca

SEQ ID NO: 20708 - DNA, 20 bp, Artificial
  CRISPR gRNA sequence
gcctccagttgtgaggaaat

SEQ ID NO: 20709 - DNA, 20 bp, Artificial
  CRISPR gRNA sequence
tggggaaaaattggccacat

SEQ ID NO: 20710 - DNA, 20 bp, Artificial
  CRISPR gRNA sequence
ttggatcaagcacagaactg

SEQ ID NO: 20711 - DNA, 20 bp, Artificial
  CRISPR gRNA sequence
actgctgaatgctgctgttc

SEQ ID NO: 20712 - DNA, 20 bp, Artificial
  CRISPR gRNA sequence
gcaggaagaagaccactaag

SEQ ID NO: 20713 - DNA, 20 bp, Artificial
  CRISPR gRNA sequence
caccaccaccacctctcccc

SEQ ID NO: 20714 - DNA, 20 bp, Artificial
  CRISPR gRNA sequence
gaaacgagaaagacctaggt

SEQ ID NO: 20715 - DNA, 20 bp, Artificial
  CRISPR gRNA sequence
ttactatctctaatgcaaac

SEQ ID NO: 20716 - DNA, 20 bp, Artificial
  CRISPR gRNA sequence
tgtatttcctttgttgttgt

SEQ ID NO: 20717 - DNA, 20 bp, Artificial
  CRISPR gRNA sequence
tggacagcaatgagcatact

SEQ ID NO: 20718 - DNA, 20 bp, Artificial
  CRISPR gRNA sequence
atgctagttattacaaatac

SEQ ID NO: 20719 - DNA, 20 bp, Artificial
  CRISPR gRNA sequence
gagctgggaggaaaagggaa

SEQ ID NO: 20720 - DNA, 20 bp, Artificial
  CRISPR gRNA sequence
tatggtatgggctttgtaga

SEQ ID NO: 20721 - DNA, 20 bp, Artificial
  CRISPR gRNA sequence
tgcgtatagaaatggaggtg

SEQ ID NO: 20722 - DNA, 20 bp, Artificial
  CRISPR gRNA sequence
tccatctcccctctcttccc

SEQ ID NO: 20723 - DNA, 20 bp, Artificial
  CRISPR gRNA sequence
ggggactgacgtggctcatg

SEQ ID NO: 20724 - DNA, 20 bp, Artificial
  CRISPR gRNA sequence
actgacgtggctcatgatga

SEQ ID NO: 20725 - DNA, 20 bp, Artificial
  CRISPR gRNA sequence
cgcagttgatggtgtctgtg

SEQ ID NO: 20726 - DNA, 20 bp, Artificial
  CRISPR gRNA sequence
gttctgggaggaaaagtccc

SEQ ID NO: 20727 - DNA, 20 bp, Artificial
  CRISPR gRNA sequence
gctgacgggagggcagggac

SEQ ID NO: 20728 - DNA, 20 bp, Artificial
  CRISPR gRNA sequence
gccgtctctacagcaagctg

SEQ ID NO: 20729 - DNA, 20 bp, Artificial
  CRISPR gRNA sequence
ctacagcaagctgaggggtg

SEQ ID NO: 20730 - DNA, 20 bp, Artificial
  CRISPR gRNA sequence
ccagagggaggagggcccac

SEQ ID NO: 20731 - DNA, 20 bp, Artificial
  CRISPR gRNA sequence
atagaagtggtagaggcaca

SEQ ID NO: 20732 - DNA, 20 bp, Artificial
  CRISPR gRNA sequence
gacaatgctcagtcacctca

SEQ ID NO: 20733 - DNA, 20 bp, Artificial
  CRISPR gRNA sequence
actcccagctggtgagggct

SEQ ID NO: 20734 - DNA, 20 bp, Artificial
  CRISPR gRNA sequence
tggtgagggctggggatgag

SEQ ID NO: 20735 - DNA, 20 bp, Artificial
  CRISPR gRNA sequence
gagggctggggatgagagga

SEQ ID NO: 20736 - DNA, 20 bp, Artificial
  CRISPR gRNA sequence
agaaaagggaactggaaagt

SEQ ID NO: 20737 - DNA, 20 bp, Artificial
  CRISPR gRNA sequence
attccatcaatctcacacca

SEQ ID NO: 20738 - DNA, 20 bp, Artificial
  CRISPR gRNA sequence
gtcccacatttggcaatgcc

SEQ ID NO: 20739 - DNA, 20 bp, Artificial
  CRISPR gRNA sequence
aacccatgtccaagtggaac

SEQ ID NO: 20740 - DNA, 20 bp, Artificial
  CRISPR gRNA sequence
aaccacaatgctctactgct

SEQ ID NO: 20741 - DNA, 20 bp, Artificial
  CRISPR gRNA sequence
tttcctaatatgtaaactga

SEQ ID NO: 20742 - DNA, 20 bp, Artificial
  CRISPR gRNA sequence
atctttaaacaatcccaaat

SEQ ID NO: 20743 - DNA, 20 bp, Artificial
  CRISPR gRNA sequence
atccacacaaaaacctatac

SEQ ID NO: 20744 - DNA, 20 bp, Artificial
  CRISPR gRNA sequence
ctatacacgaatgttcacag

SEQ ID NO: 20745 - DNA, 20 bp, Artificial
  CRISPR gRNA sequence
aaatatccaccaaaaaataa

SEQ ID NO: 20746 - DNA, 20 bp, Artificial
  CRISPR gRNA sequence
gcactgatacatgctggaac

SEQ ID NO: 20747 - DNA, 20 bp, Artificial
  CRISPR gRNA sequence
aagtgaagaagccggacaca

SEQ ID NO: 20748 - DNA, 20 bp, Artificial
  CRISPR gRNA sequence
ccatggagacataaagtagg

SEQ ID NO: 20749 - DNA, 20 bp, Artificial
  CRISPR gRNA sequence
actttgggaggctgagacag

SEQ ID NO: 20750 - DNA, 20 bp, Artificial
  CRISPR gRNA sequence
ttgcctagggcttggcagag

SEQ ID NO: 20751 - DNA, 20 bp, Artificial
  CRISPR gRNA sequence
gaaatggggaacaactgctg

SEQ ID NO: 20752 - DNA, 20 bp, Artificial
  CRISPR gRNA sequence
ggaacaactgctgatgggtc

SEQ ID NO: 20753 - DNA, 20 bp, Artificial
  CRISPR gRNA sequence
atgggtctggagtttcttta

SEQ ID NO: 20754 - DNA, 20 bp, Artificial
  CRISPR gRNA sequence
aatgtgctaaaattgactgt

SEQ ID NO: 20755 - DNA, 20 bp, Artificial
  CRISPR gRNA sequence
ggagatggtcacacaactct

SEQ ID NO: 20756 - DNA, 20 bp, Artificial
  CRISPR gRNA sequence
ttttttttttttttttaaga

SEQ ID NO: 20757 - DNA, 20 bp, Artificial
  CRISPR gRNA sequence
ggagtctctgtcacccaggc

SEQ ID NO: 20758 - DNA, 20 bp, Artificial
  CRISPR gRNA sequence
tgtcacccaggctggagtgc

SEQ ID NO: 20759 - DNA, 20 bp, Artificial
  CRISPR gRNA sequence
gcctcagcctcctgagcagc

SEQ ID NO: 20760 - DNA, 20 bp, Artificial
  CRISPR gRNA sequence
tcctcggcctcccaaagtgt

SEQ ID NO: 20761 - DNA, 20 bp, Artificial
  CRISPR gRNA sequence
taagtgggcaaattgtatat

SEQ ID NO: 20762 - DNA, 20 bp, Artificial
  CRISPR gRNA sequence
tgtggctctaaggctcctgc

SEQ ID NO: 20763 - DNA, 20 bp, Artificial
  CRISPR gRNA sequence
tgcctctggaggctcgaggg

SEQ ID NO: 20764 - DNA, 20 bp, Artificial
  CRISPR gRNA sequence
tcttataaagacacttgtca

SEQ ID NO: 20765 - DNA, 20 bp, Artificial
  CRISPR gRNA sequence
taggacccacctagataatc

SEQ ID NO: 20766 - DNA, 20 bp, Artificial
  CRISPR gRNA sequence
gcttgctctgttgcccaggc

SEQ ID NO: 20767 - DNA, 20 bp, Artificial
  CRISPR gRNA sequence
gattctcctgccccagtctc

SEQ ID NO: 20768 - DNA, 20 bp, Artificial
  CRISPR gRNA sequence
gccccagtctcctgagtagc

SEQ ID NO: 20769 - DNA, 20 bp, Artificial
  CRISPR gRNA sequence
ttttgtatttttagtagaaa

SEQ ID NO: 20770 - DNA, 20 bp, Artificial
  CRISPR gRNA sequence
atctcagcttcccaaagtgc

SEQ ID NO: 20771 - DNA, 20 bp, Artificial
  CRISPR gRNA sequence
aagtcacactgacaggttcc

SEQ ID NO: 20772 - DNA, 20 bp, Artificial
  CRISPR gRNA sequence
gccctgttctgggcccagaa

SEQ ID NO: 20773 - DNA, 20 bp, Artificial
  CRISPR gRNA sequence
gcccagaagagaatacattg

SEQ ID NO: 20774 - DNA, 20 bp, Artificial
  CRISPR gRNA sequence
ttttctttttttttttgaga

SEQ ID NO: 20775 - DNA, 20 bp, Artificial
  CRISPR gRNA sequence
tctcactctgtcgcccaggc

SEQ ID NO: 20776 - DNA, 20 bp, Artificial
  CRISPR gRNA sequence
ctcactgcaacctctgcctc

SEQ ID NO: 20777 - DNA, 20 bp, Artificial
  CRISPR gRNA sequence
ttttttatttttagtaaaga

SEQ ID NO: 20778 - DNA, 20 bp, Artificial
  CRISPR gRNA sequence
gccttggcctcccaaagtgc

SEQ ID NO: 20779 - DNA, 20 bp, Artificial
  CRISPR gRNA sequence
gagaggctcagcacagaccc

SEQ ID NO: 20780 - DNA, 20 bp, Artificial
  CRISPR gRNA sequence
acagacccccggatgtcaca

SEQ ID NO: 20781 - DNA, 20 bp, Artificial
  CRISPR gRNA sequence
gccaaagctgggagatggtt

SEQ ID NO: 20782 - DNA, 20 bp, Artificial
  CRISPR gRNA sequence
agactgatcctagcaactcc

SEQ ID NO: 20783 - DNA, 20 bp, Artificial
  CRISPR gRNA sequence
tgatcctagcaactccgtga

SEQ ID NO: 20784 - DNA, 20 bp, Artificial
  CRISPR gRNA sequence
ctcagttttctcacagggca

SEQ ID NO: 20785 - DNA, 20 bp, Artificial
  CRISPR gRNA sequence
cacaggtggtatcacagatg

SEQ ID NO: 20786 - DNA, 20 bp, Artificial
  CRISPR gRNA sequence
gatgagctctgcttcaaact

SEQ ID NO: 20787 - DNA, 20 bp, Artificial
  CRISPR gRNA sequence
agtttccatatctataaaat

SEQ ID NO: 20788 - DNA, 20 bp, Artificial
  CRISPR gRNA sequence
aataataattggcaactcac

SEQ ID NO: 20789 - DNA, 20 bp, Artificial
  CRISPR gRNA sequence
tggcaactcacaaggattag

SEQ ID NO: 20790 - DNA, 20 bp, Artificial
  CRISPR gRNA sequence
ggactggcaatcagtaagtg

SEQ ID NO: 20791 - DNA, 20 bp, Artificial
  CRISPR gRNA sequence
ggcagcacagcttctacatg

SEQ ID NO: 20792 - DNA, 20 bp, Artificial
  CRISPR gRNA sequence
agtttgcttcttacgtttgt

SEQ ID NO: 20793 - DNA, 20 bp, Artificial
  CRISPR gRNA sequence
tgtagaaattccagcacttt

SEQ ID NO: 20794 - DNA, 20 bp, Artificial
  CRISPR gRNA sequence
gcactttgggagtccaaggc

SEQ ID NO: 20795 - DNA, 20 bp, Artificial
  CRISPR gRNA sequence
caggagtatcacctcagtcc

SEQ ID NO: 20796 - DNA, 20 bp, Artificial
  CRISPR gRNA sequence
tactcaggaggctgaggtgg

SEQ ID NO: 20797 - DNA, 20 bp, Artificial
  CRISPR gRNA sequence
ttgcaccactgcactccagc

SEQ ID NO: 20798 - DNA, 20 bp, Artificial
  CRISPR gRNA sequence
cccacagccagcagggcagc

SEQ ID NO: 20799 - DNA, 20 bp, Artificial
  CRISPR gRNA sequence
tgcaccttaagcacttcctc

SEQ ID NO: 20800 - DNA, 20 bp, Artificial
  CRISPR gRNA sequence
gcacttcctcttgggtgatc

SEQ ID NO: 20801 - DNA, 20 bp, Artificial
  CRISPR gRNA sequence
gcctccatcctccacaccat

SEQ ID NO: 20802 - DNA, 20 bp, Artificial
  CRISPR gRNA sequence
aaaaagctctggggaaaagg

SEQ ID NO: 20803 - DNA, 20 bp, Artificial
  CRISPR gRNA sequence
gctctggggaaaaggcaggg

SEQ ID NO: 20804 - DNA, 20 bp, Artificial
  CRISPR gRNA sequence
tgtggtttaggagcttgcat

SEQ ID NO: 20805 - DNA, 20 bp, Artificial
  CRISPR gRNA sequence
ttttcccaatattagttctg

SEQ ID NO: 20806 - DNA, 20 bp, Artificial
  CRISPR gRNA sequence
caggcagatcacttgaggtc

SEQ ID NO: 20807 - DNA, 20 bp, Artificial
  CRISPR gRNA sequence
tacttgggaggctgaggcag

SEQ ID NO: 20808 - DNA, 20 bp, Artificial
  CRISPR gRNA sequence
aaacaaaaaagattgtcctg

SEQ ID NO: 20809 - DNA, 20 bp, Artificial
  CRISPR gRNA sequence
caggatcatcagaaggccaa

SEQ ID NO: 20810 - DNA, 20 bp, Artificial
  CRISPR gRNA sequence
aaggccaagggagttctgtg

SEQ ID NO: 20811 - DNA, 20 bp, Artificial
  CRISPR gRNA sequence
aaaggaagcccattacatta

SEQ ID NO: 20812 - DNA, 20 bp, Artificial
  CRISPR gRNA sequence
ccagtcacaccaagatctac

SEQ ID NO: 20813 - DNA, 20 bp, Artificial
  CRISPR gRNA sequence
tccaaaccacattgccagag

SEQ ID NO: 20814 - DNA, 20 bp, Artificial
  CRISPR gRNA sequence
ccgtggcaatgatatagaac

SEQ ID NO: 20815 - DNA, 20 bp, Artificial
  CRISPR gRNA sequence
agatgaagagacaggctcag

SEQ ID NO: 20816 - DNA, 20 bp, Artificial
  CRISPR gRNA sequence
cagcccactctatagccttt

SEQ ID NO: 20817 - DNA, 20 bp, Artificial
  CRISPR gRNA sequence
gcaccccggcgagggaaggc

SEQ ID NO: 20818 - DNA, 20 bp, Artificial
  CRISPR gRNA sequence
ttgccatcaaaagtcctttt

SEQ ID NO: 20819 - DNA, 20 bp, Artificial
  CRISPR gRNA sequence
tccccacttcacactgcatg

SEQ ID NO: 20820 - DNA, 20 bp, Artificial
  CRISPR gRNA sequence
tccatctcagctggtgggag

SEQ ID NO: 20821 - DNA, 20 bp, Artificial
  CRISPR gRNA sequence
ggagctcagatggtgagctt

SEQ ID NO: 20822 - DNA, 20 bp, Artificial
  CRISPR gRNA sequence
acctaccaacgcactacaat

SEQ ID NO: 20823 - DNA, 20 bp, Artificial
  CRISPR gRNA sequence
gtttccttatctgtaaagtg

SEQ ID NO: 20824 - DNA, 20 bp, Artificial
  CRISPR gRNA sequence
ggataataattggcaactca

SEQ ID NO: 20825 - DNA, 20 bp, Artificial
  CRISPR gRNA sequence
ttggcaactcataggattag

SEQ ID NO: 20826 - DNA, 20 bp, Artificial
  CRISPR gRNA sequence
ggcagcacaacttctgcatg

SEQ ID NO: 20827 - DNA, 20 bp, Artificial
  CRISPR gRNA sequence
aatgtgcttcttacctctgt

SEQ ID NO: 20828 - DNA, 20 bp, Artificial
  CRISPR gRNA sequence
atgttttcttcccagaggcg

SEQ ID NO: 20829 - DNA, 20 bp, Artificial
  CRISPR gRNA sequence
gaggcggggagtctatcttt

SEQ ID NO: 20830 - DNA, 20 bp, Artificial
  CRISPR gRNA sequence
aagagcatgagaaggaggcc

SEQ ID NO: 20831 - DNA, 20 bp, Artificial
  CRISPR gRNA sequence
actttgagaggccgaggctg

SEQ ID NO: 20832 - DNA, 20 bp, Artificial
  CRISPR gRNA sequence
ctggcggattacttgaggtc

SEQ ID NO: 20833 - DNA, 20 bp, Artificial
  CRISPR gRNA sequence
aaaatgagctgggcgtggtg

SEQ ID NO: 20834 - DNA, 20 bp, Artificial
  CRISPR gRNA sequence
aaaaaaaaaaaagcttgaga

SEQ ID NO: 20835 - DNA, 20 bp, Artificial
  CRISPR gRNA sequence
accatgaacttctcctcctg

SEQ ID NO: 20836 - DNA, 20 bp, Artificial
  CRISPR gRNA sequence
tgtgtgcctagagacatggt

SEQ ID NO: 20837 - DNA, 20 bp, Artificial
  CRISPR gRNA sequence
tttctgctctgcctttgatc

SEQ ID NO: 20838 - DNA, 20 bp, Artificial
  CRISPR gRNA sequence
ccctctgagcctccgtttca

SEQ ID NO: 20839 - DNA, 20 bp, Artificial
  CRISPR gRNA sequence
gagtgttggagccccttcaa

SEQ ID NO: 20840 - DNA, 20 bp, Artificial
  CRISPR gRNA sequence
tgttgggaagccaggggcct

SEQ ID NO: 20841 - DNA, 20 bp, Artificial
  CRISPR gRNA sequence
accccaaacagcttctttgt

SEQ ID NO: 20842 - DNA, 20 bp, Artificial
  CRISPR gRNA sequence
ttgtgggggtagtagctcaa

SEQ ID NO: 20843 - DNA, 20 bp, Artificial
  CRISPR gRNA sequence
ataataatagcatagtggtt

SEQ ID NO: 20844 - DNA, 20 bp, Artificial
  CRISPR gRNA sequence
agtggttaagggtgcaggct

SEQ ID NO: 20845 - DNA, 20 bp, Artificial
  CRISPR gRNA sequence
gcaaatgttactcaacctct

SEQ ID NO: 20846 - DNA, 20 bp, Artificial
  CRISPR gRNA sequence
tactcaacctctctgagtca

SEQ ID NO: 20847 - DNA, 20 bp, Artificial
  CRISPR gRNA sequence
ttggcacagtgcttatgtca

SEQ ID NO: 20848 - DNA, 20 bp, Artificial
  CRISPR gRNA sequence
gacttacctaaagtgactta

SEQ ID NO: 20849 - DNA, 20 bp, Artificial
  CRISPR gRNA sequence
aaatgccaagtgttggttac

SEQ ID NO: 20850 - DNA, 20 bp, Artificial
  CRISPR gRNA sequence
tgttggttacacgggtttgt

SEQ ID NO: 20851 - DNA, 20 bp, Artificial
  CRISPR gRNA sequence
acgggtttgtgggaatgtag

SEQ ID NO: 20852 - DNA, 20 bp, Artificial
  CRISPR gRNA sequence
gagaacgacctggcatcatg

SEQ ID NO: 20853 - DNA, 20 bp, Artificial
  CRISPR gRNA sequence
tggcatcatgtagaatatct

SEQ ID NO: 20854 - DNA, 20 bp, Artificial
  CRISPR gRNA sequence
accacctggcaattcagctc

SEQ ID NO: 20855 - DNA, 20 bp, Artificial
  CRISPR gRNA sequence
ctccccaggagaacccatct

SEQ ID NO: 20856 - DNA, 20 bp, Artificial
  CRISPR gRNA sequence
ctgtgttatttgtggtgaca

SEQ ID NO: 20857 - DNA, 20 bp, Artificial
  CRISPR gRNA sequence
tcacctaggtgtccatcact

SEQ ID NO: 20858 - DNA, 20 bp, Artificial
  CRISPR gRNA sequence
tagatcctaaaaacatagta

SEQ ID NO: 20859 - DNA, 20 bp, Artificial
  CRISPR gRNA sequence
cagcactttgggaggccgag

SEQ ID NO: 20860 - DNA, 20 bp, Artificial
  CRISPR gRNA sequence
actttgggaggccgaggcgg

SEQ ID NO: 20861 - DNA, 20 bp, Artificial
  CRISPR gRNA sequence
cgggtggatcacctgaggtc

SEQ ID NO: 20862 - DNA, 20 bp, Artificial
  CRISPR gRNA sequence
ctaaaaatagaaaactcagc

SEQ ID NO: 20863 - DNA, 20 bp, Artificial
  CRISPR gRNA sequence
agaaaactcagcctgggtga

SEQ ID NO: 20864 - DNA, 20 bp, Artificial
  CRISPR gRNA sequence
aagatacacctgaaatgcat

SEQ ID NO: 20865 - DNA, 20 bp, Artificial
  CRISPR gRNA sequence
aatcgaaggtttaaaggccc

SEQ ID NO: 20866 - DNA, 20 bp, Artificial
  CRISPR gRNA sequence
tgaaaagaaaagaaacaaag

SEQ ID NO: 20867 - DNA, 20 bp, Artificial
  CRISPR gRNA sequence
aagaaacaaaggaggattca

SEQ ID NO: 20868 - DNA, 20 bp, Artificial
  CRISPR gRNA sequence
ttgatttgtgcccaagagcc

SEQ ID NO: 20869 - DNA, 20 bp, Artificial
  CRISPR gRNA sequence
ggaacatgctggacttggag

SEQ ID NO: 20870 - DNA, 20 bp, Artificial
  CRISPR gRNA sequence
ggagcaggatgggggaggag

SEQ ID NO: 20871 - DNA, 20 bp, Artificial
  CRISPR gRNA sequence
cactcaagactttcacttcc

SEQ ID NO: 20872 - DNA, 20 bp, Artificial
  CRISPR gRNA sequence
tatgggcctggaaacagttg

SEQ ID NO: 20873 - DNA, 20 bp, Artificial
  CRISPR gRNA sequence
cttggctgcaaaatcaaaag

SEQ ID NO: 20874 - DNA, 20 bp, Artificial
  CRISPR gRNA sequence
accatcacaatgtctctata

SEQ ID NO: 20875 - DNA, 20 bp, Artificial
  CRISPR gRNA sequence
cattatggcccctttggtat

SEQ ID NO: 20876 - DNA, 20 bp, Artificial
  CRISPR gRNA sequence
tcccaagataatggcttggg

SEQ ID NO: 20877 - DNA, 20 bp, Artificial
  CRISPR gRNA sequence
aagataatggcttgggaggg

SEQ ID NO: 20878 - DNA, 20 bp, Artificial
  CRISPR gRNA sequence
gtgactggggcagggagagg

SEQ ID NO: 20879 - DNA, 20 bp, Artificial
  CRISPR gRNA sequence
aattatgtcctgtcctgcaa

SEQ ID NO: 20880 - DNA, 20 bp, Artificial
  CRISPR gRNA sequence
aatggaattgaggtgtacag

SEQ ID NO: 20881 - DNA, 20 bp, Artificial
  CRISPR gRNA sequence
cagtagggtctttttctaca

SEQ ID NO: 20882 - DNA, 20 bp, Artificial
  CRISPR gRNA sequence
ggtcttggaggggactggcc

SEQ ID NO: 20883 - DNA, 20 bp, Artificial
  CRISPR gRNA sequence
agcactaaagttgcagcatc

SEQ ID NO: 20884 - DNA, 20 bp, Artificial
  CRISPR gRNA sequence
aagttgcagcatctggggtg

SEQ ID NO: 20885 - DNA, 20 bp, Artificial
  CRISPR gRNA sequence
actttgggaggctgaggagg

SEQ ID NO: 20886 - DNA, 20 bp, Artificial
  CRISPR gRNA sequence
agggaggatgacttgaggcc

SEQ ID NO: 20887 - DNA, 20 bp, Artificial
  CRISPR gRNA sequence
ataaaagatacaaaaattag

SEQ ID NO: 20888 - DNA, 20 bp, Artificial
  CRISPR gRNA sequence
caaaaattagctgggtgtgg

SEQ ID NO: 20889 - DNA, 20 bp, Artificial
  CRISPR gRNA sequence
tacttgggaggctgaggcag

SEQ ID NO: 20890 - DNA, 20 bp, Artificial
  CRISPR gRNA sequence
ctgcactccaacctgggcaa

SEQ ID NO: 20891 - DNA, 20 bp, Artificial
  CRISPR gRNA sequence
agactttgtctcataaatga

SEQ ID NO: 20892 - DNA, 20 bp, Artificial
  CRISPR gRNA sequence
tttgtctcataaatgaaagg

SEQ ID NO: 20893 - DNA, 20 bp, Artificial
  CRISPR gRNA sequence
tctcataaatgaaaggatga

SEQ ID NO: 20894 - DNA, 20 bp, Artificial
  CRISPR gRNA sequence
ataaatgaaaggatgaatga

SEQ ID NO: 20895 - DNA, 20 bp, Artificial
  CRISPR gRNA sequence
aaggatgaatgaatgaatga

SEQ ID NO: 20896 - DNA, 20 bp, Artificial
  CRISPR gRNA sequence
ggtaagctccctgggaactg

SEQ ID NO: 20897 - DNA, 20 bp, Artificial
  CRISPR gRNA sequence
ccatcccaattccagcaccg

SEQ ID NO: 20898 - DNA, 20 bp, Artificial
  CRISPR gRNA sequence
cccaattccagcaccgttga

SEQ ID NO: 20899 - DNA, 20 bp, Artificial
  CRISPR gRNA sequence
ccattgcagctccctgccct

SEQ ID NO: 20900 - DNA, 20 bp, Artificial
  CRISPR gRNA sequence
caagctcagtcacaagtgaa

SEQ ID NO: 20901 - DNA, 20 bp, Artificial
  CRISPR gRNA sequence
catgtatctgtccaaaccca

SEQ ID NO: 20902 - DNA, 20 bp, Artificial
  CRISPR gRNA sequence
cccacagaatgtacaacacc

SEQ ID NO: 20903 - DNA, 20 bp, Artificial
  CRISPR gRNA sequence
atgtaaacaaaccatggacc

SEQ ID NO: 20904 - DNA, 20 bp, Artificial
  CRISPR gRNA sequence
acaaatgtatcagtctggtg

SEQ ID NO: 20905 - DNA, 20 bp, Artificial
  CRISPR gRNA sequence
tgggaggacggaggtagatg

SEQ ID NO: 20906 - DNA, 20 bp, Artificial
  CRISPR gRNA sequence
agcttccttgctgtcccagc

SEQ ID NO: 20907 - DNA, 20 bp, Artificial
  CRISPR gRNA sequence
cccagcttgagtgctcccta

SEQ ID NO: 20908 - DNA, 20 bp, Artificial
  CRISPR gRNA sequence
ctgctttcttcccttttcct

SEQ ID NO: 20909 - DNA, 20 bp, Artificial
  CRISPR gRNA sequence
tccttcgggtgttccctcct

SEQ ID NO: 20910 - DNA, 20 bp, Artificial
  CRISPR gRNA sequence
aggcaagccacctatcttct

SEQ ID NO: 20911 - DNA, 20 bp, Artificial
  CRISPR gRNA sequence
aacttggaaaatcttaaaac

SEQ ID NO: 20912 - DNA, 20 bp, Artificial
  CRISPR gRNA sequence
agcttgtgcatttgccagta

SEQ ID NO: 20913 - DNA, 20 bp, Artificial
  CRISPR gRNA sequence
cagtaaagggtaaagttatt

SEQ ID NO: 20914 - DNA, 20 bp, Artificial
  CRISPR gRNA sequence
ggtgaggggcctggtggtcc

SEQ ID NO: 20915 - DNA, 20 bp, Artificial
  CRISPR gRNA sequence
gggcctggtggtcccaggat

SEQ ID NO: 20916 - DNA, 20 bp, Artificial
  CRISPR gRNA sequence
ggagaccttcggtccctgtc

SEQ ID NO: 20917 - DNA, 20 bp, Artificial
  CRISPR gRNA sequence
ttcggtccctgtccagaatg

SEQ ID NO: 20918 - DNA, 20 bp, Artificial
  CRISPR gRNA sequence
ccctgtccagaatgcagggt

SEQ ID NO: 20919 - DNA, 20 bp, Artificial
  CRISPR gRNA sequence
ccagaatgcagggttgggat

SEQ ID NO: 20920 - DNA, 20 bp, Artificial
  CRISPR gRNA sequence
ctgcagtcaatgacctggaa

SEQ ID NO: 20921 - DNA, 20 bp, Artificial
  CRISPR gRNA sequence
agggaacctgaccctggtgc

SEQ ID NO: 20922 - DNA, 20 bp, Artificial
  CRISPR gRNA sequence
ctgaccctggtgctggggta

SEQ ID NO: 20923 - DNA, 20 bp, Artificial
  CRISPR gRNA sequence
cctggtgctggggtaggggg

SEQ ID NO: 20924 - DNA, 20 bp, Artificial
  CRISPR gRNA sequence
ggggtagggggtggagtgat

SEQ ID NO: 20925 - DNA, 20 bp, Artificial
  CRISPR gRNA sequence
gtccccccgccagcactctg

SEQ ID NO: 20926 - DNA, 20 bp, Artificial
  CRISPR gRNA sequence
tgcttgctgagatctgacta

SEQ ID NO: 20927 - DNA, 20 bp, Artificial
  CRISPR gRNA sequence
agccatcggcaggcttggct

SEQ ID NO: 20928 - DNA, 20 bp, Artificial
  CRISPR gRNA sequence
cggcaggcttggctgtgagt

SEQ ID NO: 20929 - DNA, 20 bp, Artificial
  CRISPR gRNA sequence
gtgagtgagaattacctggg

SEQ ID NO: 20930 - DNA, 20 bp, Artificial
  CRISPR gRNA sequence
acccccagtgattctattca

SEQ ID NO: 20931 - DNA, 20 bp, Artificial
  CRISPR gRNA sequence
gggagtctgcagccgggccc

SEQ ID NO: 20932 - DNA, 20 bp, Artificial
  CRISPR gRNA sequence
ttctttcattttttttgaga

SEQ ID NO: 20933 - DNA, 20 bp, Artificial
  CRISPR gRNA sequence
ttcactcttgttgcccaggc

SEQ ID NO: 20934 - DNA, 20 bp, Artificial
  CRISPR gRNA sequence
ctcaccgcaatctccgcctc

SEQ ID NO: 20935 - DNA, 20 bp, Artificial
  CRISPR gRNA sequence
gattctcctccaccagccta

SEQ ID NO: 20936 - DNA, 20 bp, Artificial
  CRISPR gRNA sequence
ccaccagcctaccgagtagc

SEQ ID NO: 20937 - DNA, 20 bp, Artificial
  CRISPR gRNA sequence
gcctcagcctcccaaagtgc

SEQ ID NO: 20938 - DNA, 20 bp, Artificial
  CRISPR gRNA sequence
gtgagccaccatgcccggcc

SEQ ID NO: 20939 - DNA, 20 bp, Artificial
  CRISPR gRNA sequence
gccttgacctcccaaggtga

SEQ ID NO: 20940 - DNA, 20 bp, Artificial
  CRISPR gRNA sequence
tcttccatctttacaatttt

SEQ ID NO: 20941 - DNA, 20 bp, Artificial
  CRISPR gRNA sequence
gattttaaaagaaagctttc

SEQ ID NO: 20942 - DNA, 20 bp, Artificial
  CRISPR gRNA sequence
gctttctagagttgaaagcg

SEQ ID NO: 20943 - DNA, 20 bp, Artificial
  CRISPR gRNA sequence
acccaagtgtctatcaacaa

SEQ ID NO: 20944 - DNA, 20 bp, Artificial
  CRISPR gRNA sequence
aagtgtctatcaacaaatga

SEQ ID NO: 20945 - DNA, 20 bp, Artificial
  CRISPR gRNA sequence
atgaatggatgaacaaaata

SEQ ID NO: 20946 - DNA, 20 bp, Artificial
  CRISPR gRNA sequence
aatatgggatatccacatat

SEQ ID NO: 20947 - DNA, 20 bp, Artificial
  CRISPR gRNA sequence
aatactattccgccatagaa

SEQ ID NO: 20948 - DNA, 20 bp, Artificial
  CRISPR gRNA sequence
ggaattacacatggcacgac

SEQ ID NO: 20949 - DNA, 20 bp, Artificial
  CRISPR gRNA sequence
ttctatttataggcggtgtc

SEQ ID NO: 20950 - DNA, 20 bp, Artificial
  CRISPR gRNA sequence
aaaacatagagacaggaagt

SEQ ID NO: 20951 - DNA, 20 bp, Artificial
  CRISPR gRNA sequence
gaagttggagttaccacgag

SEQ ID NO: 20952 - DNA, 20 bp, Artificial
  CRISPR gRNA sequence
gctgggtggaaggggcagtg

SEQ ID NO: 20953 - DNA, 20 bp, Artificial
  CRISPR gRNA sequence
cagtggggagttattgctta

SEQ ID NO: 20954 - DNA, 20 bp, Artificial
  CRISPR gRNA sequence
gggagttattgcttattggg

SEQ ID NO: 20955 - DNA, 20 bp, Artificial
  CRISPR gRNA sequence
tgggtagagtttcagtttgg

SEQ ID NO: 20956 - DNA, 20 bp, Artificial
  CRISPR gRNA sequence
aggatgaaaaagttctggag

SEQ ID NO: 20957 - DNA, 20 bp, Artificial
  CRISPR gRNA sequence
gactttgtccttgatgtcag

SEQ ID NO: 20958 - DNA, 20 bp, Artificial
  CRISPR gRNA sequence
cttgatgtcagaaggattga

SEQ ID NO: 20959 - DNA, 20 bp, Artificial
  CRISPR gRNA sequence
actatctatgtccttcctat

SEQ ID NO: 20960 - DNA, 20 bp, Artificial
  CRISPR gRNA sequence
cagtggtgcaatctcagctc

SEQ ID NO: 20961 - DNA, 20 bp, Artificial
  CRISPR gRNA sequence
tctcgggtaacctccacctc

SEQ ID NO: 20962 - DNA, 20 bp, Artificial
  CRISPR gRNA sequence
tctcgggtaaactccgcctc

SEQ ID NO: 20963 - DNA, 20 bp, Artificial
  CRISPR gRNA sequence
aacacaaaaaagtgttttag

SEQ ID NO: 20964 - DNA, 20 bp, Artificial
  CRISPR gRNA sequence
aaaaagtgttttagtagagt

SEQ ID NO: 20965 - DNA, 20 bp, Artificial
  CRISPR gRNA sequence
gcctcggcctcccaaagtgc

SEQ ID NO: 20966 - DNA, 20 bp, Artificial
  CRISPR gRNA sequence
atctttctaaacaatccctt

SEQ ID NO: 20967 - DNA, 20 bp, Artificial
  CRISPR gRNA sequence
ataataattattcccaatgc

SEQ ID NO: 20968 - DNA, 20 bp, Artificial
  CRISPR gRNA sequence
ctgattgcctggaactaatc

SEQ ID NO: 20969 - DNA, 20 bp, Artificial
  CRISPR gRNA sequence
ggaactaatccagagtttcc

SEQ ID NO: 20970 - DNA, 20 bp, Artificial
  CRISPR gRNA sequence
tcttctcaaggtatctgagg

SEQ ID NO: 20971 - DNA, 20 bp, Artificial
  CRISPR gRNA sequence
agccccagccatcagacaga

SEQ ID NO: 20972 - DNA, 20 bp, Artificial
  CRISPR gRNA sequence
gggctgggctctcagtagac

SEQ ID NO: 20973 - DNA, 20 bp, Artificial
  CRISPR gRNA sequence
tagaggttttgtaacaggga

SEQ ID NO: 20974 - DNA, 20 bp, Artificial
  CRISPR gRNA sequence
tttgccccacaaacgaacat

SEQ ID NO: 20975 - DNA, 20 bp, Artificial
  CRISPR gRNA sequence
aaacgaacattggagtcacc

SEQ ID NO: 20976 - DNA, 20 bp, Artificial
  CRISPR gRNA sequence
gggatagatggtttaacctg

SEQ ID NO: 20977 - DNA, 20 bp, Artificial
  CRISPR gRNA sequence
aggcctagccaaccgggcct

SEQ ID NO: 20978 - DNA, 20 bp, Artificial
  CRISPR gRNA sequence
atgttcatgtgtggggagcc

SEQ ID NO: 20979 - DNA, 20 bp, Artificial
  CRISPR gRNA sequence
ggtcatcccctaagggagcc

SEQ ID NO: 20980 - DNA, 20 bp, Artificial
  CRISPR gRNA sequence
tttgcaaggtgatcatttgt

SEQ ID NO: 20981 - DNA, 20 bp, Artificial
  CRISPR gRNA sequence
gtatttatttattttttctc

SEQ ID NO: 20982 - DNA, 20 bp, Artificial
  CRISPR gRNA sequence
gccacctctcctgtgccacc

SEQ ID NO: 20983 - DNA, 20 bp, Artificial
  CRISPR gRNA sequence
tcaggaggaccgcggctttt

SEQ ID NO: 20984 - DNA, 20 bp, Artificial
  CRISPR gRNA sequence
cgctttagcctctctcctta

SEQ ID NO: 20985 - DNA, 20 bp, Artificial
  CRISPR gRNA sequence
aagagatcggttcagtccgg

SEQ ID NO: 20986 - DNA, 20 bp, Artificial
  CRISPR gRNA sequence
ccttcgccaagatgttcaac

SEQ ID NO: 20987 - DNA, 20 bp, Artificial
  CRISPR gRNA sequence
gagcccaatacccaagattc

SEQ ID NO: 20988 - DNA, 20 bp, Artificial
  CRISPR gRNA sequence
caagattccagagttagaga

SEQ ID NO: 20989 - DNA, 20 bp, Artificial
  CRISPR gRNA sequence
aagaagggcgcgcacctctg

SEQ ID NO: 20990 - DNA, 20 bp, Artificial
  CRISPR gRNA sequence
tctgcaggatcccgggcgcg

SEQ ID NO: 20991 - DNA, 20 bp, Artificial
  CRISPR gRNA sequence
ccgggcgcgcggagtcggcc

SEQ ID NO: 20992 - DNA, 20 bp, Artificial
  CRISPR gRNA sequence
agtcggccaagggtggccgg

SEQ ID NO: 20993 - DNA, 20 bp, Artificial
  CRISPR gRNA sequence
tgggcacagcaagccaagct

SEQ ID NO: 20994 - DNA, 20 bp, Artificial
  CRISPR gRNA sequence
cccggctcctggttcccgcg

SEQ ID NO: 20995 - DNA, 20 bp, Artificial
  CRISPR gRNA sequence
ttcccgcgcagagtcgttgc

SEQ ID NO: 20996 - DNA, 20 bp, Artificial
  CRISPR gRNA sequence
tcgattctcagcccgacctt

SEQ ID NO: 20997 - DNA, 20 bp, Artificial
  CRISPR gRNA sequence
gtggccagccccacttcggg

SEQ ID NO: 20998 - DNA, 20 bp, Artificial
  CRISPR gRNA sequence
gggcaagtgatctgcaagtc

SEQ ID NO: 20999 - DNA, 20 bp, Artificial
  CRISPR gRNA sequence
cagggagcttgtccccaccc

SEQ ID NO: 21000 - DNA, 20 bp, Artificial
  CRISPR gRNA sequence
gagcttgtccccacccctgg

SEQ ID NO: 21001 - DNA, 20 bp, Artificial
  CRISPR gRNA sequence
aaatccctcaggtaccttcc

SEQ ID NO: 21002 - DNA, 20 bp, Artificial
  CRISPR gRNA sequence
gccggtccttttcagaggtc

SEQ ID NO: 21003 - DNA, 20 bp, Artificial
  CRISPR gRNA sequence
tcagaggtcttggattcctg

SEQ ID NO: 21004 - DNA, 20 bp, Artificial
  CRISPR gRNA sequence
gtcactttcccttttcaggc

SEQ ID NO: 21005 - DNA, 20 bp, Artificial
  CRISPR gRNA sequence
caggcctgaatttcctcatc

SEQ ID NO: 21006 - DNA, 20 bp, Artificial
  CRISPR gRNA sequence
ggcagacctgtcatcagtct

SEQ ID NO: 21007 - DNA, 20 bp, Artificial
  CRISPR gRNA sequence
aagcaaaccatacatttcag

SEQ ID NO: 21008 - DNA, 20 bp, Artificial
  CRISPR gRNA sequence
tttcaggggagtctgagaaa

SEQ ID NO: 21009 - DNA, 20 bp, Artificial
  CRISPR gRNA sequence
cactccaggaaaattgactc

SEQ ID NO: 21010 - DNA, 20 bp, Artificial
  CRISPR gRNA sequence
attttggtttccctgcttct

SEQ ID NO: 21011 - DNA, 20 bp, Artificial
  CRISPR gRNA sequence
tttccctgcttctctgggta

SEQ ID NO: 21012 - DNA, 20 bp, Artificial
  CRISPR gRNA sequence
ctgcttctctgggtatggag

SEQ ID NO: 21013 - DNA, 20 bp, Artificial
  CRISPR gRNA sequence
ccgagccaggccagcatgct

SEQ ID NO: 21014 - DNA, 20 bp, Artificial
  CRISPR gRNA sequence
cctcacccccatccccaatt

SEQ ID NO: 21015 - DNA, 20 bp, Artificial
  CRISPR gRNA sequence
gaatggtttctctgtttatc

SEQ ID NO: 21016 - DNA, 20 bp, Artificial
  CRISPR gRNA sequence
agccaggcaacgcattgtgt

SEQ ID NO: 21017 - DNA, 20 bp, Artificial
  CRISPR gRNA sequence
cccagccaggcagcagctcc

SEQ ID NO: 21018 - DNA, 20 bp, Artificial
  CRISPR gRNA sequence
ctcgtgccctcagcttcccc

SEQ ID NO: 21019 - DNA, 20 bp, Artificial
  CRISPR gRNA sequence
cagcttccccaaggatgcct

SEQ ID NO: 21020 - DNA, 20 bp, Artificial
  CRISPR gRNA sequence
ctccgggagctgctgcctgg

SEQ ID NO: 21021 - DNA, 20 bp, Artificial
  CRISPR gRNA sequence
ctggcggatgctgccctccc

SEQ ID NO: 21022 - DNA, 20 bp, Artificial
  CRISPR gRNA sequence
tccccccagtttcctaatgg

SEQ ID NO: 21023 - DNA, 20 bp, Artificial
  CRISPR gRNA sequence
gaagggtgtgcccctgaaga

SEQ ID NO: 21024 - DNA, 20 bp, Artificial
  CRISPR gRNA sequence
tctcagactcccctgaaatg

SEQ ID NO: 21025 - DNA, 20 bp, Artificial
  CRISPR gRNA sequence
agactcccctgaaatgtatg

SEQ ID NO: 21026 - DNA, 20 bp, Artificial
  CRISPR gRNA sequence
gggggtgtggtcatggtaac

SEQ ID NO: 21027 - DNA, 20 bp, Artificial
  CRISPR gRNA sequence
tccatccatggaaggtacct

SEQ ID NO: 21028 - DNA, 20 bp, Artificial
  CRISPR gRNA sequence
aggggccatgtgccctcgga

SEQ ID NO: 21029 - DNA, 20 bp, Artificial
  CRISPR gRNA sequence
aagcacgtggtggccacagt

SEQ ID NO: 21030 - DNA, 20 bp, Artificial
  CRISPR gRNA sequence
aaatgtagggccgggaaaca

SEQ ID NO: 21031 - DNA, 20 bp, Artificial
  CRISPR gRNA sequence
ggaaccaggagccgggaacc

SEQ ID NO: 21032 - DNA, 20 bp, Artificial
  CRISPR gRNA sequence
caggagccgggaacccggag

SEQ ID NO: 21033 - DNA, 20 bp, Artificial
  CRISPR gRNA sequence
gggtggcaggaaagcctggc

SEQ ID NO: 21034 - DNA, 20 bp, Artificial
  CRISPR gRNA sequence
tggaccagggccgccgttcc

SEQ ID NO: 21035 - DNA, 20 bp, Artificial
  CRISPR gRNA sequence
cttgatctctcacttctcta

SEQ ID NO: 21036 - DNA, 20 bp, Artificial
  CRISPR gRNA sequence
gcgaatgccggggtgggagt

SEQ ID NO: 21037 - DNA, 20 bp, Artificial
  CRISPR gRNA sequence
gaaagccggaatcggagcca

SEQ ID NO: 21038 - DNA, 20 bp, Artificial
  CRISPR gRNA sequence
ccggaatcggagccaccatg

SEQ ID NO: 21039 - DNA, 20 bp, Artificial
  CRISPR gRNA sequence
tctaactttggcaggaagtc

SEQ ID NO: 21040 - DNA, 20 bp, Artificial
  CRISPR gRNA sequence
taaataaatacttctccgga

SEQ ID NO: 21041 - DNA, 20 bp, Artificial
  CRISPR gRNA sequence
cctggtctccaacaatctca

SEQ ID NO: 21042 - DNA, 20 bp, Artificial
  CRISPR gRNA sequence
ctatcccaggtgactccaat

SEQ ID NO: 21043 - DNA, 20 bp, Artificial
  CRISPR gRNA sequence
atcagaaaaggagtaccagg

SEQ ID NO: 21044 - DNA, 20 bp, Artificial
  CRISPR gRNA sequence
aaaaggagtaccaggaggtg

SEQ ID NO: 21045 - DNA, 20 bp, Artificial
  CRISPR gRNA sequence
gagtaccaggaggtgttttg

SEQ ID NO: 21046 - DNA, 20 bp, Artificial
  CRISPR gRNA sequence
ccaggaggtgttttgttttg

SEQ ID NO: 21047 - DNA, 20 bp, Artificial
  CRISPR gRNA sequence
ttgcttaacgccacatagca

SEQ ID NO: 21048 - DNA, 20 bp, Artificial
  CRISPR gRNA sequence
atagcaagcagtttgcagac

SEQ ID NO: 21049 - DNA, 20 bp, Artificial
  CRISPR gRNA sequence
tacccagtctgtctgatggc

SEQ ID NO: 21050 - DNA, 20 bp, Artificial
  CRISPR gRNA sequence
agtctgtctgatggctgggg

SEQ ID NO: 21051 - DNA, 20 bp, Artificial
  CRISPR gRNA sequence
agaaattaacccaaggaaac

SEQ ID NO: 21052 - DNA, 20 bp, Artificial
  CRISPR gRNA sequence
aggaaacttctggacttagc

SEQ ID NO: 21053 - DNA, 20 bp, Artificial
  CRISPR gRNA sequence
ctgtaaaatggataaaacat

SEQ ID NO: 21054 - DNA, 20 bp, Artificial
  CRISPR gRNA sequence
aaaatggataaaacatgaga

SEQ ID NO: 21055 - DNA, 20 bp, Artificial
  CRISPR gRNA sequence
aataattattatagatccta

SEQ ID NO: 21056 - DNA, 20 bp, Artificial
  CRISPR gRNA sequence
attattatagatcctaaagg

SEQ ID NO: 21057 - DNA, 20 bp, Artificial
  CRISPR gRNA sequence
cactttgggaggccgaggcg

SEQ ID NO: 21058 - DNA, 20 bp, Artificial
  CRISPR gRNA sequence
ttgggaggccgaggcgggtg

SEQ ID NO: 21059 - DNA, 20 bp, Artificial
  CRISPR gRNA sequence
aactctactaaaacactttt

SEQ ID NO: 21060 - DNA, 20 bp, Artificial
  CRISPR gRNA sequence
aatcacttgaacccaagagg

SEQ ID NO: 21061 - DNA, 20 bp, Artificial
  CRISPR gRNA sequence
aggtggaggttacccgagag

SEQ ID NO: 21062 - DNA, 20 bp, Artificial
  CRISPR gRNA sequence
gaggaaagcataggcagatg

SEQ ID NO: 21063 - DNA, 20 bp, Artificial
  CRISPR gRNA sequence
cagaaaggggcattagttac

SEQ ID NO: 21064 - DNA, 20 bp, Artificial
  CRISPR gRNA sequence
attctcataggaaggacata

SEQ ID NO: 21065 - DNA, 20 bp, Artificial
  CRISPR gRNA sequence
taggaaggacatagatagtt

SEQ ID NO: 21066 - DNA, 20 bp, Artificial
  CRISPR gRNA sequence
tctgacatcaaggacaaagt

SEQ ID NO: 21067 - DNA, 20 bp, Artificial
  CRISPR gRNA sequence
acaaagtctctgattttccc

SEQ ID NO: 21068 - DNA, 20 bp, Artificial
  CRISPR gRNA sequence
cctgatgtttgacagtgccc

SEQ ID NO: 21069 - DNA, 20 bp, Artificial
  CRISPR gRNA sequence
tgacagtgccctaatgcttg

SEQ ID NO: 21070 - DNA, 20 bp, Artificial
  CRISPR gRNA sequence
ttaacaaagtggtaaagaag

SEQ ID NO: 21071 - DNA, 20 bp, Artificial
  CRISPR gRNA sequence
agctgagattattttagtaa

SEQ ID NO: 21072 - DNA, 20 bp, Artificial
  CRISPR gRNA sequence
tttcaaccacaagtgatact

SEQ ID NO: 21073 - DNA, 20 bp, Artificial
  CRISPR gRNA sequence
accacaagtgatactgttgg

SEQ ID NO: 21074 - DNA, 20 bp, Artificial
  CRISPR gRNA sequence
aagtgatactgttggtttgg

SEQ ID NO: 21075 - DNA, 20 bp, Artificial
  CRISPR gRNA sequence
ctgttggtttggttttgctt

SEQ ID NO: 21076 - DNA, 20 bp, Artificial
  CRISPR gRNA sequence
ttccgtttatacatggaaaa

SEQ ID NO: 21077 - DNA, 20 bp, Artificial
  CRISPR gRNA sequence
gtaactccaacttcctgtct

SEQ ID NO: 21078 - DNA, 20 bp, Artificial
  CRISPR gRNA sequence
gtgatatttgtctttttgtg

SEQ ID NO: 21079 - DNA, 20 bp, Artificial
  CRISPR gRNA sequence
ggacaaatatctgtctgact

SEQ ID NO: 21080 - DNA, 20 bp, Artificial
  CRISPR gRNA sequence
actccccgctttcaactcta

SEQ ID NO: 21081 - DNA, 20 bp, Artificial
  CRISPR gRNA sequence
ttcttttaaaatcggtctat

SEQ ID NO: 21082 - DNA, 20 bp, Artificial
  CRISPR gRNA sequence
aaagatggaagacgaatgcc

SEQ ID NO: 21083 - DNA, 20 bp, Artificial
  CRISPR gRNA sequence
ttgggaggtcaaggcaggat

SEQ ID NO: 21084 - DNA, 20 bp, Artificial
  CRISPR gRNA sequence
taaaaataaatttttgaaaa

SEQ ID NO: 21085 - DNA, 20 bp, Artificial
  CRISPR gRNA sequence
aatcgcctgaacccaggagg

SEQ ID NO: 21086 - DNA, 20 bp, Artificial
  CRISPR gRNA sequence
tcaaaaaaaatgaaagaaaa

SEQ ID NO: 21087 - DNA, 20 bp, Artificial
  CRISPR gRNA sequence
tgggggtgaggcccaggacg

SEQ ID NO: 21088 - DNA, 20 bp, Artificial
  CRISPR gRNA sequence
gtcaggactggagtgtgggg

SEQ ID NO: 21089 - DNA, 20 bp, Artificial
  CRISPR gRNA sequence
agctggagatgatggcccat

SEQ ID NO: 21090 - DNA, 20 bp, Artificial
  CRISPR gRNA sequence
gatgatggcccattcgagtt

SEQ ID NO: 21091 - DNA, 20 bp, Artificial
  CRISPR gRNA sequence
atcgggacccagagaagata

SEQ ID NO: 21092 - DNA, 20 bp, Artificial
  CRISPR gRNA sequence
ggtgtcttttgtggggtcct

SEQ ID NO: 21093 - DNA, 20 bp, Artificial
  CRISPR gRNA sequence
atagaagtaagttgtctcag

SEQ ID NO: 21094 - DNA, 20 bp, Artificial
  CRISPR gRNA sequence
ctgggaagccaagtaggaga

SEQ ID NO: 21095 - DNA, 20 bp, Artificial
  CRISPR gRNA sequence
gagatggagatttgcatata

SEQ ID NO: 21096 - DNA, 20 bp, Artificial
  CRISPR gRNA sequence
catcattattacccaaggtc

SEQ ID NO: 21097 - DNA, 20 bp, Artificial
  CRISPR gRNA sequence
attattacccaaggtccatg

SEQ ID NO: 21098 - DNA, 20 bp, Artificial
  CRISPR gRNA sequence
ggtccatggtttgtttacat

SEQ ID NO: 21099 - DNA, 20 bp, Artificial
  CRISPR gRNA sequence
ctcttggtgttgtacattct

SEQ ID NO: 21100 - DNA, 20 bp, Artificial
  CRISPR gRNA sequence
cagactcatttcacttgtga

SEQ ID NO: 21101 - DNA, 20 bp, Artificial
  CRISPR gRNA sequence
ctgctgagaagccctttggc

SEQ ID NO: 21102 - DNA, 20 bp, Artificial
  CRISPR gRNA sequence
agggattgcagccaatttta

SEQ ID NO: 21103 - DNA, 20 bp, Artificial
  CRISPR gRNA sequence
actttcctgctctgaagtta

SEQ ID NO: 21104 - DNA, 20 bp, Artificial
  CRISPR gRNA sequence
tttgcatcccacagttccca

SEQ ID NO: 21105 - DNA, 20 bp, Artificial
  CRISPR gRNA sequence
atcttttatttctgaagaga

SEQ ID NO: 21106 - DNA, 20 bp, Artificial
  CRISPR gRNA sequence
ctcctcagcctcccaaagtg

SEQ ID NO: 21107 - DNA, 20 bp, Artificial
  CRISPR gRNA sequence
ggattacaggtgtgatctca

SEQ ID NO: 21108 - DNA, 20 bp, Artificial
  CRISPR gRNA sequence
caccccagatgctgcaactt

SEQ ID NO: 21109 - DNA, 20 bp, Artificial
  CRISPR gRNA sequence
tccttctctgtgtggaactg

SEQ ID NO: 21110 - DNA, 20 bp, Artificial
  CRISPR gRNA sequence
tctatatagagacattgtga

SEQ ID NO: 21111 - DNA, 20 bp, Artificial
  CRISPR gRNA sequence
ttagacacacacacacttat

SEQ ID NO: 21112 - DNA, 20 bp, Artificial
  CRISPR gRNA sequence
caaaacaaataggcctatcg

SEQ ID NO: 21113 - DNA, 20 bp, Artificial
  CRISPR gRNA sequence
gcctatcgactggattcaac

SEQ ID NO: 21114 - DNA, 20 bp, Artificial
  CRISPR gRNA sequence
aagcccctgtggcacagctg

SEQ ID NO: 21115 - DNA, 20 bp, Artificial
  CRISPR gRNA sequence
gaggagcttgcaggtcagaa

SEQ ID NO: 21116 - DNA, 20 bp, Artificial
  CRISPR gRNA sequence
gacaaatgatcagatcctgc

SEQ ID NO: 21117 - DNA, 20 bp, Artificial
  CRISPR gRNA sequence
attgcagtgttgctacatgc

SEQ ID NO: 21118 - DNA, 20 bp, Artificial
  CRISPR gRNA sequence
tgaaagtcttgagtgagacc

SEQ ID NO: 21119 - DNA, 20 bp, Artificial
  CRISPR gRNA sequence
gttctcctgggatatctaca

SEQ ID NO: 21120 - DNA, 20 bp, Artificial
  CRISPR gRNA sequence
aaacagcaggctggagagtg

SEQ ID NO: 21121 - DNA, 20 bp, Artificial
  CRISPR gRNA sequence
gcctgtggggtggcaagagc

SEQ ID NO: 21122 - DNA, 20 bp, Artificial
  CRISPR gRNA sequence
gtggggtggcaagagcagag

SEQ ID NO: 21123 - DNA, 20 bp, Artificial
  CRISPR gRNA sequence
acctcaccccatgaatcctc

SEQ ID NO: 21124 - DNA, 20 bp, Artificial
  CRISPR gRNA sequence
caacccctgggcctttaaac

SEQ ID NO: 21125 - DNA, 20 bp, Artificial
  CRISPR gRNA sequence
ctatgatctttggttcacat

SEQ ID NO: 21126 - DNA, 20 bp, Artificial
  CRISPR gRNA sequence
aatgcatttcaggtgtatct

SEQ ID NO: 21127 - DNA, 20 bp, Artificial
  CRISPR gRNA sequence
tttgtatgtgctcttataaa

SEQ ID NO: 21128 - DNA, 20 bp, Artificial
  CRISPR gRNA sequence
gtctcactctgtcacccagg

SEQ ID NO: 21129 - DNA, 20 bp, Artificial
  CRISPR gRNA sequence
ttttctatttttagtagaga

SEQ ID NO: 21130 - DNA, 20 bp, Artificial
  CRISPR gRNA sequence
tgcgagtcaccacgcctggc

SEQ ID NO: 21131 - DNA, 20 bp, Artificial
  CRISPR gRNA sequence
tcttacttttgcattctgta

SEQ ID NO: 21132 - DNA, 20 bp, Artificial
  CRISPR gRNA sequence
atgtttttaggatctacttg

SEQ ID NO: 21133 - DNA, 20 bp, Artificial
  CRISPR gRNA sequence
ttgcttctgatgcatttgat

SEQ ID NO: 21134 - DNA, 20 bp, Artificial
  CRISPR gRNA sequence
tacagtatcaagtgtcactt

SEQ ID NO: 21135 - DNA, 20 bp, Artificial
  CRISPR gRNA sequence
tcactttgctgttttatttt

SEQ ID NO: 21136 - DNA, 20 bp, Artificial
  CRISPR gRNA sequence
gcactgtgccaacaaaatgc

SEQ ID NO: 21137 - DNA, 20 bp, Artificial
  CRISPR gRNA sequence
gtcacacagcaagtgtggaa

SEQ ID NO: 21138 - DNA, 20 bp, Artificial
  CRISPR gRNA sequence
ccttaaccactatgctatta

SEQ ID NO: 21139 - DNA, 20 bp, Artificial
  CRISPR gRNA sequence
ttacggggtgctcagtgaat

SEQ ID NO: 21140 - DNA, 20 bp, Artificial
  CRISPR gRNA sequence
tgctcagtgaatcattgttt

SEQ ID NO: 21141 - DNA, 20 bp, Artificial
  CRISPR gRNA sequence
ctttagaggggaaaagtgag

SEQ ID NO: 21142 - DNA, 20 bp, Artificial
  CRISPR gRNA sequence
gaaaagtgagagatgtttct

SEQ ID NO: 21143 - DNA, 20 bp, Artificial
  CRISPR gRNA sequence
agctactacccccacaaaga

SEQ ID NO: 21144 - DNA, 20 bp, Artificial
  CRISPR gRNA sequence
tagataggcattcctaggcc

SEQ ID NO: 21145 - DNA, 20 bp, Artificial
  CRISPR gRNA sequence
aacaccatttggcccccgga

SEQ ID NO: 21146 - DNA, 20 bp, Artificial
  CRISPR gRNA sequence
gagtagggaagtattccttc

SEQ ID NO: 21147 - DNA, 20 bp, Artificial
  CRISPR gRNA sequence
tgcctcagcctcccaagtag

SEQ ID NO: 21148 - DNA, 20 bp, Artificial
  CRISPR gRNA sequence
tttttgtatttttgcagaga

SEQ ID NO: 21149 - DNA, 20 bp, Artificial
  CRISPR gRNA sequence
agcctcggcctctcaaagtg

SEQ ID NO: 21150 - DNA, 20 bp, Artificial
  CRISPR gRNA sequence
tcacagttcagagcagtgct

SEQ ID NO: 21151 - DNA, 20 bp, Artificial
  CRISPR gRNA sequence
ataaggaaactgaggctcca

SEQ ID NO: 21152 - DNA, 20 bp, Artificial
  CRISPR gRNA sequence
tggtttaaaaaatgaactta

SEQ ID NO: 21153 - DNA, 20 bp, Artificial
  CRISPR gRNA sequence
gatgcatgcactgatcttca

SEQ ID NO: 21154 - DNA, 20 bp, Artificial
  CRISPR gRNA sequence
agttagaacattgtggcgac

SEQ ID NO: 21155 - DNA, 20 bp, Artificial
  CRISPR gRNA sequence
ggtgaattgttatttcagac

SEQ ID NO: 21156 - DNA, 20 bp, Artificial
  CRISPR gRNA sequence
ggtggtggcccagggggaag

SEQ ID NO: 21157 - DNA, 20 bp, Artificial
  CRISPR gRNA sequence
gggctgagactttggagatg

SEQ ID NO: 21158 - DNA, 20 bp, Artificial
  CRISPR gRNA sequence
cctccatcccgctctggcaa

SEQ ID NO: 21159 - DNA, 20 bp, Artificial
  CRISPR gRNA sequence
ggatagaggaaggtcccatg

SEQ ID NO: 21160 - DNA, 20 bp, Artificial
  CRISPR gRNA sequence
ctagagtcttgggcctgaat

SEQ ID NO: 21161 - DNA, 20 bp, Artificial
  CRISPR gRNA sequence
ctttgacaccctctaatgta

SEQ ID NO: 21162 - DNA, 20 bp, Artificial
  CRISPR gRNA sequence
gtaatgggcttcctttgact

SEQ ID NO: 21163 - DNA, 20 bp, Artificial
  CRISPR gRNA sequence
tgatcctgcaggacaatctt

SEQ ID NO: 21164 - DNA, 20 bp, Artificial
  CRISPR gRNA sequence
gcaggacaatcttttttgtt

SEQ ID NO: 21165 - DNA, 20 bp, Artificial
  CRISPR gRNA sequence
aatcttttttgttttttgtt

SEQ ID NO: 21166 - DNA, 20 bp, Artificial
  CRISPR gRNA sequence
agcctctgcctcccaggttc

SEQ ID NO: 21167 - DNA, 20 bp, Artificial
  CRISPR gRNA sequence
tgcctcagcctcccaagtag

SEQ ID NO: 21168 - DNA, 20 bp, Artificial
  CRISPR gRNA sequence
attttgtatttttagtagag

SEQ ID NO: 21169 - DNA, 20 bp, Artificial
  CRISPR gRNA sequence
actctaccctgccttttccc

SEQ ID NO: 21170 - DNA, 20 bp, Artificial
  CRISPR gRNA sequence
atccttgatcacccaagagg

SEQ ID NO: 21171 - DNA, 20 bp, Artificial
  CRISPR gRNA sequence
caagaggaagtgcttaaggt

SEQ ID NO: 21172 - DNA, 20 bp, Artificial
  CRISPR gRNA sequence
ggggcgctgaaatgtgtatt

SEQ ID NO: 21173 - DNA, 20 bp, Artificial
  CRISPR gRNA sequence
tgtattgggggcttctggga

SEQ ID NO: 21174 - DNA, 20 bp, Artificial
  CRISPR gRNA sequence
atgcacatcaccacgcccag

SEQ ID NO: 21175 - DNA, 20 bp, Artificial
  CRISPR gRNA sequence
ttttgtgttatttgtagaga

SEQ ID NO: 21176 - DNA, 20 bp, Artificial
  CRISPR gRNA sequence
ttatgcaaaagaacagaaag

SEQ ID NO: 21177 - DNA, 20 bp, Artificial
  CRISPR gRNA sequence
gaacagaaagctcggcttca

SEQ ID NO: 21178 - DNA, 20 bp, Artificial
  CRISPR gRNA sequence
acttctgttcattcagcact

SEQ ID NO: 21179 - DNA, 20 bp, Artificial
  CRISPR gRNA sequence
atatggaaactgaggctcca

SEQ ID NO: 21180 - DNA, 20 bp, Artificial
  CRISPR gRNA sequence
ctcaatttatttctctgact

SEQ ID NO: 21181 - DNA, 20 bp, Artificial
  CRISPR gRNA sequence
aaccacacagcagtgtcatc

SEQ ID NO: 21182 - DNA, 20 bp, Artificial
  CRISPR gRNA sequence
ctgtgataccacctgtgtct

SEQ ID NO: 21183 - DNA, 20 bp, Artificial
  CRISPR gRNA sequence
tgcagagtgaaggaaagagg

SEQ ID NO: 21184 - DNA, 20 bp, Artificial
  CRISPR gRNA sequence
cccaatgccctgtgagaaaa

SEQ ID NO: 21185 - DNA, 20 bp, Artificial
  CRISPR gRNA sequence
tcacactgcctcaaagagga

SEQ ID NO: 21186 - DNA, 20 bp, Artificial
  CRISPR gRNA sequence
ttttctcactgctctgagag

SEQ ID NO: 21187 - DNA, 20 bp, Artificial
  CRISPR gRNA sequence
catctcacccccaaccatct

SEQ ID NO: 21188 - DNA, 20 bp, Artificial
  CRISPR gRNA sequence
gcggtggccccatctttcag

SEQ ID NO: 21189 - DNA, 20 bp, Artificial
  CRISPR gRNA sequence
gggatctcgctgcaagccgg

SEQ ID NO: 21190 - DNA, 20 bp, Artificial
  CRISPR gRNA sequence
caagtgggcccagccagtgc

SEQ ID NO: 21191 - DNA, 20 bp, Artificial
  CRISPR gRNA sequence
ttgggaggttgaagcaggag

SEQ ID NO: 21192 - DNA, 20 bp, Artificial
  CRISPR gRNA sequence
gaggcagaggttgcagtgag

SEQ ID NO: 21193 - DNA, 20 bp, Artificial
  CRISPR gRNA sequence
aatggggtggcaagttgagt

SEQ ID NO: 21194 - DNA, 20 bp, Artificial
  CRISPR gRNA sequence
agttgagtgtgtgttttctc

SEQ ID NO: 21195 - DNA, 20 bp, Artificial
  CRISPR gRNA sequence
taggagcctccctctggtct

SEQ ID NO: 21196 - DNA, 20 bp, Artificial
  CRISPR gRNA sequence
tacctcctccaggaagctcc

SEQ ID NO: 21197 - DNA, 20 bp, Artificial
  CRISPR gRNA sequence
aatcccagcactttgggaag

SEQ ID NO: 21198 - DNA, 20 bp, Artificial
  CRISPR gRNA sequence
tcaggagactggggcaggag

SEQ ID NO: 21199 - DNA, 20 bp, Artificial
  CRISPR gRNA sequence
agatcttgaaatgacatcat

SEQ ID NO: 21200 - DNA, 20 bp, Artificial
  CRISPR gRNA sequence
aggtgatgtggccactaaag

SEQ ID NO: 21201 - DNA, 20 bp, Artificial
  CRISPR gRNA sequence
cagcgtggccctgctgacac

SEQ ID NO: 21202 - DNA, 20 bp, Artificial
  CRISPR gRNA sequence
gagctacctggatgctggta

SEQ ID NO: 21203 - DNA, 20 bp, Artificial
  CRISPR gRNA sequence
tagagccacacagatgagcc

SEQ ID NO: 21204 - DNA, 20 bp, Artificial
  CRISPR gRNA sequence
ccacacagatgagccttcag

SEQ ID NO: 21205 - DNA, 20 bp, Artificial
  CRISPR gRNA sequence
gagctacatgatcttgagga

SEQ ID NO: 21206 - DNA, 20 bp, Artificial
  CRISPR gRNA sequence
tcatctgccaatggagacaa

SEQ ID NO: 21207 - DNA, 20 bp, Artificial
  CRISPR gRNA sequence
gagacaataatgcttacttc

SEQ ID NO: 21208 - DNA, 20 bp, Artificial
  CRISPR gRNA sequence
atgcttacttcctaggtttt

SEQ ID NO: 21209 - DNA, 20 bp, Artificial
  CRISPR gRNA sequence
caggcggatcacttgaggtc

SEQ ID NO: 21210 - DNA, 20 bp, Artificial
  CRISPR gRNA sequence
tcaggaggctgaggcagaag

SEQ ID NO: 21211 - DNA, 20 bp, Artificial
  CRISPR gRNA sequence
gaggcagacgttgcagtgag

SEQ ID NO: 21212 - DNA, 20 bp, Artificial
  CRISPR gRNA sequence
caagccctaggcaaccacta

SEQ ID NO: 21213 - DNA, 20 bp, Artificial
  CRISPR gRNA sequence
ttaaaaaaaaattaatagag

SEQ ID NO: 21214 - DNA, 20 bp, Artificial
  CRISPR gRNA sequence
ggtcttgaacacctgggctc

SEQ ID NO: 21215 - DNA, 20 bp, Artificial
  CRISPR gRNA sequence
tgtctcagcctcccaaagtg

SEQ ID NO: 21216 - DNA, 20 bp, Artificial
  CRISPR gRNA sequence
cccctcctactttatgtctc

SEQ ID NO: 21217 - DNA, 20 bp, Artificial
  CRISPR gRNA sequence
ctttatgtctccatggattt

SEQ ID NO: 21218 - DNA, 20 bp, Artificial
  CRISPR gRNA sequence
acaatatgtgaccctttgtg

SEQ ID NO: 21219 - DNA, 20 bp, Artificial
  CRISPR gRNA sequence
atccatgttccagcatgtat

SEQ ID NO: 21220 - DNA, 20 bp, Artificial
  CRISPR gRNA sequence
tattgtatagataagcaaca

SEQ ID NO: 21221 - DNA, 20 bp, Artificial
  CRISPR gRNA sequence
tattttttggtggatatttg

SEQ ID NO: 21222 - DNA, 20 bp, Artificial
  CRISPR gRNA sequence
ccttctgtgaacattcgtgt

SEQ ID NO: 21223 - DNA, 20 bp, Artificial
  CRISPR gRNA sequence
taggtttttgtgtggatata

SEQ ID NO: 21224 - DNA, 20 bp, Artificial
  CRISPR gRNA sequence
gtgtggatatatctggtttt

SEQ ID NO: 21225 - DNA, 20 bp, Artificial
  CRISPR gRNA sequence
atctggtttttcttgttttc

SEQ ID NO: 21226 - DNA, 20 bp, Artificial
  CRISPR gRNA sequence
gatatttgaggtatccacat

SEQ ID NO: 21227 - DNA, 20 bp, Artificial
  CRISPR gRNA sequence
tttgaggtatccacatttgg

SEQ ID NO: 21228 - DNA, 20 bp, Artificial
  CRISPR gRNA sequence
tatccacatttgggattgtt

SEQ ID NO: 21229 - DNA, 20 bp, Artificial
  CRISPR gRNA sequence
ttagaatctgctcagactcc

SEQ ID NO: 21230 - DNA, 20 bp, Artificial
  CRISPR gRNA sequence
aatcctggttccacttggac

SEQ ID NO: 21231 - DNA, 20 bp, Artificial
  CRISPR gRNA sequence
atcacttcacctctctgagc

SEQ ID NO: 21232 - DNA, 20 bp, Artificial
  CRISPR gRNA sequence
tcatgtgcctggcgtatagg

SEQ ID NO: 21233 - DNA, 20 bp, Artificial
  CRISPR gRNA sequence
gggtctcctgactctctggt

SEQ ID NO: 21234 - DNA, 20 bp, Artificial
  CRISPR gRNA sequence
agttccttggaggaagggaa

SEQ ID NO: 21235 - DNA, 20 bp, Artificial
  CRISPR gRNA sequence
gcatataagaggtgctgaat

SEQ ID NO: 21236 - DNA, 20 bp, Artificial
  CRISPR gRNA sequence
gcccctagaaggtggctacc

SEQ ID NO: 21237 - DNA, 20 bp, Artificial
  CRISPR gRNA sequence
gatggacctggctggagaag

SEQ ID NO: 21238 - DNA, 20 bp, Artificial
  CRISPR gRNA sequence
tcttccggtatcccccaccc

SEQ ID NO: 21239 - DNA, 20 bp, Artificial
  CRISPR gRNA sequence
gaaggtgatgaagagaccag

SEQ ID NO: 21240 - DNA, 20 bp, Artificial
  CRISPR gRNA sequence
accaccaagaaaacaaaatc

SEQ ID NO: 21241 - DNA, 20 bp, Artificial
  CRISPR gRNA sequence
acctccatttctatacgcat

SEQ ID NO: 21242 - DNA, 20 bp, Artificial
  CRISPR gRNA sequence
caacaaaggaaatacatatt

SEQ ID NO: 21243 - DNA, 20 bp, Artificial
  CRISPR gRNA sequence
tcttttacaaatgaggaaat

SEQ ID NO: 21244 - DNA, 20 bp, Artificial
  CRISPR gRNA sequence
agagaggtgaaacgacctac

SEQ ID NO: 21245 - DNA, 20 bp, Artificial
  CRISPR gRNA sequence
gaaattctaacctaggtctt

SEQ ID NO: 21246 - DNA, 20 bp, Artificial
  CRISPR gRNA sequence
aaaagaaagtgtctggggtt

SEQ ID NO: 21247 - DNA, 20 bp, Artificial
  CRISPR gRNA sequence
tctggggttggaagatttgc

SEQ ID NO: 21248 - DNA, 20 bp, Artificial
  CRISPR gRNA sequence
tttgtagccttaagaagagc

SEQ ID NO: 21249 - DNA, 20 bp, Artificial
  CRISPR gRNA sequence
gtggtggtggtgttgctgct

SEQ ID NO: 21250 - DNA, 20 bp, Artificial
  CRISPR gRNA sequence
tggtggtgttgctgctagtg

SEQ ID NO: 21251 - DNA, 20 bp, Artificial
  CRISPR gRNA sequence
tgcagcccctaccaggaagt

SEQ ID NO: 21252 - DNA, 20 bp, Artificial
  CRISPR gRNA sequence
gtcctgcccccattttcctt

SEQ ID NO: 21253 - DNA, 20 bp, Artificial
  CRISPR gRNA sequence
aacagcagcattcagcagtt

SEQ ID NO: 21254 - DNA, 20 bp, Artificial
  CRISPR gRNA sequence
tggaggggactagtaattgt

SEQ ID NO: 21255 - DNA, 20 bp, Artificial
  CRISPR gRNA sequence
gtttcagaaattacagaact

SEQ ID NO: 21256 - DNA, 20 bp, Artificial
  CRISPR gRNA sequence
aattacagaactgagagctt

SEQ ID NO: 21257 - DNA, 20 bp, Artificial
  CRISPR gRNA sequence
tgactgcttccttcccttcc

SEQ ID NO: 21258 - DNA, 20 bp, Artificial
  CRISPR gRNA sequence
gatttacatgggggaagcag

SEQ ID NO: 21259 - DNA, 20 bp, Artificial
  CRISPR gRNA sequence
tcacaactggaggcagtcat

SEQ ID NO: 21260 - DNA, 20 bp, Artificial
  CRISPR gRNA sequence
attaaggatttgggcatgtc

SEQ ID NO: 21261 - DNA, 20 bp, Artificial
  CRISPR gRNA sequence
ttgggcatgtcataggattt

SEQ ID NO: 21262 - DNA, 20 bp, Artificial
  CRISPR gRNA sequence
cagtgcgttagtccattttt

SEQ ID NO: 21263 - DNA, 20 bp, Artificial
  CRISPR gRNA sequence
gtgtggggcatcacgaggca

SEQ ID NO: 21264 - DNA, 20 bp, Artificial
  CRISPR gRNA sequence
gacaacccattaacttatta

SEQ ID NO: 21265 - DNA, 20 bp, Artificial
  CRISPR gRNA sequence
tgtttatccactaatccatg

SEQ ID NO: 21266 - DNA, 20 bp, Artificial
  CRISPR gRNA sequence
acctctcaatactgccacat

SEQ ID NO: 21267 - DNA, 20 bp, Artificial
  CRISPR gRNA sequence
ataggggattacatttatac

SEQ ID NO: 21268 - DNA, 20 bp, Artificial
  CRISPR gRNA sequence
caaacattcacgtcataaca

SEQ ID NO: 21269 - DNA, 20 bp, Artificial
  CRISPR gRNA sequence
caagtctgctcctcaagtct

SEQ ID NO: 21270 - DNA, 20 bp, Artificial
  CRISPR gRNA sequence
ctcaagtctgtgggttttct

SEQ ID NO: 21271 - DNA, 20 bp, Artificial
  CRISPR gRNA sequence
gcagcatcctgaaatatgac

SEQ ID NO: 21272 - DNA, 20 bp, Artificial
  CRISPR gRNA sequence
agaagccttctatggctccc

SEQ ID NO: 21273 - DNA, 20 bp, Artificial
  CRISPR gRNA sequence
taccaccgtcacctatctct

SEQ ID NO: 21274 - DNA, 20 bp, Artificial
  CRISPR gRNA sequence
gtttcctaaacatactctga

SEQ ID NO: 21275 - DNA, 20 bp, Artificial
  CRISPR gRNA sequence
cccttcctccaggaagcctt

SEQ ID NO: 21276 - DNA, 20 bp, Artificial
  CRISPR gRNA sequence
gtagaacctctaattatcac

SEQ ID NO: 21277 - DNA, 20 bp, Artificial
  CRISPR gRNA sequence
acagtggttaaataagtagc

SEQ ID NO: 21278 - DNA, 20 bp, Artificial
  CRISPR gRNA sequence
gctcttctttgtagcagtag

SEQ ID NO: 21279 - DNA, 20 bp, Artificial
  CRISPR gRNA sequence
catggatacatacctcatcc

SEQ ID NO: 21280 - DNA, 20 bp, Artificial
  CRISPR gRNA sequence
atacatacctcatccttttg

SEQ ID NO: 21281 - DNA, 20 bp, Artificial
  CRISPR gRNA sequence
tggagtgtcagtgttcattc

SEQ ID NO: 21282 - DNA, 20 bp, Artificial
  CRISPR gRNA sequence
gtgggccttcagttagacct

SEQ ID NO: 21283 - DNA, 20 bp, Artificial
  CRISPR gRNA sequence
agttagaccttgttgattga

SEQ ID NO: 21284 - DNA, 20 bp, Artificial
  CRISPR gRNA sequence
cctgagcaaggacattttca

SEQ ID NO: 21285 - DNA, 20 bp, Artificial
  CRISPR gRNA sequence
gggtacaatagagactcacc

SEQ ID NO: 21286 - DNA, 20 bp, Artificial
  CRISPR gRNA sequence
agagactcaccttgggcttt

SEQ ID NO: 21287 - DNA, 20 bp, Artificial
  CRISPR gRNA sequence
attgattgtgtgagttggtc

SEQ ID NO: 21288 - DNA, 20 bp, Artificial
  CRISPR gRNA sequence
ccctccctgatccaacctag

SEQ ID NO: 21289 - DNA, 20 bp, Artificial
  CRISPR gRNA sequence
caaagcctgctgtgggtcca

SEQ ID NO: 21290 - DNA, 20 bp, Artificial
  CRISPR gRNA sequence
acaggagccttaaaatgtac

SEQ ID NO: 21291 - DNA, 20 bp, Artificial
  CRISPR gRNA sequence
gacaccacacttcagccacc

SEQ ID NO: 21292 - DNA, 20 bp, Artificial
  CRISPR gRNA sequence
cttctctgaccatccttcca

SEQ ID NO: 21293 - DNA, 20 bp, Artificial
  CRISPR gRNA sequence
accttgtgtgtctttttcct

SEQ ID NO: 21294 - DNA, 20 bp, Artificial
  CRISPR gRNA sequence
accttgtctttcttgctcgt

SEQ ID NO: 21295 - DNA, 20 bp, Artificial
  CRISPR gRNA sequence
aggtgaatcgcacacagggt

SEQ ID NO: 21296 - DNA, 20 bp, Artificial
  CRISPR gRNA sequence
cggctcacacctgtaatccc

SEQ ID NO: 21297 - DNA, 20 bp, Artificial
  CRISPR gRNA sequence
gggacggatcacttgaggtc

SEQ ID NO: 21298 - DNA, 20 bp, Artificial
  CRISPR gRNA sequence
tcgggaggctgaggcaggag

SEQ ID NO: 21299 - DNA, 20 bp, Artificial
  CRISPR gRNA sequence
ccactcctgttctgtagtcc

SEQ ID NO: 21300 - DNA, 20 bp, Artificial
  CRISPR gRNA sequence
tatcttagtcaacctatgtg

SEQ ID NO: 21301 - DNA, 20 bp, Artificial
  CRISPR gRNA sequence
gaaataaagcgagctcctgt

SEQ ID NO: 21302 - DNA, 20 bp, Artificial
  CRISPR gRNA sequence
tttatttacactattctgca

SEQ ID NO: 21303 - DNA, 20 bp, Artificial
  CRISPR gRNA sequence
gaggacacggtcctatcttc

SEQ ID NO: 21304 - DNA, 20 bp, Artificial
  CRISPR gRNA sequence
cttctttattttctttcttt

SEQ ID NO: 21305 - DNA, 20 bp, Artificial
  CRISPR gRNA sequence
tcttttcttgtttttcttct

SEQ ID NO: 21306 - DNA, 20 bp, Artificial
  CRISPR gRNA sequence
catttgataaatatttcccc

SEQ ID NO: 21307 - DNA, 20 bp, Artificial
  CRISPR gRNA sequence
tccccccaagattttattgt

SEQ ID NO: 21308 - DNA, 20 bp, Artificial
  CRISPR gRNA sequence
ctggcagatcacctgaggtc

SEQ ID NO: 21309 - DNA, 20 bp, Artificial
  CRISPR gRNA sequence
cagggaggctagggtgggag

SEQ ID NO: 21310 - DNA, 20 bp, Artificial
  CRISPR gRNA sequence
gaagcagaggttgcagtgag

SEQ ID NO: 21311 - DNA, 20 bp, Artificial
  CRISPR gRNA sequence
gcctgggcaacagagctaga

SEQ ID NO: 21312 - DNA, 20 bp, Artificial
  CRISPR gRNA sequence
tctgtttcaaaaaaaaaaaa

SEQ ID NO: 21313 - DNA, 20 bp, Artificial
  CRISPR gRNA sequence
catatacccaccatgtacca

SEQ ID NO: 21314 - DNA, 20 bp, Artificial
  CRISPR gRNA sequence
ttttgattctacaattaatg

SEQ ID NO: 21315 - DNA, 20 bp, Artificial
  CRISPR gRNA sequence
tgtacatttcaaatgtaaat

SEQ ID NO: 21316 - DNA, 20 bp, Artificial
  CRISPR gRNA sequence
tcctttcttttaaggccatg

SEQ ID NO: 21317 - DNA, 20 bp, Artificial
  CRISPR gRNA sequence
cgttgggtagatgaaccata

SEQ ID NO: 21318 - DNA, 20 bp, Artificial
  CRISPR gRNA sequence
agtcccttgctaagggacac

SEQ ID NO: 21319 - DNA, 20 bp, Artificial
  CRISPR gRNA sequence
ggtttttaatctgttgctgt

SEQ ID NO: 21320 - DNA, 20 bp, Artificial
  CRISPR gRNA sequence
gtgagtgcttgatactcact

SEQ ID NO: 21321 - DNA, 20 bp, Artificial
  CRISPR gRNA sequence
agcggttcaaaagcaggttc

SEQ ID NO: 21322 - DNA, 20 bp, Artificial
  CRISPR gRNA sequence
ttcaaaagcaggttcctttg

SEQ ID NO: 21323 - DNA, 20 bp, Artificial
  CRISPR gRNA sequence
aagcaggttcctttgttttg

SEQ ID NO: 21324 - DNA, 20 bp, Artificial
  CRISPR gRNA sequence
ggttcctttgttttgttttg

SEQ ID NO: 21325 - DNA, 20 bp, Artificial
  CRISPR gRNA sequence
tctgctgctacactgcctgg

SEQ ID NO: 21326 - DNA, 20 bp, Artificial
  CRISPR gRNA sequence
ctgcctggtatggtttgaga

SEQ ID NO: 21327 - DNA, 20 bp, Artificial
  CRISPR gRNA sequence
tgctagagtcctgagcccct

SEQ ID NO: 21328 - DNA, 20 bp, Artificial
  CRISPR gRNA sequence
tctccctggggcagctgatc

SEQ ID NO: 21329 - DNA, 20 bp, Artificial
  CRISPR gRNA sequence
tttctctgcagccttcccag

SEQ ID NO: 21330 - DNA, 20 bp, Artificial
  CRISPR gRNA sequence
atgccttggggaggggatgg

SEQ ID NO: 21331 - DNA, 20 bp, Artificial
  CRISPR gRNA sequence
cccttctttgggtagaggct

SEQ ID NO: 21332 - DNA, 20 bp, Artificial
  CRISPR gRNA sequence
gagtcctctaaggggctcac

SEQ ID NO: 21333 - DNA, 20 bp, Artificial
  CRISPR gRNA sequence
gactgtttgtggaaggtggt

SEQ ID NO: 21334 - DNA, 20 bp, Artificial
  CRISPR gRNA sequence
ggtggtaggggcttggagct

SEQ ID NO: 21335 - DNA, 20 bp, Artificial
  CRISPR gRNA sequence
gatgcgcctggagaaaaccg

SEQ ID NO: 21336 - DNA, 20 bp, Artificial
  CRISPR gRNA sequence
accagattcccagtatgtta

SEQ ID NO: 21337 - DNA, 20 bp, Artificial
  CRISPR gRNA sequence
tgttagggggcttggagaga

SEQ ID NO: 21338 - DNA, 20 bp, Artificial
  CRISPR gRNA sequence
tgtcactcacctctgcccca

SEQ ID NO: 21339 - DNA, 20 bp, Artificial
  CRISPR gRNA sequence
gaatctccctgagggaccca

SEQ ID NO: 21340 - DNA, 20 bp, Artificial
  CRISPR gRNA sequence
caaaaatcaaagcagaagag

SEQ ID NO: 21341 - DNA, 20 bp, Artificial
  CRISPR gRNA sequence
tggttgtgtggccttccata

SEQ ID NO: 21342 - DNA, 20 bp, Artificial
  CRISPR gRNA sequence
gttgctttccccttctgacc

SEQ ID NO: 21343 - DNA, 20 bp, Artificial
  CRISPR gRNA sequence
agtttttccttatttttttt

SEQ ID NO: 21344 - DNA, 20 bp, Artificial
  CRISPR gRNA sequence
tccttattttttttaaatgt

SEQ ID NO: 21345 - DNA, 20 bp, Artificial
  CRISPR gRNA sequence
actaataagctaatgacaag

SEQ ID NO: 21346 - DNA, 20 bp, Artificial
  CRISPR gRNA sequence
tcttttagtatactgatgtg

SEQ ID NO: 21347 - DNA, 20 bp, Artificial
  CRISPR gRNA sequence
tagtttggtgtgcatccttg

SEQ ID NO: 21348 - DNA, 20 bp, Artificial
  CRISPR gRNA sequence
gtgcatccttgcatagcttt

SEQ ID NO: 21349 - DNA, 20 bp, Artificial
  CRISPR gRNA sequence
gcatagctttctctgatttg

SEQ ID NO: 21350 - DNA, 20 bp, Artificial
  CRISPR gRNA sequence
tgtgacttgtctcagggaag

SEQ ID NO: 21351 - DNA, 20 bp, Artificial
  CRISPR gRNA sequence
tgtcagggatgagaccagga

SEQ ID NO: 21352 - DNA, 20 bp, Artificial
  CRISPR gRNA sequence
gcatccattcctggttgcaa

SEQ ID NO: 21353 - DNA, 20 bp, Artificial
  CRISPR gRNA sequence
tgagctaattgcacccattt

SEQ ID NO: 21354 - DNA, 20 bp, Artificial
  CRISPR gRNA sequence
agacttcctgagctccacag

SEQ ID NO: 21355 - DNA, 20 bp, Artificial
  CRISPR gRNA sequence
ccagccaagtaccccctccc

SEQ ID NO: 21356 - DNA, 20 bp, Artificial
  CRISPR gRNA sequence
ctgcctgtagggacaacagg

SEQ ID NO: 21357 - DNA, 20 bp, Artificial
  CRISPR gRNA sequence
aaatacagccatcagccttc

SEQ ID NO: 21358 - DNA, 20 bp, Artificial
  CRISPR gRNA sequence
agatcttttgaagttgaaaa

SEQ ID NO: 21359 - DNA, 20 bp, Artificial
  CRISPR gRNA sequence
ccctgatttttacatagata

SEQ ID NO: 21360 - DNA, 20 bp, Artificial
  CRISPR gRNA sequence
aacctccgccctacaggttc

SEQ ID NO: 21361 - DNA, 20 bp, Artificial
  CRISPR gRNA sequence
tttttgtaatttcagtagag

SEQ ID NO: 21362 - DNA, 20 bp, Artificial
  CRISPR gRNA sequence
tgcctcgacctcccaaagtg

SEQ ID NO: 21363 - DNA, 20 bp, Artificial
  CRISPR gRNA sequence
ccactgcacccagcctgata

SEQ ID NO: 21364 - DNA, 20 bp, Artificial
  CRISPR gRNA sequence
accctcaccctaaatctggc

SEQ ID NO: 21365 - DNA, 20 bp, Artificial
  CRISPR gRNA sequence
ggcagctggagaggtctcca

SEQ ID NO: 21366 - DNA, 20 bp, Artificial
  CRISPR gRNA sequence
ggtggagatggaagcccata

SEQ ID NO: 21367 - DNA, 20 bp, Artificial
  CRISPR gRNA sequence
attcattcattcattcactt

SEQ ID NO: 21368 - DNA, 20 bp, Artificial
  CRISPR gRNA sequence
aagagaattactaaattact

SEQ ID NO: 21369 - DNA, 20 bp, Artificial
  CRISPR gRNA sequence
tgctccagcaagtggtagaa

SEQ ID NO: 21370 - DNA, 20 bp, Artificial
  CRISPR gRNA sequence
gagtagtgatcaagcgaaga

SEQ ID NO: 21371 - DNA, 20 bp, Artificial
  CRISPR gRNA sequence
gaggtggaggttgccgtgag

SEQ ID NO: 21372 - DNA, 20 bp, Artificial
  CRISPR gRNA sequence
cactttgggaggccaaggcg

SEQ ID NO: 21373 - DNA, 20 bp, Artificial
  CRISPR gRNA sequence
ttgggaggccaaggcggaac

SEQ ID NO: 21374 - DNA, 20 bp, Artificial
  CRISPR gRNA sequence
ctactcaggaggctgaggtg

SEQ ID NO: 21375 - DNA, 20 bp, Artificial
  CRISPR gRNA sequence
tcaggaggctgaggtgggag

SEQ ID NO: 21376 - DNA, 20 bp, Artificial
  CRISPR gRNA sequence
gaggttgaagctgtggtgga

SEQ ID NO: 21377 - DNA, 20 bp, Artificial
  CRISPR gRNA sequence
ccggcggccgcgtgagacac

SEQ ID NO: 21378 - DNA, 20 bp, Artificial
  CRISPR gRNA sequence
gctggggcagtgagccgggc

SEQ ID NO: 21379 - DNA, 20 bp, Artificial
  CRISPR gRNA sequence
gagccgggcctgggcttgtg

SEQ ID NO: 21380 - DNA, 20 bp, Artificial
  CRISPR gRNA sequence
ttgtcttctctgtcccctgc

SEQ ID NO: 21381 - DNA, 20 bp, Artificial
  CRISPR gRNA sequence
cagccactcgtggcggccga

SEQ ID NO: 21382 - DNA, 20 bp, Artificial
  CRISPR gRNA sequence
accgcgttctgctcatccta

SEQ ID NO: 21383 - DNA, 20 bp, Artificial
  CRISPR gRNA sequence
tcgaggagctggaagcgcaa

SEQ ID NO: 21384 - DNA, 20 bp, Artificial
  CRISPR gRNA sequence
ccgacgccctatttgagctg

SEQ ID NO: 21385 - DNA, 20 bp, Artificial
  CRISPR gRNA sequence
ccagctctcagaggccctgc

SEQ ID NO: 21386 - DNA, 20 bp, Artificial
  CRISPR gRNA sequence
tgaggacctgggcgatggcc

SEQ ID NO: 21387 - DNA, 20 bp, Artificial
  CRISPR gRNA sequence
cagagtccgagctggccttc

SEQ ID NO: 21388 - DNA, 20 bp, Artificial
  CRISPR gRNA sequence
ccttccccagcttcctcctg

SEQ ID NO: 21389 - DNA, 20 bp, Artificial
  CRISPR gRNA sequence
acaactggctggagggcgtg

SEQ ID NO: 21390 - DNA, 20 bp, Artificial
  CRISPR gRNA sequence
ctcggtggacaggaagcaga

SEQ ID NO: 21391 - DNA, 20 bp, Artificial
  CRISPR gRNA sequence
gcagcactggcatttgcccc

SEQ ID NO: 21392 - DNA, 20 bp, Artificial
  CRISPR gRNA sequence
tcgtgggactcagctgtgtc

SEQ ID NO: 21393 - DNA, 20 bp, Artificial
  CRISPR gRNA sequence
cacccgtttcaggtggggtg

SEQ ID NO: 21394 - DNA, 20 bp, Artificial
  CRISPR gRNA sequence
agagcagccgggtggggcag

SEQ ID NO: 21395 - DNA, 20 bp, Artificial
  CRISPR gRNA sequence
tgagactgacctgggctcaa

SEQ ID NO: 21396 - DNA, 20 bp, Artificial
  CRISPR gRNA sequence
tttccaccccctgagcacgc

SEQ ID NO: 21397 - DNA, 20 bp, Artificial
  CRISPR gRNA sequence
ccaatcttctcagaacttga

SEQ ID NO: 21398 - DNA, 20 bp, Artificial
  CRISPR gRNA sequence
tgaatctgattgtatcccat

SEQ ID NO: 21399 - DNA, 20 bp, Artificial
  CRISPR gRNA sequence
atgaaggctaaattccttaa

SEQ ID NO: 21400 - DNA, 20 bp, Artificial
  CRISPR gRNA sequence
tttcattaagtcggtctgca

SEQ ID NO: 21401 - DNA, 20 bp, Artificial
  CRISPR gRNA sequence
tctgcaatctgcttgagcat

SEQ ID NO: 21402 - DNA, 20 bp, Artificial
  CRISPR gRNA sequence
agcatttcagcttaatcgcc

SEQ ID NO: 21403 - DNA, 20 bp, Artificial
  CRISPR gRNA sequence
tttcagcttaatcgccagag

SEQ ID NO: 21404 - DNA, 20 bp, Artificial
  CRISPR gRNA sequence
attgtgccaataatttagca

SEQ ID NO: 21405 - DNA, 20 bp, Artificial
  CRISPR gRNA sequence
taaaggctggagtggtcatg

SEQ ID NO: 21406 - DNA, 20 bp, Artificial
  CRISPR gRNA sequence
gaaggatgtggaagacctgg

SEQ ID NO: 21407 - DNA, 20 bp, Artificial
  CRISPR gRNA sequence
aggacatgtaggacccattc

SEQ ID NO: 21408 - DNA, 20 bp, Artificial
  CRISPR gRNA sequence
aggtccagaaggcagacaaa

SEQ ID NO: 21409 - DNA, 20 bp, Artificial
  CRISPR gRNA sequence
tcattcattccttcatcaca

SEQ ID NO: 21410 - DNA, 20 bp, Artificial
  CRISPR gRNA sequence
ctagaatacagtagtgcgat

SEQ ID NO: 21411 - DNA, 20 bp, Artificial
  CRISPR gRNA sequence
gtagtgcgatcatagcttac

SEQ ID NO: 21412 - DNA, 20 bp, Artificial
  CRISPR gRNA sequence
tgcctcagcctcccaagtag

SEQ ID NO: 21413 - DNA, 20 bp, Artificial
  CRISPR gRNA sequence
taggtgcacgtcatcacacc

SEQ ID NO: 21414 - DNA, 20 bp, Artificial
  CRISPR gRNA sequence
tcatcacaccggatgatttt

SEQ ID NO: 21415 - DNA, 20 bp, Artificial
  CRISPR gRNA sequence
tgttcgggacctaaagaaac

SEQ ID NO: 21416 - DNA, 20 bp, Artificial
  CRISPR gRNA sequence
ggagtttgcgtaagcaaagg

SEQ ID NO: 21417 - DNA, 20 bp, Artificial
  CRISPR gRNA sequence
gattgtcttgtgggtctgcg

SEQ ID NO: 21418 - DNA, 20 bp, Artificial
  CRISPR gRNA sequence
ggtttcccctgcagcattag

SEQ ID NO: 21419 - DNA, 20 bp, Artificial
  CRISPR gRNA sequence
ctcttgcccaccactttgga

SEQ ID NO: 21420 - DNA, 20 bp, Artificial
  CRISPR gRNA sequence
gtgggcaaatgctggaggtt

SEQ ID NO: 21421 - DNA, 20 bp, Artificial
  CRISPR gRNA sequence
ctcagatttgaagctaatgg

SEQ ID NO: 21422 - DNA, 20 bp, Artificial
  CRISPR gRNA sequence
ggaggaggtgatatctgcac

SEQ ID NO: 21423 - DNA, 20 bp, Artificial
  CRISPR gRNA sequence
agtggggagaggggagtaag

SEQ ID NO: 21424 - DNA, 20 bp, Artificial
  CRISPR gRNA sequence
ctgcacaacgtcccttgtgc

SEQ ID NO: 21425 - DNA, 20 bp, Artificial
  CRISPR gRNA sequence
acaacgtcccttgtgcctga

SEQ ID NO: 21426 - DNA, 20 bp, Artificial
  CRISPR gRNA sequence
tcccccattttgaaattccc

SEQ ID NO: 21427 - DNA, 20 bp, Artificial
  CRISPR gRNA sequence
ccctacttgcctgggactat

SEQ ID NO: 21428 - DNA, 20 bp, Artificial
  CRISPR gRNA sequence
tatatttagatctgtcagaa

SEQ ID NO: 21429 - DNA, 20 bp, Artificial
  CRISPR gRNA sequence
cttttcttctttttctttct

SEQ ID NO: 21430 - DNA, 20 bp, Artificial
  CRISPR gRNA sequence
tttttgtattttttgtagag

SEQ ID NO: 21431 - DNA, 20 bp, Artificial
  CRISPR gRNA sequence
cacctcagcctcccaaagtg

SEQ ID NO: 21432 - DNA, 20 bp, Artificial
  CRISPR gRNA sequence
agctcccgcacctggccaga

SEQ ID NO: 21433 - DNA, 20 bp, Artificial
  CRISPR gRNA sequence
gctgagaacaagagacttta

SEQ ID NO: 21434 - DNA, 20 bp, Artificial
  CRISPR gRNA sequence
ttccacagaaaaagctaaat

SEQ ID NO: 21435 - DNA, 20 bp, Artificial
  CRISPR gRNA sequence
tggtaggggtctagatcatc

SEQ ID NO: 21436 - DNA, 20 bp, Artificial
  CRISPR gRNA sequence
tatgcctgtggtatattcgg

SEQ ID NO: 21437 - DNA, 20 bp, Artificial
  CRISPR gRNA sequence
tgcctcagcctcccgagtag

SEQ ID NO: 21438 - DNA, 20 bp, Artificial
  CRISPR gRNA sequence
tttttgtatttttagtagag

SEQ ID NO: 21439 - DNA, 20 bp, Artificial
  CRISPR gRNA sequence
cacctcagcctcccaaagtg

SEQ ID NO: 21440 - DNA, 20 bp, Artificial
  CRISPR gRNA sequence
tacaggtgtaagccaccatg

SEQ ID NO: 21441 - DNA, 20 bp, Artificial
  CRISPR gRNA sequence
cccagaaaaaagccagtgtc

SEQ ID NO: 21442 - DNA, 20 bp, Artificial
  CRISPR gRNA sequence
agactatttctggcattttc

SEQ ID NO: 21443 - DNA, 20 bp, Artificial
  CRISPR gRNA sequence
cactcacaaccctacaggga

SEQ ID NO: 21444 - DNA, 20 bp, Artificial
  CRISPR gRNA sequence
tccagccacagggcctcctt

SEQ ID NO: 21445 - DNA, 20 bp, Artificial
  CRISPR gRNA sequence
gctggctttcaacctcctag

SEQ ID NO: 21446 - DNA, 20 bp, Artificial
  CRISPR gRNA sequence
gccttttcttttctttcttt

SEQ ID NO: 21447 - DNA, 20 bp, Artificial
  CRISPR gRNA sequence
aacctcctcctcccaagtcc

SEQ ID NO: 21448 - DNA, 20 bp, Artificial
  CRISPR gRNA sequence
ttttgtatttttagtagaga

SEQ ID NO: 21449 - DNA, 20 bp, Artificial
  CRISPR gRNA sequence
cacctcggcctcccaaagtg

SEQ ID NO: 21450 - DNA, 20 bp, Artificial
  CRISPR gRNA sequence
ataaaactctggccaggcgc

SEQ ID NO: 21451 - DNA, 20 bp, Artificial
  CRISPR gRNA sequence
ggcaggtggatcacaaggcc

SEQ ID NO: 21452 - DNA, 20 bp, Artificial
  CRISPR gRNA sequence
ctgagatcacgccactgcag

SEQ ID NO: 21453 - DNA, 20 bp, Artificial
  CRISPR gRNA sequence
cctcaccactgtatatttcc

SEQ ID NO: 21454 - DNA, 20 bp, Artificial
  CRISPR gRNA sequence
tatgattcattgtctcagac

SEQ ID NO: 21455 - DNA, 20 bp, Artificial
  CRISPR gRNA sequence
attcattgtctcagacatca

SEQ ID NO: 21456 - DNA, 20 bp, Artificial
  CRISPR gRNA sequence
gtctcagacatcagcttgct

SEQ ID NO: 21457 - DNA, 20 bp, Artificial
  CRISPR gRNA sequence
atcagcttgctttccgattt

SEQ ID NO: 21458 - DNA, 20 bp, Artificial
  CRISPR gRNA sequence
gaatgtcagcacccagaagg

SEQ ID NO: 21459 - DNA, 20 bp, Artificial
  CRISPR gRNA sequence
cccagaaggcagggattttc

SEQ ID NO: 21460 - DNA, 20 bp, Artificial
  CRISPR gRNA sequence
gccttaatccaagaaccccc

SEQ ID NO: 21461 - DNA, 20 bp, Artificial
  CRISPR gRNA sequence
gagatcaagacttaagggtg

SEQ ID NO: 21462 - DNA, 20 bp, Artificial
  CRISPR gRNA sequence
gaggccagtgttctcagact

SEQ ID NO: 21463 - DNA, 20 bp, Artificial
  CRISPR gRNA sequence
ttcgagtgaccgtgcgcggt

SEQ ID NO: 21464 - DNA, 20 bp, Artificial
  CRISPR gRNA sequence
cgtgcgcggttactgttttt

SEQ ID NO: 21465 - DNA, 20 bp, Artificial
  CRISPR gRNA sequence
gctatttgatcgcctagtgc

SEQ ID NO: 21466 - DNA, 20 bp, Artificial
  CRISPR gRNA sequence
agggaagggcctagcatgcc

SEQ ID NO: 21467 - DNA, 20 bp, Artificial
  CRISPR gRNA sequence
aaaggcatattagtcaacca

SEQ ID NO: 21468 - DNA, 20 bp, Artificial
  CRISPR gRNA sequence
tacctctttttcttttcttt

SEQ ID NO: 21469 - DNA, 20 bp, Artificial
  CRISPR gRNA sequence
ctccacctcctgggctcaag

SEQ ID NO: 21470 - DNA, 20 bp, Artificial
  CRISPR gRNA sequence
ccaccacacttggctaatta

SEQ ID NO: 21471 - DNA, 20 bp, Artificial
  CRISPR gRNA sequence
atgaaatctaccccaagcag

SEQ ID NO: 21472 - DNA, 20 bp, Artificial
  CRISPR gRNA sequence
ctgggccctgtctcaggccc

SEQ ID NO: 21473 - DNA, 20 bp, Artificial
  CRISPR gRNA sequence
gctacagtgcccagcaacct

SEQ ID NO: 21474 - DNA, 20 bp, Artificial
  CRISPR gRNA sequence
ctctcagcaattcagctggg

SEQ ID NO: 21475 - DNA, 20 bp, Artificial
  CRISPR gRNA sequence
taaggaagttgccaagcctc

SEQ ID NO: 21476 - DNA, 20 bp, Artificial
  CRISPR gRNA sequence
ttagttcctaagaagctaaa

SEQ ID NO: 21477 - DNA, 20 bp, Artificial
  CRISPR gRNA sequence
gacgctagctgatggccccc

SEQ ID NO: 21478 - DNA, 20 bp, Artificial
  CRISPR gRNA sequence
ctttttcaaaattaatttaa

SEQ ID NO: 21479 - DNA, 20 bp, Artificial
  CRISPR gRNA sequence
gcctcaaggaatctcctcac

SEQ ID NO: 21480 - DNA, 20 bp, Artificial
  CRISPR gRNA sequence
cacctccgcttcccaaagtg

SEQ ID NO: 21481 - DNA, 20 bp, Artificial
  CRISPR gRNA sequence
gacttaccatgcccagcccc

SEQ ID NO: 21482 - DNA, 20 bp, Artificial
  CRISPR gRNA sequence
cagccattcatccttccatt

SEQ ID NO: 21483 - DNA, 20 bp, Artificial
  CRISPR gRNA sequence
acctttctaggccctggaga

SEQ ID NO: 21484 - DNA, 20 bp, Artificial
  CRISPR gRNA sequence
aaagtatacagtaatgaaaa

SEQ ID NO: 21485 - DNA, 20 bp, Artificial
  CRISPR gRNA sequence
ctggggggtgaaataggaga

SEQ ID NO: 21486 - DNA, 20 bp, Artificial
  CRISPR gRNA sequence
ggtgaaataggagagataga

SEQ ID NO: 21487 - DNA, 20 bp, Artificial
  CRISPR gRNA sequence
gataagatacaggaggatca

SEQ ID NO: 21488 - DNA, 20 bp, Artificial
  CRISPR gRNA sequence
tttgtatttttttgtagaga

SEQ ID NO: 21489 - DNA, 20 bp, Artificial
  CRISPR gRNA sequence
tgcctctgcctcccaaagta

SEQ ID NO: 21490 - DNA, 20 bp, Artificial
  CRISPR gRNA sequence
gagtcactgtgcctggttca

SEQ ID NO: 21491 - DNA, 20 bp, Artificial
  CRISPR gRNA sequence
ttttgtatttttagtagaga

SEQ ID NO: 21492 - DNA, 20 bp, Artificial
  CRISPR gRNA sequence
cacctcagcctcccaaagtg

SEQ ID NO: 21493 - DNA, 20 bp, Artificial
  CRISPR gRNA sequence
gagccaccacgcccagttca

SEQ ID NO: 21494 - DNA, 20 bp, Artificial
  CRISPR gRNA sequence
tgtcctaggtaacactgtaa

SEQ ID NO: 21495 - DNA, 20 bp, Artificial
  CRISPR gRNA sequence
tgaagcccacaacccggcag

SEQ ID NO: 21496 - DNA, 20 bp, Artificial
  CRISPR gRNA sequence
tatcctcctatttaccgaga

SEQ ID NO: 21497 - DNA, 20 bp, Artificial
  CRISPR gRNA sequence
ttgaggtcaaagtgaggcat

SEQ ID NO: 21498 - DNA, 20 bp, Artificial
  CRISPR gRNA sequence
aatcaccacagccctgaaca

SEQ ID NO: 21499 - DNA, 20 bp, Artificial
  CRISPR gRNA sequence
gtcagttattcattcctagc

SEQ ID NO: 21500 - DNA, 20 bp, Artificial
  CRISPR gRNA sequence
ttcccccagggatggcggga

SEQ ID NO: 21501 - DNA, 20 bp, Artificial
  CRISPR gRNA sequence
tttttccggaacctaggggt

SEQ ID NO: 21502 - DNA, 20 bp, Artificial
  CRISPR gRNA sequence
ctggaaggctaaccacgtac

SEQ ID NO: 21503 - DNA, 20 bp, Artificial
  CRISPR gRNA sequence
cttgtcacttacatgccggt

SEQ ID NO: 21504 - DNA, 20 bp, Artificial
  CRISPR gRNA sequence
gtaggccttggcatagcacc

SEQ ID NO: 21505 - DNA, 20 bp, Artificial
  CRISPR gRNA sequence
tcccagaggtaatgagcgga

SEQ ID NO: 21506 - DNA, 20 bp, Artificial
  CRISPR gRNA sequence
acttactgaggacaaccaga

SEQ ID NO: 21507 - DNA, 20 bp, Artificial
  CRISPR gRNA sequence
ttatttttaatttttttaat

SEQ ID NO: 21508 - DNA, 20 bp, Artificial
  CRISPR gRNA sequence
tgcctcagtgctccgagtag

SEQ ID NO: 21509 - DNA, 20 bp, Artificial
  CRISPR gRNA sequence
ggcgcccaccaccacgtcca

SEQ ID NO: 21510 - DNA, 20 bp, Artificial
  CRISPR gRNA sequence
ttttatatttttagtagaga

SEQ ID NO: 21511 - DNA, 20 bp, Artificial
  CRISPR gRNA sequence
tcggcctcccaaagtgagta

SEQ ID NO: 21512 - DNA, 20 bp, Artificial
  CRISPR gRNA sequence
taatttcttcccagcatgat

SEQ ID NO: 21513 - DNA, 20 bp, Artificial
  CRISPR gRNA sequence
ttacaatattttatttatgt

SEQ ID NO: 21514 - DNA, 20 bp, Artificial
  CRISPR gRNA sequence
atgaactagacagatgtcgt

SEQ ID NO: 21515 - DNA, 20 bp, Artificial
  CRISPR gRNA sequence
gacagatgtcgttcttgctt

SEQ ID NO: 21516 - DNA, 20 bp, Artificial
  CRISPR gRNA sequence
ataaataaaatattgtaaaa

SEQ ID NO: 21517 - DNA, 20 bp, Artificial
  CRISPR gRNA sequence
agggtacaggacttctgggg

SEQ ID NO: 21518 - DNA, 20 bp, Artificial
  CRISPR gRNA sequence
gccctaagtgggaaaagggg

SEQ ID NO: 21519 - DNA, 20 bp, Artificial
  CRISPR gRNA sequence
tgtgggtcacaagaggtatt

SEQ ID NO: 21520 - DNA, 20 bp, Artificial
  CRISPR gRNA sequence
gcctgggaaggcgacacttg

SEQ ID NO: 21521 - DNA, 20 bp, Artificial
  CRISPR gRNA sequence
aagcactgcctcctgggttc

SEQ ID NO: 21522 - DNA, 20 bp, Artificial
  CRISPR gRNA sequence
tgcctcagcctcccaagtag

SEQ ID NO: 21523 - DNA, 20 bp, Artificial
  CRISPR gRNA sequence
gccaccacaccaggctattt

SEQ ID NO: 21524 - DNA, 20 bp, Artificial
  CRISPR gRNA sequence
ttttgtgttttcagtagaga

SEQ ID NO: 21525 - DNA, 20 bp, Artificial
  CRISPR gRNA sequence
cacctcagccttccaaagtg

SEQ ID NO: 21526 - DNA, 20 bp, Artificial
  CRISPR gRNA sequence
ggtgtgagccaccatgccca

SEQ ID NO: 21527 - DNA, 20 bp, Artificial
  CRISPR gRNA sequence
cttggcatcgatgaaatatg

SEQ ID NO: 21528 - DNA, 20 bp, Artificial
  CRISPR gRNA sequence
gaggaagggtctccagggtt

SEQ ID NO: 21529 - DNA, 20 bp, Artificial
  CRISPR gRNA sequence
cagagattgcaaaaccccca

SEQ ID NO: 21530 - DNA, 20 bp, Artificial
  CRISPR gRNA sequence
accggccgacccgtgatgtg

SEQ ID NO: 21531 - DNA, 20 bp, Artificial
  CRISPR gRNA sequence
tttttctttttttttcgaga

SEQ ID NO: 21532 - DNA, 20 bp, Artificial
  CRISPR gRNA sequence
ttttgtatttttagtagaga

SEQ ID NO: 21533 - DNA, 20 bp, Artificial
  CRISPR gRNA sequence
ccgcctcggcctccaaagtg

SEQ ID NO: 21534 - DNA, 20 bp, Artificial
  CRISPR gRNA sequence
caggcgtgagccactgcacc

SEQ ID NO: 21535 - DNA, 20 bp, Artificial
  CRISPR gRNA sequence
cagcacctgacctgttaaaa

SEQ ID NO: 21536 - DNA, 20 bp, Artificial
  CRISPR gRNA sequence
aaactggagctggtccagtg

SEQ ID NO: 21537 - DNA, 20 bp, Artificial
  CRISPR gRNA sequence
tgttctaaatgttatatcag

SEQ ID NO: 21538 - DNA, 20 bp, Artificial
  CRISPR gRNA sequence
actgagtctcagaagagttg

SEQ ID NO: 21539 - DNA, 20 bp, Artificial
  CRISPR gRNA sequence
ataggcagtaagaggcatag

SEQ ID NO: 21540 - DNA, 20 bp, Artificial
  CRISPR gRNA sequence
tgaacttgggaagttgttct

SEQ ID NO: 21541 - DNA, 20 bp, Artificial
  CRISPR gRNA sequence
aaatgacttccttttagtcc

SEQ ID NO: 21542 - DNA, 20 bp, Artificial
  CRISPR gRNA sequence
tcctgctgttttcctgggct

SEQ ID NO: 21543 - DNA, 20 bp, Artificial
  CRISPR gRNA sequence
gtggtctcaactctctgggt

SEQ ID NO: 21544 - DNA, 20 bp, Artificial
  CRISPR gRNA sequence
aggctctgttgtgcaataaa

SEQ ID NO: 21545 - DNA, 20 bp, Artificial
  CRISPR gRNA sequence
ttcccccagggatagtggga

SEQ ID NO: 21546 - DNA, 20 bp, Artificial
  CRISPR gRNA sequence
tttttctggaatctagggat

SEQ ID NO: 21547 - DNA, 20 bp, Artificial
  CRISPR gRNA sequence
ctccaatccctccccctggc

SEQ ID NO: 21548 - DNA, 20 bp, Artificial
  CRISPR gRNA sequence
tccccctggcctctgtttcc

SEQ ID NO: 21549 - DNA, 20 bp, Artificial
  CRISPR gRNA sequence
gcatctgcgacgtgggagcc

SEQ ID NO: 21550 - DNA, 20 bp, Artificial
  CRISPR gRNA sequence
gggagccgagagcttggctc

SEQ ID NO: 21551 - DNA, 20 bp, Artificial
  CRISPR gRNA sequence
cccaagggccaggccccaag

SEQ ID NO: 21552 - DNA, 20 bp, Artificial
  CRISPR gRNA sequence
ggtgagcagacacttccccc

SEQ ID NO: 21553 - DNA, 20 bp, Artificial
  CRISPR gRNA sequence
cagacacttccccctctggc

SEQ ID NO: 21554 - DNA, 20 bp, Artificial
  CRISPR gRNA sequence
acagtaataatatccaccca

SEQ ID NO: 21555 - DNA, 20 bp, Artificial
  CRISPR gRNA sequence
tatccacccaagaggttttg

SEQ ID NO: 21556 - DNA, 20 bp, Artificial
  CRISPR gRNA sequence
aattggcaatttcatatggt

SEQ ID NO: 21557 - DNA, 20 bp, Artificial
  CRISPR gRNA sequence
ataaaggaatctcgggcctc

SEQ ID NO: 21558 - DNA, 20 bp, Artificial
  CRISPR gRNA sequence
cgttctaggctgggtggaag

SEQ ID NO: 21559 - DNA, 20 bp, Artificial
  CRISPR gRNA sequence
gtccaggaacacctgcaaca

SEQ ID NO: 21560 - DNA, 20 bp, Artificial
  CRISPR gRNA sequence
ctctggacagggtaaccagg

SEQ ID NO: 21561 - DNA, 20 bp, Artificial
  CRISPR gRNA sequence
aaaggagaagcctaggaggc

SEQ ID NO: 21562 - DNA, 20 bp, Artificial
  CRISPR gRNA sequence
agaaaggttagttaactgct

SEQ ID NO: 21563 - DNA, 20 bp, Artificial
  CRISPR gRNA sequence
ctgtgcgtcttagaagaggt

SEQ ID NO: 21564 - DNA, 20 bp, Artificial
  CRISPR gRNA sequence
gtgagtgattgtggagataa

SEQ ID NO: 21565 - DNA, 20 bp, Artificial
  CRISPR gRNA sequence
gtgccagctactgttgttat

SEQ ID NO: 21566 - DNA, 20 bp, Artificial
  CRISPR gRNA sequence
ctgttgttataagagctttg

SEQ ID NO: 21567 - DNA, 20 bp, Artificial
  CRISPR gRNA sequence
tgttataagagctttgtagg

SEQ ID NO: 21568 - DNA, 20 bp, Artificial
  CRISPR gRNA sequence
taagagctttgtagggcttg

SEQ ID NO: 21569 - DNA, 20 bp, Artificial
  CRISPR gRNA sequence
agtgtctgctcacccagggt

SEQ ID NO: 21570 - DNA, 20 bp, Artificial
  CRISPR gRNA sequence
gcagattggtgaagggaaga

SEQ ID NO: 21571 - DNA, 20 bp, Artificial
  CRISPR gRNA sequence
tcggaaacagaggccagggg

SEQ ID NO: 21572 - DNA, 20 bp, Artificial
  CRISPR gRNA sequence
gccttccagaagccaccatc

SEQ ID NO: 21573 - DNA, 20 bp, Artificial
  CRISPR gRNA sequence
gaatgaataagtgacttgct

SEQ ID NO: 21574 - DNA, 20 bp, Artificial
  CRISPR gRNA sequence
agttctcttgttcagggctg

SEQ ID NO: 21575 - DNA, 20 bp, Artificial
  CRISPR gRNA sequence
ctcttgttcagggctgtggt

SEQ ID NO: 21576 - DNA, 20 bp, Artificial
  CRISPR gRNA sequence
cccgtgggagtcaccaccta

SEQ ID NO: 21577 - DNA, 20 bp, Artificial
  CRISPR gRNA sequence
gctactcaactcttctgaga

SEQ ID NO: 21578 - DNA, 20 bp, Artificial
  CRISPR gRNA sequence
aagccagtcactggaccagc

SEQ ID NO: 21579 - DNA, 20 bp, Artificial
  CRISPR gRNA sequence
gtgtcactgatgccaacttc

SEQ ID NO: 21580 - DNA, 20 bp, Artificial
  CRISPR gRNA sequence
caggtcaggtgctgctgcgg

SEQ ID NO: 21581 - DNA, 20 bp, Artificial
  CRISPR gRNA sequence
atttcagggccatgactttg

SEQ ID NO: 21582 - DNA, 20 bp, Artificial
  CRISPR gRNA sequence
cgggtggatcacctaaggtc

SEQ ID NO: 21583 - DNA, 20 bp, Artificial
  CRISPR gRNA sequence
ttgagaggctgaggcaggag

SEQ ID NO: 21584 - DNA, 20 bp, Artificial
  CRISPR gRNA sequence
gaaaaaaataaataaatgca

SEQ ID NO: 21585 - DNA, 20 bp, Artificial
  CRISPR gRNA sequence
gcaggtttacactgctgcca

SEQ ID NO: 21586 - DNA, 20 bp, Artificial
  CRISPR gRNA sequence
taccagtgcagaaactagat

SEQ ID NO: 21587 - DNA, 20 bp, Artificial
  CRISPR gRNA sequence
tcttataaccaatagcgtgt

SEQ ID NO: 21588 - DNA, 20 bp, Artificial
  CRISPR gRNA sequence
ggtcttacaatggatggcat

SEQ ID NO: 21589 - DNA, 20 bp, Artificial
  CRISPR gRNA sequence
atcttagattccatgaaata

SEQ ID NO: 21590 - DNA, 20 bp, Artificial
  CRISPR gRNA sequence
ttggaaggctgaggtgggtg

SEQ ID NO: 21591 - DNA, 20 bp, Artificial
  CRISPR gRNA sequence
ggtgggtggatcgcttgggc

SEQ ID NO: 21592 - DNA, 20 bp, Artificial
  CRISPR gRNA sequence
aatcacttgaacccaggagg

SEQ ID NO: 21593 - DNA, 20 bp, Artificial
  CRISPR gRNA sequence
acaagggcctccctgtgtga

SEQ ID NO: 21594 - DNA, 20 bp, Artificial
  CRISPR gRNA sequence
ttcctagagtccttttcccc

SEQ ID NO: 21595 - DNA, 20 bp, Artificial
  CRISPR gRNA sequence
ccagaagtcctgtaccctcc

SEQ ID NO: 21596 - DNA, 20 bp, Artificial
  CRISPR gRNA sequence
cctgtaccctcctggggctt

SEQ ID NO: 21597 - DNA, 20 bp, Artificial
  CRISPR gRNA sequence
gtttccttcccagcatgaat

SEQ ID NO: 21598 - DNA, 20 bp, Artificial
  CRISPR gRNA sequence
gtctagttcatacttgtatc

SEQ ID NO: 21599 - DNA, 20 bp, Artificial
  CRISPR gRNA sequence
tttagcacaattatgaacca

SEQ ID NO: 21600 - DNA, 20 bp, Artificial
  CRISPR gRNA sequence
atgaaccagacagattctat

SEQ ID NO: 21601 - DNA, 20 bp, Artificial
  CRISPR gRNA sequence
gacagattctatttttgctt

SEQ ID NO: 21602 - DNA, 20 bp, Artificial
  CRISPR gRNA sequence
ttggaaggctgaggtgggag

SEQ ID NO: 21603 - DNA, 20 bp, Artificial
  CRISPR gRNA sequence
caggtggatcacctgagatc

SEQ ID NO: 21604 - DNA, 20 bp, Artificial
  CRISPR gRNA sequence
tcggagcactgaggcaggcg

SEQ ID NO: 21605 - DNA, 20 bp, Artificial
  CRISPR gRNA sequence
agagctctggcgaagaggag

SEQ ID NO: 21606 - DNA, 20 bp, Artificial
  CRISPR gRNA sequence
acagaacctggcattgtgac

SEQ ID NO: 21607 - DNA, 20 bp, Artificial
  CRISPR gRNA sequence
gaatgaataactgacttgct

SEQ ID NO: 21608 - DNA, 20 bp, Artificial
  CRISPR gRNA sequence
aatccttttgttcagggctg

SEQ ID NO: 21609 - DNA, 20 bp, Artificial
  CRISPR gRNA sequence
cttttgttcagggctgtggt

SEQ ID NO: 21610 - DNA, 20 bp, Artificial
  CRISPR gRNA sequence
cgagcgaaggcagggcctcg

SEQ ID NO: 21611 - DNA, 20 bp, Artificial
  CRISPR gRNA sequence
atgaaataagtgttggcatt

SEQ ID NO: 21612 - DNA, 20 bp, Artificial
  CRISPR gRNA sequence
gtaatcctttctgccgggtt

SEQ ID NO: 21613 - DNA, 20 bp, Artificial
  CRISPR gRNA sequence
ttcacatggagcagggctgt

SEQ ID NO: 21614 - DNA, 20 bp, Artificial
  CRISPR gRNA sequence
gaaggactaaggagaagaaa

SEQ ID NO: 21615 - DNA, 20 bp, Artificial
  CRISPR gRNA sequence
tggttgtgagggggagtgtg

SEQ ID NO: 21616 - DNA, 20 bp, Artificial
  CRISPR gRNA sequence
ttgggaggctgaggtgtgag

SEQ ID NO: 21617 - DNA, 20 bp, Artificial
  CRISPR gRNA sequence
aattgcttgaacccaggagg

SEQ ID NO: 21618 - DNA, 20 bp, Artificial
  CRISPR gRNA sequence
ttgggaggcagaggcaggag

SEQ ID NO: 21619 - DNA, 20 bp, Artificial
  CRISPR gRNA sequence
ctactcagaaggttgagatg

SEQ ID NO: 21620 - DNA, 20 bp, Artificial
  CRISPR gRNA sequence
tcagaaggttgagatgggag

SEQ ID NO: 21621 - DNA, 20 bp, Artificial
  CRISPR gRNA sequence
tgggaggattgcttgagcct

SEQ ID NO: 21622 - DNA, 20 bp, Artificial
  CRISPR gRNA sequence
gagattgaggctgcagtgag

SEQ ID NO: 21623 - DNA, 20 bp, Artificial
  CRISPR gRNA sequence
tccaacttcccagagcccag

SEQ ID NO: 21624 - DNA, 20 bp, Artificial
  CRISPR gRNA sequence
agagcccagaacagttttta

SEQ ID NO: 21625 - DNA, 20 bp, Artificial
  CRISPR gRNA sequence
gaacagtttttaaaaagttt

SEQ ID NO: 21626 - DNA, 20 bp, Artificial
  CRISPR gRNA sequence
aagttttactgttttgataa

SEQ ID NO: 21627 - DNA, 20 bp, Artificial
  CRISPR gRNA sequence
tgtatactttataattaccg

SEQ ID NO: 21628 - DNA, 20 bp, Artificial
  CRISPR gRNA sequence
ttgtgtctcctcactagaat

SEQ ID NO: 21629 - DNA, 20 bp, Artificial
  CRISPR gRNA sequence
aatttaagattcctgaggtc

SEQ ID NO: 21630 - DNA, 20 bp, Artificial
  CRISPR gRNA sequence
ttcctgaggtcaggggattt

SEQ ID NO: 21631 - DNA, 20 bp, Artificial
  CRISPR gRNA sequence
gaggtcaggggatttatttg

SEQ ID NO: 21632 - DNA, 20 bp, Artificial
  CRISPR gRNA sequence
gtaggtcctccttaaatatt

SEQ ID NO: 21633 - DNA, 20 bp, Artificial
  CRISPR gRNA sequence
aaatggttgggtaagtaaag

SEQ ID NO: 21634 - DNA, 20 bp, Artificial
  CRISPR gRNA sequence
cattgaatggaaggatgaat

SEQ ID NO: 21635 - DNA, 20 bp, Artificial
  CRISPR gRNA sequence
cactttgggaagcggaggtg

SEQ ID NO: 21636 - DNA, 20 bp, Artificial
  CRISPR gRNA sequence
aagtcagccggactttgggg

SEQ ID NO: 21637 - DNA, 20 bp, Artificial
  CRISPR gRNA sequence
caggcccagctcactcactt

SEQ ID NO: 21638 - DNA, 20 bp, Artificial
  CRISPR gRNA sequence
cataggcagccggcacattc

SEQ ID NO: 21639 - DNA, 20 bp, Artificial
  CRISPR gRNA sequence
aactcatgatggacttgaat

SEQ ID NO: 21640 - DNA, 20 bp, Artificial
  CRISPR gRNA sequence
atgatggacttgaatccctg

SEQ ID NO: 21641 - DNA, 20 bp, Artificial
  CRISPR gRNA sequence
cttcttaggaactaagcccc

SEQ ID NO: 21642 - DNA, 20 bp, Artificial
  CRISPR gRNA sequence
gcaaatgaggttgtgaggaa

SEQ ID NO: 21643 - DNA, 20 bp, Artificial
  CRISPR gRNA sequence
tctacaactttttttgtcac

SEQ ID NO: 21644 - DNA, 20 bp, Artificial
  CRISPR gRNA sequence
gagaaaaaaagggacaaagt

SEQ ID NO: 21645 - DNA, 20 bp, Artificial
  CRISPR gRNA sequence
tttctgcaggtgccttgggg

SEQ ID NO: 21646 - DNA, 20 bp, Artificial
  CRISPR gRNA sequence
aaaaggccgtgaggatccgc

SEQ ID NO: 21647 - DNA, 20 bp, Artificial
  CRISPR gRNA sequence
ccacgtaggaccccaatctt

SEQ ID NO: 21648 - DNA, 20 bp, Artificial
  CRISPR gRNA sequence
ccccaatcttttctgcttgg

SEQ ID NO: 21649 - DNA, 20 bp, Artificial
  CRISPR gRNA sequence
ttgggaggccaaggtaagag

SEQ ID NO: 21650 - DNA, 20 bp, Artificial
  CRISPR gRNA sequence
cttgagcccaggagttcaag

SEQ ID NO: 21651 - DNA, 20 bp, Artificial
  CRISPR gRNA sequence
gtggtggtgtgtcctgtggt

SEQ ID NO: 21652 - DNA, 20 bp, Artificial
  CRISPR gRNA sequence
ttaggaggctgaggtggaag

SEQ ID NO: 21653 - DNA, 20 bp, Artificial
  CRISPR gRNA sequence
gggctcccatcttggggctc

SEQ ID NO: 21654 - DNA, 20 bp, Artificial
  CRISPR gRNA sequence
gaaaaataaggacaacgaag

SEQ ID NO: 21655 - DNA, 20 bp, Artificial
  CRISPR gRNA sequence
ataaggacaacgaagggccg

SEQ ID NO: 21656 - DNA, 20 bp, Artificial
  CRISPR gRNA sequence
gcagtgggtattttgttgtt

SEQ ID NO: 21657 - DNA, 20 bp, Artificial
  CRISPR gRNA sequence
tgggtattttgttgttattt

SEQ ID NO: 21658 - DNA, 20 bp, Artificial
  CRISPR gRNA sequence
tcagcaaaaggccacaggat

SEQ ID NO: 21659 - DNA, 20 bp, Artificial
  CRISPR gRNA sequence
accccaatcttatgggggtt

SEQ ID NO: 21660 - DNA, 20 bp, Artificial
  CRISPR gRNA sequence
ggcattcgttgttaaatatt

SEQ ID NO: 21661 - DNA, 20 bp, Artificial
  CRISPR gRNA sequence
atatacagtggtgaggggga

SEQ ID NO: 21662 - DNA, 20 bp, Artificial
  CRISPR gRNA sequence
gctcaccgcaacctccgcct

SEQ ID NO: 21663 - DNA, 20 bp, Artificial
  CRISPR gRNA sequence
aacctccgcctcccggtttc

SEQ ID NO: 21664 - DNA, 20 bp, Artificial
  CRISPR gRNA sequence
cctgccaccatgcccagcta

SEQ ID NO: 21665 - DNA, 20 bp, Artificial
  CRISPR gRNA sequence
ttttgtatatttagtagaga

SEQ ID NO: 21666 - DNA, 20 bp, Artificial
  CRISPR gRNA sequence
tgcctcggcctcccaaagtg

SEQ ID NO: 21667 - DNA, 20 bp, Artificial
  CRISPR gRNA sequence
cataagccactgcgcctggc

SEQ ID NO: 21668 - DNA, 20 bp, Artificial
  CRISPR gRNA sequence
ggtggggggatcacgaggtc

SEQ ID NO: 21669 - DNA, 20 bp, Artificial
  CRISPR gRNA sequence
gaggaggaggttgcagtgag

SEQ ID NO: 21670 - DNA, 20 bp, Artificial
  CRISPR gRNA sequence
gggttgtgagtggctaagaa

SEQ ID NO: 21671 - DNA, 20 bp, Artificial
  CRISPR gRNA sequence
tccttcctcagaacctcctc

SEQ ID NO: 21672 - DNA, 20 bp, Artificial
  CRISPR gRNA sequence
cgcagttccgatcttgaact

SEQ ID NO: 21673 - DNA, 20 bp, Artificial
  CRISPR gRNA sequence
ggccagaaagggccctcagt

SEQ ID NO: 21674 - DNA, 20 bp, Artificial
  CRISPR gRNA sequence
ctctgttcaaaacaagagac

SEQ ID NO: 21675 - DNA, 20 bp, Artificial
  CRISPR gRNA sequence
agcagtgatcagggagagct

SEQ ID NO: 21676 - DNA, 20 bp, Artificial
  CRISPR gRNA sequence
tctgtcttccacagtagctc

SEQ ID NO: 21677 - DNA, 20 bp, Artificial
  CRISPR gRNA sequence
cacagtagctcttgagatta

SEQ ID NO: 21678 - DNA, 20 bp, Artificial
  CRISPR gRNA sequence
ctgaattataagctgggcat

SEQ ID NO: 21679 - DNA, 20 bp, Artificial
  CRISPR gRNA sequence
tcgggaggctgaggcaggaa

SEQ ID NO: 21680 - DNA, 20 bp, Artificial
  CRISPR gRNA sequence
aaattgcttgaaccgagagg

SEQ ID NO: 21681 - DNA, 20 bp, Artificial
  CRISPR gRNA sequence
taccaaggaacaaacattca

SEQ ID NO: 21682 - DNA, 20 bp, Artificial
  CRISPR gRNA sequence
catttagctttttctgtgga

SEQ ID NO: 21683 - DNA, 20 bp, Artificial
  CRISPR gRNA sequence
cactttgggaggctgaggtg

SEQ ID NO: 21684 - DNA, 20 bp, Artificial
  CRISPR gRNA sequence
ttgggaggctgaggtgggag

SEQ ID NO: 21685 - DNA, 20 bp, Artificial
  CRISPR gRNA sequence
gaggttgaggctgtggtgag

SEQ ID NO: 21686 - DNA, 20 bp, Artificial
  CRISPR gRNA sequence
agatctaaatataataatta

SEQ ID NO: 21687 - DNA, 20 bp, Artificial
  CRISPR gRNA sequence
cacatagagcaaccaactgt

SEQ ID NO: 21688 - DNA, 20 bp, Artificial
  CRISPR gRNA sequence
tcccagtttgcctgggacta

SEQ ID NO: 21689 - DNA, 20 bp, Artificial
  CRISPR gRNA sequence
gcttcttgggatgcaagact

SEQ ID NO: 21690 - DNA, 20 bp, Artificial
  CRISPR gRNA sequence
ggatagtcccaggcaagtag

SEQ ID NO: 21691 - DNA, 20 bp, Artificial
  CRISPR gRNA sequence
ctgggaatttcaaaatgggg

SEQ ID NO: 21692 - DNA, 20 bp, Artificial
  CRISPR gRNA sequence
agctcattccttatcctcac

SEQ ID NO: 21693 - DNA, 20 bp, Artificial
  CRISPR gRNA sequence
cctgacctcctccagagggg

SEQ ID NO: 21694 - DNA, 20 bp, Artificial
  CRISPR gRNA sequence
gttaaccagcaaacgggtcc

SEQ ID NO: 21695 - DNA, 20 bp, Artificial
  CRISPR gRNA sequence
agtggtgggcaagagggtaa

SEQ ID NO: 21696 - DNA, 20 bp, Artificial
  CRISPR gRNA sequence
acccacaagacaatccaccc

SEQ ID NO: 21697 - DNA, 20 bp, Artificial
  CRISPR gRNA sequence
acccctttgcttacgcaaac

SEQ ID NO: 21698 - DNA, 20 bp, Artificial
  CRISPR gRNA sequence
ccagtgccccaaattcccca

SEQ ID NO: 21699 - DNA, 20 bp, Artificial
  CRISPR gRNA sequence
tgccccaaattccccagggg

SEQ ID NO: 21700 - DNA, 20 bp, Artificial
  CRISPR gRNA sequence
cactttgggaggctgaggca

SEQ ID NO: 21701 - DNA, 20 bp, Artificial
  CRISPR gRNA sequence
ttgggaggctgaggcaggag

SEQ ID NO: 21702 - DNA, 20 bp, Artificial
  CRISPR gRNA sequence
ttgggaggctgaggcaggag

SEQ ID NO: 21703 - DNA, 20 bp, Artificial
  CRISPR gRNA sequence
tatctttcatggaaatgagc

SEQ ID NO: 21704 - DNA, 20 bp, Artificial
  CRISPR gRNA sequence
acagttaacttgttctgtaa

SEQ ID NO: 21705 - DNA, 20 bp, Artificial
  CRISPR gRNA sequence
ctagaaggggagaggttctc

SEQ ID NO: 21706 - DNA, 20 bp, Artificial
  CRISPR gRNA sequence
taagacttgggcacatgatg

SEQ ID NO: 21707 - DNA, 20 bp, Artificial
  CRISPR gRNA sequence
atggcaggttttgaatgcag

SEQ ID NO: 21708 - DNA, 20 bp, Artificial
  CRISPR gRNA sequence
cctctcacctctgagtctgc

SEQ ID NO: 21709 - DNA, 20 bp, Artificial
  CRISPR gRNA sequence
tcttccacatccttcaggga

SEQ ID NO: 21710 - DNA, 20 bp, Artificial
  CRISPR gRNA sequence
acttctcctctgctgcctga

SEQ ID NO: 21711 - DNA, 20 bp, Artificial
  CRISPR gRNA sequence
tccatgaccactccagcctt

SEQ ID NO: 21712 - DNA, 20 bp, Artificial
  CRISPR gRNA sequence
tactttctcacaactcacac

SEQ ID NO: 21713 - DNA, 20 bp, Artificial
  CRISPR gRNA sequence
cacagtggttttctttccct

SEQ ID NO: 21714 - DNA, 20 bp, Artificial
  CRISPR gRNA sequence
ggcacaattatgtaggacct

SEQ ID NO: 21715 - DNA, 20 bp, Artificial
  CRISPR gRNA sequence
gaccttacagcttgggtaaa

SEQ ID NO: 21716 - DNA, 20 bp, Artificial
  CRISPR gRNA sequence
gaaatatggaagcaatcctc

SEQ ID NO: 21717 - DNA, 20 bp, Artificial
  CRISPR gRNA sequence
cgattaagctgaaatgctca

SEQ ID NO: 21718 - DNA, 20 bp, Artificial
  CRISPR gRNA sequence
gacagtggtggagtgtccct

SEQ ID NO: 21719 - DNA, 20 bp, Artificial
  CRISPR gRNA sequence
gtaagcagggatgggataca

SEQ ID NO: 21720 - DNA, 20 bp, Artificial
  CRISPR gRNA sequence
acaatcagattcaagttctg

SEQ ID NO: 21721 - DNA, 20 bp, Artificial
  CRISPR gRNA sequence
cagagagtccaaggggaggc

SEQ ID NO: 21722 - DNA, 20 bp, Artificial
  CRISPR gRNA sequence
aaatttgagcccaggtcagt

SEQ ID NO: 21723 - DNA, 20 bp, Artificial
  CRISPR gRNA sequence
aaaagagaccccacagagca

SEQ ID NO: 21724 - DNA, 20 bp, Artificial
  CRISPR gRNA sequence
cccgcagtgtccccggctgc

SEQ ID NO: 21725 - DNA, 20 bp, Artificial
  CRISPR gRNA sequence
tcaggtacctcgcaagcacc

SEQ ID NO: 21726 - DNA, 20 bp, Artificial
  CRISPR gRNA sequence
gtactgcgggagctccttgt

SEQ ID NO: 21727 - DNA, 20 bp, Artificial
  CRISPR gRNA sequence
gtctgcggcccagctcccag

SEQ ID NO: 21728 - DNA, 20 bp, Artificial
  CRISPR gRNA sequence
agagtcccgtgagcgtggag

SEQ ID NO: 21729 - DNA, 20 bp, Artificial
  CRISPR gRNA sequence
ggaggagggtgcaacctcgg

SEQ ID NO: 21730 - DNA, 20 bp, Artificial
  CRISPR gRNA sequence
gtgctgtgcaggaagccatc

SEQ ID NO: 21731 - DNA, 20 bp, Artificial
  CRISPR gRNA sequence
gcccaatagctcttgccctg

SEQ ID NO: 21732 - DNA, 20 bp, Artificial
  CRISPR gRNA sequence
tcatttacatctgttcccca

SEQ ID NO: 21733 - DNA, 20 bp, Artificial
  CRISPR gRNA sequence
atctgttccccacacagttt

SEQ ID NO: 21734 - DNA, 20 bp, Artificial
  CRISPR gRNA sequence
gttccccacacagttttttt

SEQ ID NO: 21735 - DNA, 20 bp, Artificial
  CRISPR gRNA sequence
cccacacagtttttttgttt

SEQ ID NO: 21736 - DNA, 20 bp, Artificial
  CRISPR gRNA sequence
acagtttttttgtttgtttg

SEQ ID NO: 21737 - DNA, 20 bp, Artificial
  CRISPR gRNA sequence
ttttttgtttgtttgttttg

SEQ ID NO: 21738 - DNA, 20 bp, Artificial
  CRISPR gRNA sequence
tgttttgttttgagacaggg

SEQ ID NO: 21739 - DNA, 20 bp, Artificial
  CRISPR gRNA sequence
gacaccatgcccagataatt

SEQ ID NO: 21740 - DNA, 20 bp, Artificial
  CRISPR gRNA sequence
atggcacaatcatggtccac

SEQ ID NO: 21741 - DNA, 20 bp, Artificial
  CRISPR gRNA sequence
atgcctggctaatttttctt

SEQ ID NO: 21742 - DNA, 20 bp, Artificial
  CRISPR gRNA sequence
cgccttggcctcccaaagtg

SEQ ID NO: 21743 - DNA, 20 bp, Artificial
  CRISPR gRNA sequence
gcccccatacagtcttcatc

SEQ ID NO: 21744 - DNA, 20 bp, Artificial
  CRISPR gRNA sequence
attccttcactcatcgtctc

SEQ ID NO: 21745 - DNA, 20 bp, Artificial
  CRISPR gRNA sequence
ctcacggcaacctccacctc

SEQ ID NO: 21746 - DNA, 20 bp, Artificial
  CRISPR gRNA sequence
aacctccacctcctgggttt

SEQ ID NO: 21747 - DNA, 20 bp, Artificial
  CRISPR gRNA sequence
tgcctcggcctgccaagtag

SEQ ID NO: 21748 - DNA, 20 bp, Artificial
  CRISPR gRNA sequence
tttgtattttttaatggaga

SEQ ID NO: 21749 - DNA, 20 bp, Artificial
  CRISPR gRNA sequence
tgccttggcctcccaaagtg

SEQ ID NO: 21750 - DNA, 20 bp, Artificial
  CRISPR gRNA sequence
ctcattccttcatttactca

SEQ ID NO: 21751 - DNA, 20 bp, Artificial
  CRISPR gRNA sequence
atttactcactaagcttttt

SEQ ID NO: 21752 - DNA, 20 bp, Artificial
  CRISPR gRNA sequence
tctggaaaatggggataata

SEQ ID NO: 21753 - DNA, 20 bp, Artificial
  CRISPR gRNA sequence
attgggattgtgtgagatgt

SEQ ID NO: 21754 - DNA, 20 bp, Artificial
  CRISPR gRNA sequence
ttaatgatttagcataccta

SEQ ID NO: 21755 - DNA, 20 bp, Artificial
  CRISPR gRNA sequence
atttagtaattctcttattc

SEQ ID NO: 21756 - DNA, 20 bp, Artificial
  CRISPR gRNA sequence
atccactcactcacttcatc

SEQ ID NO: 21757 - DNA, 20 bp, Artificial
  CRISPR gRNA sequence
atgaagtgttaacacccagt

SEQ ID NO: 21758 - DNA, 20 bp, Artificial
  CRISPR gRNA sequence
tgagcaatgtgaagccagat

SEQ ID NO: 21759 - DNA, 20 bp, Artificial
  CRISPR gRNA sequence
atcactcaccaggccatttt

SEQ ID NO: 21760 - DNA, 20 bp, Artificial
  CRISPR gRNA sequence
ctggagatggagaagcaggt

SEQ ID NO: 21761 - DNA, 20 bp, Artificial
  CRISPR gRNA sequence
gtccttacagccttcatggg

SEQ ID NO: 21762 - DNA, 20 bp, Artificial
  CRISPR gRNA sequence
tgtacttttaaaaatttcac

SEQ ID NO: 21763 - DNA, 20 bp, Artificial
  CRISPR gRNA sequence
cacaatatctatgtaaaaat

SEQ ID NO: 21764 - DNA, 20 bp, Artificial
  CRISPR gRNA sequence
caaaagatctgaccacattg

SEQ ID NO: 21765 - DNA, 20 bp, Artificial
  CRISPR gRNA sequence
atggctgtatttggatggga

SEQ ID NO: 21766 - DNA, 20 bp, Artificial
  CRISPR gRNA sequence
catgacctgttgtccctaca

SEQ ID NO: 21767 - DNA, 20 bp, Artificial
  CRISPR gRNA sequence
cctgttgtccctacaggcag

SEQ ID NO: 21768 - DNA, 20 bp, Artificial
  CRISPR gRNA sequence
ttccttccccagggcctcga

SEQ ID NO: 21769 - DNA, 20 bp, Artificial
  CRISPR gRNA sequence
gccctaagggtccttacctg

SEQ ID NO: 21770 - DNA, 20 bp, Artificial
  CRISPR gRNA sequence
gtggtgtgagaataaccagg

SEQ ID NO: 21771 - DNA, 20 bp, Artificial
  CRISPR gRNA sequence
gttacatctagctcctggaa

SEQ ID NO: 21772 - DNA, 20 bp, Artificial
  CRISPR gRNA sequence
tcattttcctagatatcagg

SEQ ID NO: 21773 - DNA, 20 bp, Artificial
  CRISPR gRNA sequence
ctagatatcaggaactgctt

SEQ ID NO: 21774 - DNA, 20 bp, Artificial
  CRISPR gRNA sequence
tgggtcagtagggaccattt

SEQ ID NO: 21775 - DNA, 20 bp, Artificial
  CRISPR gRNA sequence
tcttgtaaacatcacttgtc

SEQ ID NO: 21776 - DNA, 20 bp, Artificial
  CRISPR gRNA sequence
cacctcaggaatctctgctc

SEQ ID NO: 21777 - DNA, 20 bp, Artificial
  CRISPR gRNA sequence
caggaatctctgctcttctg

SEQ ID NO: 21778 - DNA, 20 bp, Artificial
  CRISPR gRNA sequence
ggagacccctgttccagcct

SEQ ID NO: 21779 - DNA, 20 bp, Artificial
  CRISPR gRNA sequence
caaactggatgggtccctca

SEQ ID NO: 21780 - DNA, 20 bp, Artificial
  CRISPR gRNA sequence
ggtgggatcttgcatagcac

SEQ ID NO: 21781 - DNA, 20 bp, Artificial
  CRISPR gRNA sequence
atcttgcatagcacctgtgt

SEQ ID NO: 21782 - DNA, 20 bp, Artificial
  CRISPR gRNA sequence
catagcacctgtgtttgcga

SEQ ID NO: 21783 - DNA, 20 bp, Artificial
  CRISPR gRNA sequence
acctgtgtttgcgattctgc

SEQ ID NO: 21784 - DNA, 20 bp, Artificial
  CRISPR gRNA sequence
ttgcgattctgcttttgctt

SEQ ID NO: 21785 - DNA, 20 bp, Artificial
  CRISPR gRNA sequence
ctaatttccctaagagcagt

SEQ ID NO: 21786 - DNA, 20 bp, Artificial
  CRISPR gRNA sequence
caggtgaatgctctaattgg

SEQ ID NO: 21787 - DNA, 20 bp, Artificial
  CRISPR gRNA sequence
ccctcctgatgctcgcacgg

SEQ ID NO: 21788 - DNA, 20 bp, Artificial
  CRISPR gRNA sequence
ttctgaggcatgttctctgc

SEQ ID NO: 21789 - DNA, 20 bp, Artificial
  CRISPR gRNA sequence
cctaacatactgggaatctg

SEQ ID NO: 21790 - DNA, 20 bp, Artificial
  CRISPR gRNA sequence
agtgggctgtgttagagact

SEQ ID NO: 21791 - DNA, 20 bp, Artificial
  CRISPR gRNA sequence
gatgtctctcctgacagagg

SEQ ID NO: 21792 - DNA, 20 bp, Artificial
  CRISPR gRNA sequence
cagcccacctgccctgcaca

SEQ ID NO: 21793 - DNA, 20 bp, Artificial
  CRISPR gRNA sequence
tgccctgcacacctggcttc

SEQ ID NO: 21794 - DNA, 20 bp, Artificial
  CRISPR gRNA sequence
taacattccaaccccagctc

SEQ ID NO: 21795 - DNA, 20 bp, Artificial
  CRISPR gRNA sequence
gtcacaaatggggacacaac

SEQ ID NO: 21796 - DNA, 20 bp, Artificial
  CRISPR gRNA sequence
aaacaaaacaaaacaaagga

SEQ ID NO: 21797 - DNA, 20 bp, Artificial
  CRISPR gRNA sequence
aacaaaggaacctgcttttg

SEQ ID NO: 21798 - DNA, 20 bp, Artificial
  CRISPR gRNA sequence
ctagctgtgtgcctttgcaa

SEQ ID NO: 21799 - DNA, 20 bp, Artificial
  CRISPR gRNA sequence
gagtatcaagcactcacagc

SEQ ID NO: 21800 - DNA, 20 bp, Artificial
  CRISPR gRNA sequence
ccacgtgtcccttagcaagg

SEQ ID NO: 21801 - DNA, 20 bp, Artificial
  CRISPR gRNA sequence
caatcttggctcactgcaac

SEQ ID NO: 21802 - DNA, 20 bp, Artificial
  CRISPR gRNA sequence
aacctctgcttcttaggttc

SEQ ID NO: 21803 - DNA, 20 bp, Artificial
  CRISPR gRNA sequence
caccctagcctccctggtag

SEQ ID NO: 21804 - DNA, 20 bp, Artificial
  CRISPR gRNA sequence
ttttgtatttttagtagaga

SEQ ID NO: 21805 - DNA, 20 bp, Artificial
  CRISPR gRNA sequence
agccttggcctcccaaagtg

SEQ ID NO: 21806 - DNA, 20 bp, Artificial
  CRISPR gRNA sequence
aaattaaagcaaatacagga

SEQ ID NO: 21807 - DNA, 20 bp, Artificial
  CRISPR gRNA sequence
actacagaacaggagtggga

SEQ ID NO: 21808 - DNA, 20 bp, Artificial
  CRISPR gRNA sequence
ctgaatattcttttggttgt

SEQ ID NO: 21809 - DNA, 20 bp, Artificial
  CRISPR gRNA sequence
aacctccacctcctgggttc

SEQ ID NO: 21810 - DNA, 20 bp, Artificial
  CRISPR gRNA sequence
tgcctcagcctcccgagtag

SEQ ID NO: 21811 - DNA, 20 bp, Artificial
  CRISPR gRNA sequence
tttgtattttttggtagaga

SEQ ID NO: 21812 - DNA, 20 bp, Artificial
  CRISPR gRNA sequence
ccccttggcctcccaaactg

SEQ ID NO: 21813 - DNA, 20 bp, Artificial
  CRISPR gRNA sequence
tttaaaatctcataccctgt

SEQ ID NO: 21814 - DNA, 20 bp, Artificial
  CRISPR gRNA sequence
tcataccctgtgtgcgattc

SEQ ID NO: 21815 - DNA, 20 bp, Artificial
  CRISPR gRNA sequence
aactgttacacccattttac

SEQ ID NO: 21816 - DNA, 20 bp, Artificial
  CRISPR gRNA sequence
gaagggttccaggaagaggt

SEQ ID NO: 21817 - DNA, 20 bp, Artificial
  CRISPR gRNA sequence
tgacagtttagccaacacca

SEQ ID NO: 21818 - DNA, 20 bp, Artificial
  CRISPR gRNA sequence
tatagcaactgcaaaggccc

SEQ ID NO: 21819 - DNA, 20 bp, Artificial
  CRISPR gRNA sequence
ctgaagtgtggtgtctcata

SEQ ID NO: 21820 - DNA, 20 bp, Artificial
  CRISPR gRNA sequence
atgtacattttaaggctcct

SEQ ID NO: 21821 - DNA, 20 bp, Artificial
  CRISPR gRNA sequence
ggaagcaagttggacccaca

SEQ ID NO: 21822 - DNA, 20 bp, Artificial
  CRISPR gRNA sequence
gcacacagtggggactcaag

SEQ ID NO: 21823 - DNA, 20 bp, Artificial
  CRISPR gRNA sequence
ggcagaatggtagagttact

SEQ ID NO: 21824 - DNA, 20 bp, Artificial
  CRISPR gRNA sequence
ggtggaatagggcaatcagg

SEQ ID NO: 21825 - DNA, 20 bp, Artificial
  CRISPR gRNA sequence
agtctgggagaaggagaaca

SEQ ID NO: 21826 - DNA, 20 bp, Artificial
  CRISPR gRNA sequence
agtgaggaaacttgttcaga

SEQ ID NO: 21827 - DNA, 20 bp, Artificial
  CRISPR gRNA sequence
gagagataggtgacggtggt

SEQ ID NO: 21828 - DNA, 20 bp, Artificial
  CRISPR gRNA sequence
tcatgctggggaaagttagg

SEQ ID NO: 21829 - DNA, 20 bp, Artificial
  CRISPR gRNA sequence
ataagcaatggggagccata

SEQ ID NO: 21830 - DNA, 20 bp, Artificial
  CRISPR gRNA sequence
ggtagtacctaacatctact

SEQ ID NO: 21831 - DNA, 20 bp, Artificial
  CRISPR gRNA sequence
tctgtgcaaattccttttct

SEQ ID NO: 21832 - DNA, 20 bp, Artificial
  CRISPR gRNA sequence
caaccatcccgtgatggtgg

SEQ ID NO: 21833 - DNA, 20 bp, Artificial
  CRISPR gRNA sequence
aaaagaatacttgcccaggc

SEQ ID NO: 21834 - DNA, 20 bp, Artificial
  CRISPR gRNA sequence
gaagctgcctgttatgacgt

SEQ ID NO: 21835 - DNA, 20 bp, Artificial
  CRISPR gRNA sequence
tggggcctttaagaggtgac

SEQ ID NO: 21836 - DNA, 20 bp, Artificial
  CRISPR gRNA sequence
gatgaatgggttaatccgtt

SEQ ID NO: 21837 - DNA, 20 bp, Artificial
  CRISPR gRNA sequence
gttgtcgtgggagtaagact

SEQ ID NO: 21838 - DNA, 20 bp, Artificial
  CRISPR gRNA sequence
aaattactcagtgtcaggta

SEQ ID NO: 21839 - DNA, 20 bp, Artificial
  CRISPR gRNA sequence
actaacgcactgcctcacct

SEQ ID NO: 21840 - DNA, 20 bp, Artificial
  CRISPR gRNA sequence
ctgcctcacctatttgctta

SEQ ID NO: 21841 - DNA, 20 bp, Artificial
  CRISPR gRNA sequence
atgtcctcagccccaatcac

SEQ ID NO: 21842 - DNA, 20 bp, Artificial
  CRISPR gRNA sequence
cccctccattttcttccttg

SEQ ID NO: 21843 - DNA, 20 bp, Artificial
  CRISPR gRNA sequence
gcaggaagaagaccactaag

SEQ ID NO: 21844 - DNA, 20 bp, Artificial
  CRISPR gRNA sequence
aaggaaaatgggggcaggac

SEQ ID NO: 21845 - DNA, 20 bp, Artificial
  CRISPR gRNA sequence
gtggtggtgatgctggtgag

SEQ ID NO: 21846 - DNA, 20 bp, Artificial
  CRISPR gRNA sequence
agctcttcttaaggctacaa

SEQ ID NO: 21847 - DNA, 20 bp, Artificial
  CRISPR gRNA sequence
ttaaggctacaaattagctt

SEQ ID NO: 21848 - DNA, 20 bp, Artificial
  CRISPR gRNA sequence
ctctaatgcaaacttgggta

SEQ ID NO: 21849 - DNA, 20 bp, Artificial
  CRISPR gRNA sequence
atgtatttcctttgttgttg

SEQ ID NO: 21850 - DNA, 20 bp, Artificial
  CRISPR gRNA sequence
ctagttattacaaatactag

SEQ ID NO: 21851 - DNA, 20 bp, Artificial
  CRISPR gRNA sequence
aagggaaaggggtgtatggt

SEQ ID NO: 21852 - DNA, 20 bp, Artificial
  CRISPR gRNA sequence
tggaggtggaggatgtaaac

SEQ ID NO: 21853 - DNA, 20 bp, Artificial
  CRISPR gRNA sequence
tggaggatgtaaacatgaga

SEQ ID NO: 21854 - DNA, 20 bp, Artificial
  CRISPR gRNA sequence
attgctccgcatcccccttg

SEQ ID NO: 21855 - DNA, 20 bp, Artificial
  CRISPR gRNA sequence
tggcagcaaagaactcttgc

SEQ ID NO: 21856 - DNA, 20 bp, Artificial
  CRISPR gRNA sequence
gattgtccttttctgggctc

SEQ ID NO: 21857 - DNA, 20 bp, Artificial
  CRISPR gRNA sequence
agggcagggaccagaatttc

SEQ ID NO: 21858 - DNA, 20 bp, Artificial
  CRISPR gRNA sequence
tagaaaagggaactggaaag

SEQ ID NO: 21859 - DNA, 20 bp, Artificial
  CRISPR gRNA sequence
atgccatgagtggtaacagc

SEQ ID NO: 21860 - DNA, 20 bp, Artificial
  CRISPR gRNA sequence
aactgaggctcagagaggtg

SEQ ID NO: 21861 - DNA, 20 bp, Artificial
  CRISPR gRNA sequence
aaacccatgtccaagtggaa

SEQ ID NO: 21862 - DNA, 20 bp, Artificial
  CRISPR gRNA sequence
tgcatttaaccacaatgctc

SEQ ID NO: 21863 - DNA, 20 bp, Artificial
  CRISPR gRNA sequence
gtctctgctcctttctgtgc

SEQ ID NO: 21864 - DNA, 20 bp, Artificial
  CRISPR gRNA sequence
atgtaaactgaaggagtctg

SEQ ID NO: 21865 - DNA, 20 bp, Artificial
  CRISPR gRNA sequence
tgaaggagtctgagcagatt

SEQ ID NO: 21866 - DNA, 20 bp, Artificial
  CRISPR gRNA sequence
aaataaatggataaacaaaa

SEQ ID NO: 21867 - DNA, 20 bp, Artificial
  CRISPR gRNA sequence
gacacaaagggtcacatatt

SEQ ID NO: 21868 - DNA, 20 bp, Artificial
  CRISPR gRNA sequence
ttgggaggctgagacaggag

SEQ ID NO: 21869 - DNA, 20 bp, Artificial
  CRISPR gRNA sequence
aaagcatattagtggttgcc

SEQ ID NO: 21870 - DNA, 20 bp, Artificial
  CRISPR gRNA sequence
gttgcctagggcttggcaga

SEQ ID NO: 21871 - DNA, 20 bp, Artificial
  CRISPR gRNA sequence
ggaacaactgctgatgggtc

SEQ ID NO: 21872 - DNA, 20 bp, Artificial
  CRISPR gRNA sequence
tgcctcagcctcctgagcag

SEQ ID NO: 21873 - DNA, 20 bp, Artificial
  CRISPR gRNA sequence
ttttgcatttttagtagaga

SEQ ID NO: 21874 - DNA, 20 bp, Artificial
  CRISPR gRNA sequence
ctcctcggcctcccaaagtg

SEQ ID NO: 21875 - DNA, 20 bp, Artificial
  CRISPR gRNA sequence
cttgagacccagagaagaca

SEQ ID NO: 21876 - DNA, 20 bp, Artificial
  CRISPR gRNA sequence
ccaggatccgtggttcaggt

SEQ ID NO: 21877 - DNA, 20 bp, Artificial
  CRISPR gRNA sequence
cctctggaggctcgagggga

SEQ ID NO: 21878 - DNA, 20 bp, Artificial
  CRISPR gRNA sequence
tgtggctgcatcactctaaa

SEQ ID NO: 21879 - DNA, 20 bp, Artificial
  CRISPR gRNA sequence
ctcttataaagacacttgtc

SEQ ID NO: 21880 - DNA, 20 bp, Artificial
  CRISPR gRNA sequence
tttttgccttcttttgagac

SEQ ID NO: 21881 - DNA, 20 bp, Artificial
  CRISPR gRNA sequence
caacctccacctcccagttc

SEQ ID NO: 21882 - DNA, 20 bp, Artificial
  CRISPR gRNA sequence
tgccccagtctcctgagtag

SEQ ID NO: 21883 - DNA, 20 bp, Artificial
  CRISPR gRNA sequence
ttttgtatttttagtagaaa

SEQ ID NO: 21884 - DNA, 20 bp, Artificial
  CRISPR gRNA sequence
acctcaggtgatcctccaat

SEQ ID NO: 21885 - DNA, 20 bp, Artificial
  CRISPR gRNA sequence
aatctcagcttcccaaagtg

SEQ ID NO: 21886 - DNA, 20 bp, Artificial
  CRISPR gRNA sequence
aaagtcacactgacaggttc

SEQ ID NO: 21887 - DNA, 20 bp, Artificial
  CRISPR gRNA sequence
gaaggctggaaagaaacaga

SEQ ID NO: 21888 - DNA, 20 bp, Artificial
  CRISPR gRNA sequence
gctcactgcaacctctgcct

SEQ ID NO: 21889 - DNA, 20 bp, Artificial
  CRISPR gRNA sequence
ctcccggattcaagcaattc

SEQ ID NO: 21890 - DNA, 20 bp, Artificial
  CRISPR gRNA sequence
ttttttatttttagtaaaga

SEQ ID NO: 21891 - DNA, 20 bp, Artificial
  CRISPR gRNA sequence
ggtttcaccatgttggtcag

SEQ ID NO: 21892 - DNA, 20 bp, Artificial
  CRISPR gRNA sequence
cgccttggcctcccaaagtg

SEQ ID NO: 21893 - DNA, 20 bp, Artificial
  CRISPR gRNA sequence
cccattttctttcacgcatc

SEQ ID NO: 21894 - DNA, 20 bp, Artificial
  CRISPR gRNA sequence
gctgcaggaacccaaacata

SEQ ID NO: 21895 - DNA, 20 bp, Artificial
  CRISPR gRNA sequence
gactttgggccatatctata

SEQ ID NO: 21896 - DNA, 20 bp, Artificial
  CRISPR gRNA sequence
aaaataataagttacccaaa

SEQ ID NO: 21897 - DNA, 20 bp, Artificial
  CRISPR gRNA sequence
attgggtctgccagggacct

SEQ ID NO: 21898 - DNA, 20 bp, Artificial
  CRISPR gRNA sequence
cacccccacttattgatgag

SEQ ID NO: 21899 - DNA, 20 bp, Artificial
  CRISPR gRNA sequence
agggaaagaaggcaagtatc

SEQ ID NO: 21900 - DNA, 20 bp, Artificial
  CRISPR gRNA sequence
ttttttaaaccacttggagc

SEQ ID NO: 21901 - DNA, 20 bp, Artificial
  CRISPR gRNA sequence
gaataataattggcaactca

SEQ ID NO: 21902 - DNA, 20 bp, Artificial
  CRISPR gRNA sequence
tcagtaagtgctgaatgaac

SEQ ID NO: 21903 - DNA, 20 bp, Artificial
  CRISPR gRNA sequence
tgaacagaagtttaaggcag

SEQ ID NO: 21904 - DNA, 20 bp, Artificial
  CRISPR gRNA sequence
tatgtgtgatggccatcatt

SEQ ID NO: 21905 - DNA, 20 bp, Artificial
  CRISPR gRNA sequence
tgtgatggccatcattatta

SEQ ID NO: 21906 - DNA, 20 bp, Artificial
  CRISPR gRNA sequence
catcattattagtttgcttc

SEQ ID NO: 21907 - DNA, 20 bp, Artificial
  CRISPR gRNA sequence
cgaggtcaaactttgtgaag

SEQ ID NO: 21908 - DNA, 20 bp, Artificial
  CRISPR gRNA sequence
caggagtatcacctcagtcc

SEQ ID NO: 21909 - DNA, 20 bp, Artificial
  CRISPR gRNA sequence
tcaggaggctgaggtgggag

SEQ ID NO: 21910 - DNA, 20 bp, Artificial
  CRISPR gRNA sequence
ggtgtcaaggctgcagtgaa

SEQ ID NO: 21911 - DNA, 20 bp, Artificial
  CRISPR gRNA sequence
aaggcccccacagccagcag

SEQ ID NO: 21912 - DNA, 20 bp, Artificial
  CRISPR gRNA sequence
acacatttcagcgccccact

SEQ ID NO: 21913 - DNA, 20 bp, Artificial
  CRISPR gRNA sequence
agcacttcctcttgggtgat

SEQ ID NO: 21914 - DNA, 20 bp, Artificial
  CRISPR gRNA sequence
gggtagagtgttatgcccat

SEQ ID NO: 21915 - DNA, 20 bp, Artificial
  CRISPR gRNA sequence
aggttcacacgcctcagtga

SEQ ID NO: 21916 - DNA, 20 bp, Artificial
  CRISPR gRNA sequence
aaatggcttgtccaaggtca

SEQ ID NO: 21917 - DNA, 20 bp, Artificial
  CRISPR gRNA sequence
tgtccaaggtcatgtggttt

SEQ ID NO: 21918 - DNA, 20 bp, Artificial
  CRISPR gRNA sequence
gtcacttgacctctctgaac

SEQ ID NO: 21919 - DNA, 20 bp, Artificial
  CRISPR gRNA sequence
ccaatattagttctggagaa

SEQ ID NO: 21920 - DNA, 20 bp, Artificial
  CRISPR gRNA sequence
caggcagatcacttgaggtc

SEQ ID NO: 21921 - DNA, 20 bp, Artificial
  CRISPR gRNA sequence
aaaattagccaggcatggtg

SEQ ID NO: 21922 - DNA, 20 bp, Artificial
  CRISPR gRNA sequence
ttgggaggctgaggcaggag

SEQ ID NO: 21923 - DNA, 20 bp, Artificial
  CRISPR gRNA sequence
aaacaaaaaacaaaaaacaa

SEQ ID NO: 21924 - DNA, 20 bp, Artificial
  CRISPR gRNA sequence
tgaaattcaggcccaagact

SEQ ID NO: 21925 - DNA, 20 bp, Artificial
  CRISPR gRNA sequence
accttcctctatccccagag

SEQ ID NO: 21926 - DNA, 20 bp, Artificial
  CRISPR gRNA sequence
gccaagtttcctatgtctat

SEQ ID NO: 21927 - DNA, 20 bp, Artificial
  CRISPR gRNA sequence
tatgtctatagatgcttagg

SEQ ID NO: 21928 - DNA, 20 bp, Artificial
  CRISPR gRNA sequence
cttcaaaggccccttcattg

SEQ ID NO: 21929 - DNA, 20 bp, Artificial
  CRISPR gRNA sequence
tcaccttctcccagctctca

SEQ ID NO: 21930 - DNA, 20 bp, Artificial
  CRISPR gRNA sequence
tacacatcagctatttgtat

SEQ ID NO: 21931 - DNA, 20 bp, Artificial
  CRISPR gRNA sequence
cagatgaagagacaggctca

SEQ ID NO: 21932 - DNA, 20 bp, Artificial
  CRISPR gRNA sequence
ggctcagagggattagtggg

SEQ ID NO: 21933 - DNA, 20 bp, Artificial
  CRISPR gRNA sequence
ttagaaggtcctctttgaaa

SEQ ID NO: 21934 - DNA, 20 bp, Artificial
  CRISPR gRNA sequence
ttgccatcaaaagtcctttt

SEQ ID NO: 21935 - DNA, 20 bp, Artificial
  CRISPR gRNA sequence
atccccacttcacactgcat

SEQ ID NO: 21936 - DNA, 20 bp, Artificial
  CRISPR gRNA sequence
agatgaatggagctcagatg

SEQ ID NO: 21937 - DNA, 20 bp, Artificial
  CRISPR gRNA sequence
ttttttaaaccacttggagc

SEQ ID NO: 21938 - DNA, 20 bp, Artificial
  CRISPR gRNA sequence
gggataataattggcaactc

SEQ ID NO: 21939 - DNA, 20 bp, Artificial
  CRISPR gRNA sequence
ccagtaagtgctcaatgaac

SEQ ID NO: 21940 - DNA, 20 bp, Artificial
  CRISPR gRNA sequence
gatgaccatttttattatta

SEQ ID NO: 21941 - DNA, 20 bp, Artificial
  CRISPR gRNA sequence
acctctgtgagagtgaccag

SEQ ID NO: 21942 - DNA, 20 bp, Artificial
  CRISPR gRNA sequence
tagatgccttgcatttacta

SEQ ID NO: 21943 - DNA, 20 bp, Artificial
  CRISPR gRNA sequence
caactgttaacggcaactct

SEQ ID NO: 21944 - DNA, 20 bp, Artificial
  CRISPR gRNA sequence
ccattttacagacgcaggcg

SEQ ID NO: 21945 - DNA, 20 bp, Artificial
  CRISPR gRNA sequence
gagattacgtccagttcatt

SEQ ID NO: 21946 - DNA, 20 bp, Artificial
  CRISPR gRNA sequence
gcctccagcactgctctgaa

SEQ ID NO: 21947 - DNA, 20 bp, Artificial
  CRISPR gRNA sequence
cactttgagaggccgaggct

SEQ ID NO: 21948 - DNA, 20 bp, Artificial
  CRISPR gRNA sequence
ttgggaggctgaggcaggaa

SEQ ID NO: 21949 - DNA, 20 bp, Artificial
  CRISPR gRNA sequence
ctgtctcagacaaaaaaaaa

SEQ ID NO: 21950 - DNA, 20 bp, Artificial
  CRISPR gRNA sequence
ctgaactgtgtgcctagaga

SEQ ID NO: 21951 - DNA, 20 bp, Artificial
  CRISPR gRNA sequence
tgtgtgcctagagacatggt

SEQ ID NO: 21952 - DNA, 20 bp, Artificial
  CRISPR gRNA sequence
attaccttagccctctgagc

SEQ ID NO: 21953 - DNA, 20 bp, Artificial
  CRISPR gRNA sequence
gccccttcaattgagtcttt

SEQ ID NO: 21954 - DNA, 20 bp, Artificial
  CRISPR gRNA sequence
tcaattgagtctttttgaga

SEQ ID NO: 21955 - DNA, 20 bp, Artificial
  CRISPR gRNA sequence
tgctccccaacctcatgaca

SEQ ID NO: 21956 - DNA, 20 bp, Artificial
  CRISPR gRNA sequence
tctaccatgaccagacccca

SEQ ID NO: 21957 - DNA, 20 bp, Artificial
  CRISPR gRNA sequence
ggggtagtagctcaaatgag

SEQ ID NO: 21958 - DNA, 20 bp, Artificial
  CRISPR gRNA sequence
tcccctctaaagctgtaaaa

SEQ ID NO: 21959 - DNA, 20 bp, Artificial
  CRISPR gRNA sequence
cagttccttactggccccaa

SEQ ID NO: 21960 - DNA, 20 bp, Artificial
  CRISPR gRNA sequence
taccacacagtccctgccaa

SEQ ID NO: 21961 - DNA, 20 bp, Artificial
  CRISPR gRNA sequence
tcgactgcattttgttggca

SEQ ID NO: 21962 - DNA, 20 bp, Artificial
  CRISPR gRNA sequence
aaatgccaagtgttggttac

SEQ ID NO: 21963 - DNA, 20 bp, Artificial
  CRISPR gRNA sequence
cactccatagagaacaatgt

SEQ ID NO: 21964 - DNA, 20 bp, Artificial
  CRISPR gRNA sequence
cgggtggatcacctgaggtc

SEQ ID NO: 21965 - DNA, 20 bp, Artificial
  CRISPR gRNA sequence
aaaaaaaaaaaaaaggcaaa

SEQ ID NO: 21966 - DNA, 20 bp, Artificial
  CRISPR gRNA sequence
gctgcactgggcagttaatc

SEQ ID NO: 21967 - DNA, 20 bp, Artificial
  CRISPR gRNA sequence
ttgaaaagaaaagaaacaaa

SEQ ID NO: 21968 - DNA, 20 bp, Artificial
  CRISPR gRNA sequence
caccccacaggctgtctggt

SEQ ID NO: 21969 - DNA, 20 bp, Artificial
  CRISPR gRNA sequence
ccacaggctgtctggtgatg

SEQ ID NO: 21970 - DNA, 20 bp, Artificial
  CRISPR gRNA sequence
aagcccctcactctccagcc

SEQ ID NO: 21971 - DNA, 20 bp, Artificial
  CRISPR gRNA sequence
gtagcaacactgcaatgctc

SEQ ID NO: 21972 - DNA, 20 bp, Artificial
  CRISPR gRNA sequence
taatgggggcaggaggtcag

SEQ ID NO: 21973 - DNA, 20 bp, Artificial
  CRISPR gRNA sequence
aagctcctcagctgtgccac

SEQ ID NO: 21974 - DNA, 20 bp, Artificial
  CRISPR gRNA sequence
tgaatccagtcgataggcct

SEQ ID NO: 21975 - DNA, 20 bp, Artificial
  CRISPR gRNA sequence
ccagtcgataggcctatttg

SEQ ID NO: 21976 - DNA, 20 bp, Artificial
  CRISPR gRNA sequence
tcattatggcccctttggta

SEQ ID NO: 21977 - DNA, 20 bp, Artificial
  CRISPR gRNA sequence
tggtatttggatttgccacc

SEQ ID NO: 21978 - DNA, 20 bp, Artificial
  CRISPR gRNA sequence
gcccttgcaggtcccaagat

SEQ ID NO: 21979 - DNA, 20 bp, Artificial
  CRISPR gRNA sequence
ggtgactggggcagggagag

SEQ ID NO: 21980 - DNA, 20 bp, Artificial
  CRISPR gRNA sequence
tgctgccagctcagatggaa

SEQ ID NO: 21981 - DNA, 20 bp, Artificial
  CRISPR gRNA sequence
agggaggatgacttgaggcc

SEQ ID NO: 21982 - DNA, 20 bp, Artificial
  CRISPR gRNA sequence
ttgggaggctgaggcaggag

SEQ ID NO: 21983 - DNA, 20 bp, Artificial
  CRISPR gRNA sequence
caggaggatggcttgagctc

SEQ ID NO: 21984 - DNA, 20 bp, Artificial
  CRISPR gRNA sequence
tcccaattccagcaccgttg

SEQ ID NO: 21985 - DNA, 20 bp, Artificial
  CRISPR gRNA sequence
ccattgcagctccctgccct

SEQ ID NO: 21986 - DNA, 20 bp, Artificial
  CRISPR gRNA sequence
ttggctgcaatccctagcca

SEQ ID NO: 21987 - DNA, 20 bp, Artificial
  CRISPR gRNA sequence
atgatgcatcaatgtaggtt

SEQ ID NO: 21988 - DNA, 20 bp, Artificial
  CRISPR gRNA sequence
gtagatgagggatgtgaagg

SEQ ID NO: 21989 - DNA, 20 bp, Artificial
  CRISPR gRNA sequence
aggtctagcttccttgctgt

SEQ ID NO: 21990 - DNA, 20 bp, Artificial
  CRISPR gRNA sequence
tcccagcttgagtgctccct

SEQ ID NO: 21991 - DNA, 20 bp, Artificial
  CRISPR gRNA sequence
ctgcattgcacctcaactcc

SEQ ID NO: 21992 - DNA, 20 bp, Artificial
  CRISPR gRNA sequence
caactcctgctgcttcccaa

SEQ ID NO: 21993 - DNA, 20 bp, Artificial
  CRISPR gRNA sequence
atgcaaatctccatctccta

SEQ ID NO: 21994 - DNA, 20 bp, Artificial
  CRISPR gRNA sequence
agccacctatcttctctggg

SEQ ID NO: 21995 - DNA, 20 bp, Artificial
  CRISPR gRNA sequence
aactcgaatgggccatcatc

SEQ ID NO: 21996 - DNA, 20 bp, Artificial
  CRISPR gRNA sequence
gttgggataagagttccctt

SEQ ID NO: 21997 - DNA, 20 bp, Artificial
  CRISPR gRNA sequence
atgacctggaaaggagtcca

SEQ ID NO: 21998 - DNA, 20 bp, Artificial
  CRISPR gRNA sequence
caagatgaaccacgagccag

SEQ ID NO: 21999 - DNA, 20 bp, Artificial
  CRISPR gRNA sequence
actacggagtccagccatcg

SEQ ID NO: 22000 - DNA, 20 bp, Artificial
  CRISPR gRNA sequence
agcgtcctgggcctcacccc

SEQ ID NO: 22001 - DNA, 20 bp, Artificial
  CRISPR gRNA sequence
ttctttcattttttttgaga

SEQ ID NO: 22002 - DNA, 20 bp, Artificial
  CRISPR gRNA sequence
aatctccgcctcctgggttc

SEQ ID NO: 22003 - DNA, 20 bp, Artificial
  CRISPR gRNA sequence
tccaccagcctaccgagtag

SEQ ID NO: 22004 - DNA, 20 bp, Artificial
  CRISPR gRNA sequence
ttttgtatttttaggagaga

SEQ ID NO: 22005 - DNA, 20 bp, Artificial
  CRISPR gRNA sequence
agtagtcaccagaccctcag

SEQ ID NO: 22006 - DNA, 20 bp, Artificial
  CRISPR gRNA sequence
accctcagcatagattttac

SEQ ID NO: 22007 - DNA, 20 bp, Artificial
  CRISPR gRNA sequence
cttccaggtctttcctctca

SEQ ID NO: 22008 - DNA, 20 bp, Artificial
  CRISPR gRNA sequence
tttttaaagaaacttaaata

SEQ ID NO: 22009 - DNA, 20 bp, Artificial
  CRISPR gRNA sequence
taaatagaccgattttaaaa

SEQ ID NO: 22010 - DNA, 20 bp, Artificial
  CRISPR gRNA sequence
tttgtccacccatgtaccta

SEQ ID NO: 22011 - DNA, 20 bp, Artificial
  CRISPR gRNA sequence
tggaaggggcagtggggagt

SEQ ID NO: 22012 - DNA, 20 bp, Artificial
  CRISPR gRNA sequence
gggagttattgcttattggg

SEQ ID NO: 22013 - DNA, 20 bp, Artificial
  CRISPR gRNA sequence
tattgcttattgggtagagt

SEQ ID NO: 22014 - DNA, 20 bp, Artificial
  CRISPR gRNA sequence
gatggtagcggaggttgcac

SEQ ID NO: 22015 - DNA, 20 bp, Artificial
  CRISPR gRNA sequence
tttatgttatatgtatttta

SEQ ID NO: 22016 - DNA, 20 bp, Artificial
  CRISPR gRNA sequence
aacaatgttactaaaataat

SEQ ID NO: 22017 - DNA, 20 bp, Artificial
  CRISPR gRNA sequence
agactttgtccttgatgtca

SEQ ID NO: 22018 - DNA, 20 bp, Artificial
  CRISPR gRNA sequence
tttggaaacctcccatctgc

SEQ ID NO: 22019 - DNA, 20 bp, Artificial
  CRISPR gRNA sequence
aaactccgcctcttgggttc

SEQ ID NO: 22020 - DNA, 20 bp, Artificial
  CRISPR gRNA sequence
tgcctcagcctcccaagtag

SEQ ID NO: 22021 - DNA, 20 bp, Artificial
  CRISPR gRNA sequence
tgcccggctaaaacacaaaa

SEQ ID NO: 22022 - DNA, 20 bp, Artificial
  CRISPR gRNA sequence
aaaaagtgttttagtagagt

SEQ ID NO: 22023 - DNA, 20 bp, Artificial
  CRISPR gRNA sequence
cgcctcggcctcccaaagtg

SEQ ID NO: 22024 - DNA, 20 bp, Artificial
  CRISPR gRNA sequence
ccaatgcatgaatattcttt

SEQ ID NO: 22025 - DNA, 20 bp, Artificial
  CRISPR gRNA sequence
tattctttggtggttttcta

SEQ ID NO: 22026 - DNA, 20 bp, Artificial
  CRISPR gRNA sequence
agacatcatcaagcaagctc

SEQ ID NO: 22027 - DNA, 20 bp, Artificial
  CRISPR gRNA sequence
gcaaatctgaggctaagtcc

SEQ ID NO: 22028 - DNA, 20 bp, Artificial
  CRISPR gRNA sequence
ctacctccctccagccactt

SEQ ID NO: 22029 - DNA, 20 bp, Artificial
  CRISPR gRNA sequence
ctgattgcctggaactaatc

SEQ ID NO: 22030 - DNA, 20 bp, Artificial
  CRISPR gRNA sequence
cagagtttccttgggttaat

SEQ ID NO: 22031 - DNA, 20 bp, Artificial
  CRISPR gRNA sequence
atcagacagactgggtatca

SEQ ID NO: 22032 - DNA, 20 bp, Artificial
  CRISPR gRNA sequence
ctgcatttgtggaggttcac

SEQ ID NO: 22033 - DNA, 20 bp, Artificial
  CRISPR gRNA sequence
gttcaaatcctgcgtctgca

SEQ ID NO: 22034 - DNA, 20 bp, Artificial
  CRISPR gRNA sequence
cctggtactccttttctgat

SEQ ID NO: 22035 - DNA, 20 bp, Artificial
  CRISPR gRNA sequence
cattggagtcacctgggata

SEQ ID NO: 22036 - DNA, 20 bp, Artificial
  CRISPR gRNA sequence
gatgttcatgtgtggggagc

SEQ ID NO: 22037 - DNA, 20 bp, Artificial
  CRISPR gRNA sequence
agaccctgcctccaaacgct

SEQ ID NO: 22038 - DNA, 20 bp, Artificial
  CRISPR gRNA sequence
ggtcatcccctaagggagcc

SEQ ID NO: 22039 - DNA, 20 bp, Artificial
  CRISPR gRNA sequence
tttctccaagaggaagaagt

SEQ ID NO: 22040 - DNA, 20 bp, Artificial
  CRISPR gRNA sequence
gggagccatgccttgaactt

SEQ ID NO: 22041 - DNA, 20 bp, Artificial
  CRISPR gRNA sequence
gctgtgggactcaggaggac

SEQ ID NO: 22042 - DNA, 20 bp, Artificial
  CRISPR gRNA sequence
gactaagctaagcatggtgg

SEQ ID NO: 22043 - DNA, 20 bp, Artificial
  CRISPR gRNA sequence
ctaagcatggtggctccgat

SEQ ID NO: 22044 - DNA, 20 bp, Artificial
  CRISPR gRNA sequence
tcccaccccggcattcgcac

SEQ ID NO: 22045 - DNA, 20 bp, Artificial
  CRISPR gRNA sequence
attcgcacgctggctttccg

SEQ ID NO: 22046 - DNA, 20 bp, Artificial
  CRISPR gRNA sequence
acttatcccatcctctggtt

SEQ ID NO: 22047 - DNA, 20 bp, Artificial
  CRISPR gRNA sequence
ccgcctggagagcccaatac

SEQ ID NO: 22048 - DNA, 20 bp, Artificial
  CRISPR gRNA sequence
tccgcgctcccagtctgcgc

SEQ ID NO: 22049 - DNA, 20 bp, Artificial
  CRISPR gRNA sequence
cttctctgcagaagctgccg

SEQ ID NO: 22050 - DNA, 20 bp, Artificial
  CRISPR gRNA sequence
ttgcggggatgctggaaacg

SEQ ID NO: 22051 - DNA, 20 bp, Artificial
  CRISPR gRNA sequence
agtagctgacagtctcggag

SEQ ID NO: 22052 - DNA, 20 bp, Artificial
  CRISPR gRNA sequence
aagcacctactgtggccacc

SEQ ID NO: 22053 - DNA, 20 bp, Artificial
  CRISPR gRNA sequence
tctgcaagtcctgagttgca

SEQ ID NO: 22054 - DNA, 20 bp, Artificial
  CRISPR gRNA sequence
gtccccacccctgggtgggt

SEQ ID NO: 22055 - DNA, 20 bp, Artificial
  CRISPR gRNA sequence
tgccggtccttttcagaggt

SEQ ID NO: 22056 - DNA, 20 bp, Artificial
  CRISPR gRNA sequence
cctcatcattaccctttcat

SEQ ID NO: 22057 - DNA, 20 bp, Artificial
  CRISPR gRNA sequence
acctcaaggctgactccaat

SEQ ID NO: 22058 - DNA, 20 bp, Artificial
  CRISPR gRNA sequence
gctgactccaattttggttt

SEQ ID NO: 22059 - DNA, 20 bp, Artificial
  CRISPR gRNA sequence
cacccccatccccaattcag

SEQ ID NO: 22060 - DNA, 20 bp, Artificial
  CRISPR gRNA sequence
tccccaattcagaatggttt

SEQ ID NO: 22061 - DNA, 20 bp, Artificial
  CRISPR gRNA sequence
tgagactgcacgctaaatta

SEQ ID NO: 22062 - DNA, 20 bp, Artificial
  CRISPR gRNA sequence
tggcagcccctcctcgtgcc

SEQ ID NO: 22063 - DNA, 20 bp, Artificial
  CRISPR gRNA sequence
tcctgccattccagataaac

SEQ ID NO: 22064 - DNA, 20 bp, Artificial
  CRISPR gRNA sequence
tcacggttggactgagttgg

SEQ ID NO: 22065 - DNA, 20 bp, Artificial
  CRISPR gRNA sequence
cctggcccgagctcagcgct

SEQ ID NO: 22066 - DNA, 20 bp, Artificial
  CRISPR gRNA sequence
gcccgagctcagcgctgcag

SEQ ID NO: 22067 - DNA, 20 bp, Artificial
  CRISPR gRNA sequence
tgtaacccctaaggtcgggc

SEQ ID NO: 22068 - DNA, 20 bp, Artificial
  CRISPR gRNA sequence
ccgtttctgctccccactcc

SEQ ID NO: 22069 - DNA, 20 bp, Artificial
  CRISPR gRNA sequence
aacaggtacttcttcctctt

SEQ ID NO: 22070 - DNA, 20 bp, Artificial
  CRISPR gRNA sequence
tccctgttacaaaacctcta

SEQ ID NO: 22071 - DNA, 20 bp, Artificial
  CRISPR gRNA sequence
ggcaggtcccaggcagtcag

SEQ ID NO: 22072 - DNA, 20 bp, Artificial
  CRISPR gRNA sequence
cctcagataccttgagaaga

SEQ ID NO: 22073 - DNA, 20 bp, Artificial
  CRISPR gRNA sequence
ataccttgagaagagcagaa

SEQ ID NO: 22074 - DNA, 20 bp, Artificial
  CRISPR gRNA sequence
cttgatgatgtctgatgtgt

SEQ ID NO: 22075 - DNA, 20 bp, Artificial
  CRISPR gRNA sequence
atgtgtacagaaaaagcact

SEQ ID NO: 22076 - DNA, 20 bp, Artificial
  CRISPR gRNA sequence
aagcactttagaaaaccacc

SEQ ID NO: 22077 - DNA, 20 bp, Artificial
  CRISPR gRNA sequence
atagatcctaaagggattgt

SEQ ID NO: 22078 - DNA, 20 bp, Artificial
  CRISPR gRNA sequence
aagaccagcctgggcaacct

SEQ ID NO: 22079 - DNA, 20 bp, Artificial
  CRISPR gRNA sequence
ctacttgggaggctgaggca

SEQ ID NO: 22080 - DNA, 20 bp, Artificial
  CRISPR gRNA sequence
tctcaggaaaaaaaaaagag

SEQ ID NO: 22081 - DNA, 20 bp, Artificial
  CRISPR gRNA sequence
acacacagtcaaaagacagt

SEQ ID NO: 22082 - DNA, 20 bp, Artificial
  CRISPR gRNA sequence
actctagacaccgcctataa

SEQ ID NO: 22083 - DNA, 20 bp, Artificial
  CRISPR gRNA sequence
ctgactccccgctttcaact

SEQ ID NO: 22084 - DNA, 20 bp, Artificial
  CRISPR gRNA sequence
gtttctttaaaaagttaatt

SEQ ID NO: 22085 - DNA, 20 bp, Artificial
  CRISPR gRNA sequence
gacttcaggaaggaaagata

SEQ ID NO: 22086 - DNA, 20 bp, Artificial
  CRISPR gRNA sequence
ggaaggaaagatataagaat

SEQ ID NO: 22087 - DNA, 20 bp, Artificial
  CRISPR gRNA sequence
ctactcggtaggctggtgga

SEQ ID NO: 22088 - DNA, 20 bp, Artificial
  CRISPR gRNA sequence
actccgtctcaaaaaaaatg

SEQ ID NO: 22089 - DNA, 20 bp, Artificial
  CRISPR gRNA sequence
cccggctgcagactccctga

SEQ ID NO: 22090 - DNA, 20 bp, Artificial
  CRISPR gRNA sequence
ggaacacccgaaggaaaagg

SEQ ID NO: 22091 - DNA, 20 bp, Artificial
  CRISPR gRNA sequence
agtcccctccaagaccctct

SEQ ID NO: 22092 - DNA, 20 bp, Artificial
  CRISPR gRNA sequence
acagctgaggagcttgcagg

SEQ ID NO: 22093 - DNA, 20 bp, Artificial
  CRISPR gRNA sequence
gactgccaggcaacgaggaa

SEQ ID NO: 22094 - DNA, 20 bp, Artificial
  CRISPR gRNA sequence
tactcaggatcaaaggcaga

SEQ ID NO: 22095 - DNA, 20 bp, Artificial
  CRISPR gRNA sequence
gatagactccccgcctctgg

SEQ ID NO: 22096 - DNA, 20 bp, Artificial
  CRISPR gRNA sequence
agttgccgttaacagttgaa

SEQ ID NO: 22097 - DNA, 20 bp, Artificial
  CRISPR gRNA sequence
tctagcacagccccagacac

SEQ ID NO: 22098 - DNA, 20 bp, Artificial
  CRISPR gRNA sequence
ccccacatggctcctcaaaa

SEQ ID NO: 22099 - DNA, 20 bp, Artificial
  CRISPR gRNA sequence
atgaagagaggctgccatgc

SEQ ID NO: 22100 - DNA, 20 bp, Artificial
  CRISPR gRNA sequence
ccgctctggcaatgtggttt

SEQ ID NO: 22101 - DNA, 20 bp, Artificial
  CRISPR gRNA sequence
acttggctaaggcatcacag

SEQ ID NO: 22102 - DNA, 20 bp, Artificial
  CRISPR gRNA sequence
gggtccccttatgcaaaaga

SEQ ID NO: 22103 - DNA, 20 bp, Artificial
  CRISPR gRNA sequence
cttcacaaagtttgacctcg

SEQ ID NO: 22104 - DNA, 20 bp, Artificial
  CRISPR gRNA sequence
ctggcagacccaatgccctg

SEQ ID NO: 22105 - DNA, 20 bp, Artificial
  CRISPR gRNA sequence
tatagatatggaattatctt

SEQ ID NO: 22106 - DNA, 20 bp, Artificial
  CRISPR gRNA sequence
gtgaaagctgtggatgcgtg

SEQ ID NO: 22107 - DNA, 20 bp, Artificial
  CRISPR gRNA sequence
ctacttgggaggttgaagca

SEQ ID NO: 22108 - DNA, 20 bp, Artificial
  CRISPR gRNA sequence
agactctgtctcaaaaaaaa

SEQ ID NO: 22109 - DNA, 20 bp, Artificial
  CRISPR gRNA sequence
tgtctcaaaaaaaaaaagaa

SEQ ID NO: 22110 - DNA, 20 bp, Artificial
  CRISPR gRNA sequence
tgggaaaagggtctttgcag

SEQ ID NO: 22111 - DNA, 20 bp, Artificial
  CRISPR gRNA sequence
ctactcaggagactggggca

SEQ ID NO: 22112 - DNA, 20 bp, Artificial
  CRISPR gRNA sequence
tgtctcaaaagaaggcaaaa

SEQ ID NO: 22113 - DNA, 20 bp, Artificial
  CRISPR gRNA sequence
caatgacaagtgtctttata

SEQ ID NO: 22114 - DNA, 20 bp, Artificial
  CRISPR gRNA sequence
ttctggcctccagaaccatg

SEQ ID NO: 22115 - DNA, 20 bp, Artificial
  CRISPR gRNA sequence
ctgctcaggaggctgaggca

SEQ ID NO: 22116 - DNA, 20 bp, Artificial
  CRISPR gRNA sequence
agcacatttcatcaccccct

SEQ ID NO: 22117 - DNA, 20 bp, Artificial
  CRISPR gRNA sequence
gttttggtcatttcaaataa

SEQ ID NO: 22118 - DNA, 20 bp, Artificial
  CRISPR gRNA sequence
caacaaatgatgaggaaatc

SEQ ID NO: 22119 - DNA, 20 bp, Artificial
  CRISPR gRNA sequence
acatattaggaaactgaggc

SEQ ID NO: 22120 - DNA, 20 bp, Artificial
  CRISPR gRNA sequence
gttccccaccagccctcttt

SEQ ID NO: 22121 - DNA, 20 bp, Artificial
  CRISPR gRNA sequence
cggtgaggaagcacctgagc

SEQ ID NO: 22122 - DNA, 20 bp, Artificial
  CRISPR gRNA sequence
agccacgtcagtcccctccc

SEQ ID NO: 22123 - DNA, 20 bp, Artificial
  CRISPR gRNA sequence
gccccttcactaatgaccac

SEQ ID NO: 22124 - DNA, 20 bp, Artificial
  CRISPR gRNA sequence
ctccatttttaaccacaaaa

SEQ ID NO: 22125 - DNA, 20 bp, Artificial
  CRISPR gRNA sequence
ttgggggagagacgtgggat

SEQ ID NO: 22126 - DNA, 20 bp, Artificial
  CRISPR gRNA sequence
catacagagcctatgttgaa

SEQ ID NO: 22127 - DNA, 20 bp, Artificial
  CRISPR gRNA sequence
gtattgaaaatcataccaag

SEQ ID NO: 22128 - DNA, 20 bp, Artificial
  CRISPR gRNA sequence
gactagtaattgttcatgtt

SEQ ID NO: 22129 - DNA, 20 bp, Artificial
  CRISPR gRNA sequence
cctgacactgagtaatttat

SEQ ID NO: 22130 - DNA, 20 bp, Artificial
  CRISPR gRNA sequence
agttacaatgtgtaaagcat

SEQ ID NO: 22131 - DNA, 20 bp, Artificial
  CRISPR gRNA sequence
cctcactctgccactgtgac

SEQ ID NO: 22132 - DNA, 20 bp, Artificial
  CRISPR gRNA sequence
atttattcatcttacacaga

SEQ ID NO: 22133 - DNA, 20 bp, Artificial
  CRISPR gRNA sequence
gagatgccagcagaagttgg

SEQ ID NO: 22134 - DNA, 20 bp, Artificial
  CRISPR gRNA sequence
gcagaagttgggcagaaaag

SEQ ID NO: 22135 - DNA, 20 bp, Artificial
  CRISPR gRNA sequence
gtatgagattttaaaagtgc

SEQ ID NO: 22136 - DNA, 20 bp, Artificial
  CRISPR gRNA sequence
ctactcgggaggctgaggca

SEQ ID NO: 22137 - DNA, 20 bp, Artificial
  CRISPR gRNA sequence
gtctcaaacaacaacaacca

SEQ ID NO: 22138 - DNA, 20 bp, Artificial
  CRISPR gRNA sequence
ccagcttcctttttgccttg

SEQ ID NO: 22139 - DNA, 20 bp, Artificial
  CRISPR gRNA sequence
ctaccagggaggctagggtg

SEQ ID NO: 22140 - DNA, 20 bp, Artificial
  CRISPR gRNA sequence
ttcaagatacaataaaagtg

SEQ ID NO: 22141 - DNA, 20 bp, Artificial
  CRISPR gRNA sequence
gcctccggccagatgcgcct

SEQ ID NO: 22142 - DNA, 20 bp, Artificial
  CRISPR gRNA sequence
ccaactgctctgctaggtgc

SEQ ID NO: 22143 - DNA, 20 bp, Artificial
  CRISPR gRNA sequence
aagaattccatcagggcagg

SEQ ID NO: 22144 - DNA, 20 bp, Artificial
  CRISPR gRNA sequence
cattaatcaaataagcaaaa

SEQ ID NO: 22145 - DNA, 20 bp, Artificial
  CRISPR gRNA sequence
ctaatgacaagtgatgttta

SEQ ID NO: 22146 - DNA, 20 bp, Artificial
  CRISPR gRNA sequence
ttgtgggggaatggacagct

SEQ ID NO: 22147 - DNA, 20 bp, Artificial
  CRISPR gRNA sequence
cttcagctgcttgttaccca

SEQ ID NO: 22148 - DNA, 20 bp, Artificial
  CRISPR gRNA sequence
ttttaaaagtacagttggcc

SEQ ID NO: 22149 - DNA, 20 bp, Artificial
  CRISPR gRNA sequence
aacacttcattgtcaggctg

SEQ ID NO: 22150 - DNA, 20 bp, Artificial
  CRISPR gRNA sequence
tgggaataaaccagtgaata

SEQ ID NO: 22151 - DNA, 20 bp, Artificial
  CRISPR gRNA sequence
tggtgggatgtatagcatgc

SEQ ID NO: 22152 - DNA, 20 bp, Artificial
  CRISPR gRNA sequence
tgagtgagtagtgatcaagc

SEQ ID NO: 22153 - DNA, 20 bp, Artificial
  CRISPR gRNA sequence
ttagtgagtaaatgaaggaa

SEQ ID NO: 22154 - DNA, 20 bp, Artificial
  CRISPR gRNA sequence
ctacttggcaggccgaggca

SEQ ID NO: 22155 - DNA, 20 bp, Artificial
  CRISPR gRNA sequence
ccatctcaaaaaaaaaaaag

SEQ ID NO: 22156 - DNA, 20 bp, Artificial
  CRISPR gRNA sequence
tatctccacaaaaaaacaaa

SEQ ID NO: 22157 - DNA, 20 bp, Artificial
  CRISPR gRNA sequence
atgcagagcagccgggtggg

SEQ ID NO: 22158 - DNA, 20 bp, Artificial
  CRISPR gRNA sequence
tgccagtcactggggtatgt

SEQ ID NO: 22159 - DNA, 20 bp, Artificial
  CRISPR gRNA sequence
ggtagccgaagcaaaaaggg

SEQ ID NO: 22160 - DNA, 20 bp, Artificial
  CRISPR gRNA sequence
gaaaaccactgtgtgagttg

SEQ ID NO: 22161 - DNA, 20 bp, Artificial
  CRISPR gRNA sequence
aggtagaggttgagctaagg

SEQ ID NO: 22162 - DNA, 20 bp, Artificial
  CRISPR gRNA sequence
tcgctgcccaggcggagcct

SEQ ID NO: 22163 - DNA, 20 bp, Artificial
  CRISPR gRNA sequence
gtctcgctgtgtctaccagg

SEQ ID NO: 22164 - DNA, 20 bp, Artificial
  CRISPR gRNA sequence
ctccctgctgttcgggacct

SEQ ID NO: 22165 - DNA, 20 bp, Artificial
  CRISPR gRNA sequence
acctgaatggagatagatct

SEQ ID NO: 22166 - DNA, 20 bp, Artificial
  CRISPR gRNA sequence
gctgagtggggagaggggag

SEQ ID NO: 22167 - DNA, 20 bp, Artificial
  CRISPR gRNA sequence
aattgtaatttcgccaggga

SEQ ID NO: 22168 - DNA, 20 bp, Artificial
  CRISPR gRNA sequence
ccaagggatggcctccccag

SEQ ID NO: 22169 - DNA, 20 bp, Artificial
  CRISPR gRNA sequence
taggcagtgttgctggggtg

SEQ ID NO: 22170 - DNA, 20 bp, Artificial
  CRISPR gRNA sequence
agcccaccatacatgggccc

SEQ ID NO: 22171 - DNA, 20 bp, Artificial
  CRISPR gRNA sequence
aattattatatttagatctg

SEQ ID NO: 22172 - DNA, 20 bp, Artificial
  CRISPR gRNA sequence
cctggccctaagctccttcc

SEQ ID NO: 22173 - DNA, 20 bp, Artificial
  CRISPR gRNA sequence
gtcttgctctgtcacccagg

SEQ ID NO: 22174 - DNA, 20 bp, Artificial
  CRISPR gRNA sequence
gatcactgctcccctgtgcc

SEQ ID NO: 22175 - DNA, 20 bp, Artificial
  CRISPR gRNA sequence
ctacttgggaggctgaggca

SEQ ID NO: 22176 - DNA, 20 bp, Artificial
  CRISPR gRNA sequence
gctggcaccataattttacc

SEQ ID NO: 22177 - DNA, 20 bp, Artificial
  CRISPR gRNA sequence
aaagttcaaaggacataatt

SEQ ID NO: 22178 - DNA, 20 bp, Artificial
  CRISPR gRNA sequence
ggctatgaaatctaccccaa

SEQ ID NO: 22179 - DNA, 20 bp, Artificial
  CRISPR gRNA sequence
atcctgcccccaaggcacct

SEQ ID NO: 22180 - DNA, 20 bp, Artificial
  CRISPR gRNA sequence
tgcccccaaggcacctgcag

SEQ ID NO: 22181 - DNA, 20 bp, Artificial
  CRISPR gRNA sequence
ggctcgctgtgtcacccagg

SEQ ID NO: 22182 - DNA, 20 bp, Artificial
  CRISPR gRNA sequence
aatgaaaataatgtttggtg

SEQ ID NO: 22183 - DNA, 20 bp, Artificial
  CRISPR gRNA sequence
catgtgaagcccacaacccg

SEQ ID NO: 22184 - DNA, 20 bp, Artificial
  CRISPR gRNA sequence
aggattagcgggacgtggtg

SEQ ID NO: 22185 - DNA, 20 bp, Artificial
  CRISPR gRNA sequence
tcttcttactcgccagactg

SEQ ID NO: 22186 - DNA, 20 bp, Artificial
  CRISPR gRNA sequence
gtgcttacttcttgctatgc

SEQ ID NO: 22187 - DNA, 20 bp, Artificial
  CRISPR gRNA sequence
aaagaaactcagaagcaaaa

SEQ ID NO: 22188 - DNA, 20 bp, Artificial
  CRISPR gRNA sequence
ctaggggaaaaggactctag

SEQ ID NO: 22189 - DNA, 20 bp, Artificial
  CRISPR gRNA sequence
gcccagcctgatttaccctt

SEQ ID NO: 22190 - DNA, 20 bp, Artificial
  CRISPR gRNA sequence
atgctggttgtgaatatgct

SEQ ID NO: 22191 - DNA, 20 bp, Artificial
  CRISPR gRNA sequence
acagtttccacacagtaagg

SEQ ID NO: 22192 - DNA, 20 bp, Artificial
  CRISPR gRNA sequence
agaactagtgggacctgggg

SEQ ID NO: 22193 - DNA, 20 bp, Artificial
  CRISPR gRNA sequence
cctagcctctattttcatat

SEQ ID NO: 22194 - DNA, 20 bp, Artificial
  CRISPR gRNA sequence
agctgacttgctgtgtgacc

SEQ ID NO: 22195 - DNA, 20 bp, Artificial
  CRISPR gRNA sequence
gtggagataaaagtgctttg

SEQ ID NO: 22196 - DNA, 20 bp, Artificial
  CRISPR gRNA sequence
tgttgtactggacgctggca

SEQ ID NO: 22197 - DNA, 20 bp, Artificial
  CRISPR gRNA sequence
gaagccaccatccctagatt

SEQ ID NO: 22198 - DNA, 20 bp, Artificial
  CRISPR gRNA sequence
tttagaacatgccttggtgc

SEQ ID NO: 22199 - DNA, 20 bp, Artificial
  CRISPR gRNA sequence
gaccagcactgggggcagga

SEQ ID NO: 22200 - DNA, 20 bp, Artificial
  CRISPR gRNA sequence
gagaccagcctgaccaacat

SEQ ID NO: 22201 - DNA, 20 bp, Artificial
  CRISPR gRNA sequence
ctacttgagaggctgaggca

SEQ ID NO: 22202 - DNA, 20 bp, Artificial
  CRISPR gRNA sequence
gaaactctgtctcgaaaaaa

SEQ ID NO: 22203 - DNA, 20 bp, Artificial
  CRISPR gRNA sequence
acgggtcggccggtaccagt

SEQ ID NO: 22204 - DNA, 20 bp, Artificial
  CRISPR gRNA sequence
ctacttgggaggctgaggca

SEQ ID NO: 22205 - DNA, 20 bp, Artificial
  CRISPR gRNA sequence
aaagtgagacttggtctcaa

SEQ ID NO: 22206 - DNA, 20 bp, Artificial
  CRISPR gRNA sequence
gagacttggtctcaaaaaga

SEQ ID NO: 22207 - DNA, 20 bp, Artificial
  CRISPR gRNA sequence
ttggtctcaaaaagaaaaga

SEQ ID NO: 22208 - DNA, 20 bp, Artificial
  CRISPR gRNA sequence
caaaaagaaaagaaaagaaa

SEQ ID NO: 22209 - DNA, 20 bp, Artificial
  CRISPR gRNA sequence
ttcccctagagcttcccacg

SEQ ID NO: 22210 - DNA, 20 bp, Artificial
  CRISPR gRNA sequence
gtgcctaattcctactacgc

SEQ ID NO: 22211 - DNA, 20 bp, Artificial
  CRISPR gRNA sequence
taaaacagtgatcatgctgg

SEQ ID NO: 22212 - DNA, 20 bp, Artificial
  CRISPR gRNA sequence
agcgagactccatctcaaaa

SEQ ID NO: 22213 - DNA, 20 bp, Artificial
  CRISPR gRNA sequence
gatggttcccattttccagg

SEQ ID NO: 22214 - DNA, 20 bp, Artificial
  CRISPR gRNA sequence
tacttaagtggggtggcggg

SEQ ID NO: 22215 - DNA, 20 bp, Artificial
  CRISPR gRNA sequence
ggggacggaaggactaagga

SEQ ID NO: 22216 - DNA, 20 bp, Artificial
  CRISPR gRNA sequence
ttacagtgttacctaggaca

SEQ ID NO: 22217 - DNA, 20 bp, Artificial
  CRISPR gRNA sequence
ctacttgggaggctgaggtg

SEQ ID NO: 22218 - DNA, 20 bp, Artificial
  CRISPR gRNA sequence
agcgagaccttgtctgaaaa

SEQ ID NO: 22219 - DNA, 20 bp, Artificial
  CRISPR gRNA sequence
ttgttcattgtgtctcctca

SEQ ID NO: 22220 - DNA, 20 bp, Artificial
  CRISPR gRNA sequence
taaagctgggtctccagggc

SEQ ID NO: 22221 - DNA, 20 bp, Artificial
  CRISPR gRNA sequence
taataaatggttgggtaagt

SEQ ID NO: 22222 - DNA, 20 bp, Artificial
  CRISPR gRNA sequence
gagcggttggatgagggagt

SEQ ID NO: 22223 - DNA, 20 bp, Artificial
  CRISPR gRNA sequence
gaggatgcagtaggcggaag

SEQ ID NO: 22224 - DNA, 20 bp, Artificial
  CRISPR gRNA sequence
gagcgagaccctgtctcaaa

SEQ ID NO: 22225 - DNA, 20 bp, Artificial
  CRISPR gRNA sequence
aaaaaagaaaaaaaacaaaa

SEQ ID NO: 22226 - DNA, 20 bp, Artificial
  CRISPR gRNA sequence
agaaaaaaaacaaaaaaaga

SEQ ID NO: 22227 - DNA, 20 bp, Artificial
  CRISPR gRNA sequence
tagagcagacttcaagggga

SEQ ID NO: 22228 - DNA, 20 bp, Artificial
  CRISPR gRNA sequence
tcctttgaactttttcaata

SEQ ID NO: 22229 - DNA, 20 bp, Artificial
  CRISPR gRNA sequence
gggaagatagacagataatc

SEQ ID NO: 22230 - DNA, 20 bp, Artificial
  CRISPR gRNA sequence
tttatttttaactgtgaggg

SEQ ID NO: 22231 - DNA, 20 bp, Artificial
  CRISPR gRNA sequence
ctactcgggaggctgaggca

SEQ ID NO: 22232 - DNA, 20 bp, Artificial
  CRISPR gRNA sequence
agcgagactccacctcaaaa

SEQ ID NO: 22233 - DNA, 20 bp, Artificial
  CRISPR gRNA sequence
actccacctcaaaaaaagaa

SEQ ID NO: 22234 - DNA, 20 bp, Artificial
  CRISPR gRNA sequence
aaagaaaaagaaaaaaggaa

SEQ ID NO: 22235 - DNA, 20 bp, Artificial
  CRISPR gRNA sequence
aaaaagaaaaaaggaaaaag

SEQ ID NO: 22236 - DNA, 20 bp, Artificial
  CRISPR gRNA sequence
agaaaaaaggaaaaagaaag

SEQ ID NO: 22237 - DNA, 20 bp, Artificial
  CRISPR gRNA sequence
aaaaagaaagaaagaaaggg

SEQ ID NO: 22238 - DNA, 20 bp, Artificial
  CRISPR gRNA sequence
agaaagaaagaaagggaaag

SEQ ID NO: 22239 - DNA, 20 bp, Artificial
  CRISPR gRNA sequence
agaaagaaagggaaagaaag

SEQ ID NO: 22240 - DNA, 20 bp, Artificial
  CRISPR gRNA sequence
aagaaagaaagaaaggaggg

SEQ ID NO: 22241 - DNA, 20 bp, Artificial
  CRISPR gRNA sequence
aagaaagaaaggagggaaag

SEQ ID NO: 22242 - DNA, 20 bp, Artificial
  CRISPR gRNA sequence
aagaaaggagggaaagaaag

SEQ ID NO: 22243 - DNA, 20 bp, Artificial
  CRISPR gRNA sequence
aaggagggaaagaaagaaag

SEQ ID NO: 22244 - DNA, 20 bp, Artificial
  CRISPR gRNA sequence
aaagaaagaaagaaacaggg

SEQ ID NO: 22245 - DNA, 20 bp, Artificial
  CRISPR gRNA sequence
aaagaaagaaacagggaaag

SEQ ID NO: 22246 - DNA, 20 bp, Artificial
  CRISPR gRNA sequence
aagaaacagggaaagaaaga

SEQ ID NO: 22247 - DNA, 20 bp, Artificial
  CRISPR gRNA sequence
gcctgggcacagtagaagcc

SEQ ID NO: 22248 - DNA, 20 bp, Artificial
  CRISPR gRNA sequence
agtagaagcctgagaaaatg

SEQ ID NO: 22249 - DNA, 20 bp, Artificial
  CRISPR gRNA sequence
cagctgaaaataatttaagg

SEQ ID NO: 22250 - DNA, 20 bp, Artificial
  CRISPR gRNA sequence
gacagagtaagactctgcct

SEQ ID NO: 22251 - DNA, 20 bp, Artificial
  CRISPR gRNA sequence
gagtaagactctgcctcaag

SEQ ID NO: 22252 - DNA, 20 bp, Artificial
  CRISPR gRNA sequence
agactctgcctcaagaaaga

SEQ ID NO: 22253 - DNA, 20 bp, Artificial
  CRISPR gRNA sequence
tcaagaaagaaaagaaaagg

SEQ ID NO: 22254 - DNA, 20 bp, Artificial
  CRISPR gRNA sequence
gaaggaagggagggaaggaa

SEQ ID NO: 22255 - DNA, 20 bp, Artificial
  CRISPR gRNA sequence
gaagggagggaaggaaagag

SEQ ID NO: 22256 - DNA, 20 bp, Artificial
  CRISPR gRNA sequence
agggaaggaaagagaaagaa

SEQ ID NO: 22257 - DNA, 20 bp, Artificial
  CRISPR gRNA sequence
aagagaaagaaagagaatgg

SEQ ID NO: 22258 - DNA, 20 bp, Artificial
  CRISPR gRNA sequence
gaaagaaagagaatggaaag

SEQ ID NO: 22259 - DNA, 20 bp, Artificial
  CRISPR gRNA sequence
aagagaatggaaagaaagaa

SEQ ID NO: 22260 - DNA, 20 bp, Artificial
  CRISPR gRNA sequence
gaaagaaagaaagagaaagg

SEQ ID NO: 22261 - DNA, 20 bp, Artificial
  CRISPR gRNA sequence
aaagagaaaggagagaaagg

SEQ ID NO: 22262 - DNA, 20 bp, Artificial
  CRISPR gRNA sequence
agaaaggagagaaaggaaag

SEQ ID NO: 22263 - DNA, 20 bp, Artificial
  CRISPR gRNA sequence
aggaaagaaagaaaagaagg

SEQ ID NO: 22264 - DNA, 20 bp, Artificial
  CRISPR gRNA sequence
aagaaagaaaagaaggaaag

SEQ ID NO: 22265 - DNA, 20 bp, Artificial
  CRISPR gRNA sequence
aagaaaagaaggaaagaaag

SEQ ID NO: 22266 - DNA, 20 bp, Artificial
  CRISPR gRNA sequence
aggaaggaagggagagagag

SEQ ID NO: 22267 - DNA, 20 bp, Artificial
  CRISPR gRNA sequence
aggaagggagagagagagag

SEQ ID NO: 22268 - DNA, 20 bp, Artificial
  CRISPR gRNA sequence
agggagagagagagagaaag

SEQ ID NO: 22269 - DNA, 20 bp, Artificial
  CRISPR gRNA sequence
agagagagagagaaagaaag

SEQ ID NO: 22270 - DNA, 20 bp, Artificial
  CRISPR gRNA sequence
agaaagaaagaaagaaacag

SEQ ID NO: 22271 - DNA, 20 bp, Artificial
  CRISPR gRNA sequence
agaaagaaagaaacagagag

SEQ ID NO: 22272 - DNA, 20 bp, Artificial
  CRISPR gRNA sequence
gaaacagagagaaagaaaaa

SEQ ID NO: 22273 - DNA, 20 bp, Artificial
  CRISPR gRNA sequence
aaggagggagggagggaagg

SEQ ID NO: 22274 - DNA, 20 bp, Artificial
  CRISPR gRNA sequence
aaagaaaaggaagggaaagg

SEQ ID NO: 22275 - DNA, 20 bp, Artificial
  CRISPR gRNA sequence
agggaaaggaaagaaagagg

SEQ ID NO: 22276 - DNA, 20 bp, Artificial
  CRISPR gRNA sequence
gaaagaaagaggaaagaaag

SEQ ID NO: 22277 - DNA, 20 bp, Artificial
  CRISPR gRNA sequence
gaaagaggaaagaaagagag

SEQ ID NO: 22278 - DNA, 20 bp, Artificial
  CRISPR gRNA sequence
gaggaaagaaagagagaaag

SEQ ID NO: 22279 - DNA, 20 bp, Artificial
  CRISPR gRNA sequence
gaaagagagaaagaaagaaa

SEQ ID NO: 22280 - DNA, 20 bp, Artificial
  CRISPR gRNA sequence
gagagaaagaaagaaagaag

SEQ ID NO: 22281 - DNA, 20 bp, Artificial
  CRISPR gRNA sequence
gaaagaaagaaagaagaaag

SEQ ID NO: 22282 - DNA, 20 bp, Artificial
  CRISPR gRNA sequence
aagaaagaagaaagaaagaa

SEQ ID NO: 22283 - DNA, 20 bp, Artificial
  CRISPR gRNA sequence
aagaaagaaaaagaaagaga

SEQ ID NO: 22284 - DNA, 20 bp, Artificial
  CRISPR gRNA sequence
aaagaaagagagaagaaagg

SEQ ID NO: 22285 - DNA, 20 bp, Artificial
  CRISPR gRNA sequence
aaagagagaagaaaggaaag

SEQ ID NO: 22286 - DNA, 20 bp, Artificial
  CRISPR gRNA sequence
agagaagaaaggaaagaaag

SEQ ID NO: 22287 - DNA, 20 bp, Artificial
  CRISPR gRNA sequence
caaagtggtgggcaagaggg

SEQ ID NO: 22288 - DNA, 20 bp, Artificial
  CRISPR gRNA sequence
acacagcgagaccctgtctt

SEQ ID NO: 22289 - DNA, 20 bp, Artificial
  CRISPR gRNA sequence
agactctggttagccattgc

SEQ ID NO: 22290 - DNA, 20 bp, Artificial
  CRISPR gRNA sequence
ggaaatgcccatgacaaact

SEQ ID NO: 22291 - DNA, 20 bp, Artificial
  CRISPR gRNA sequence
tagctcaacctctacctttc

SEQ ID NO: 22292 - DNA, 20 bp, Artificial
  CRISPR gRNA sequence
acaaaatggagtggaagagg

SEQ ID NO: 22293 - DNA, 20 bp, Artificial
  CRISPR gRNA sequence
ccatggctttactcttagca

SEQ ID NO: 22294 - DNA, 20 bp, Artificial
  CRISPR gRNA sequence
gtggcgtgctcagggggtgg

SEQ ID NO: 22295 - DNA, 20 bp, Artificial
  CRISPR gRNA sequence
gggccttcaaatattgactg

SEQ ID NO: 22296 - DNA, 20 bp, Artificial
  CRISPR gRNA sequence
catcctcatcttaaaaatgg

SEQ ID NO: 22297 - DNA, 20 bp, Artificial
  CRISPR gRNA sequence
aggaggcgtgaggcgggtgc

SEQ ID NO: 22298 - DNA, 20 bp, Artificial
  CRISPR gRNA sequence
aggctggaagatcagcccag

SEQ ID NO: 22299 - DNA, 20 bp, Artificial
  CRISPR gRNA sequence
aaatttcactcatgtttaaa

SEQ ID NO: 22300 - DNA, 20 bp, Artificial
  CRISPR gRNA sequence
ctgctccggaggctgaggca

SEQ ID NO: 22301 - DNA, 20 bp, Artificial
  CRISPR gRNA sequence
attgggggtggagagtggtg

SEQ ID NO: 22302 - DNA, 20 bp, Artificial
  CRISPR gRNA sequence
agaataaccaggtattgatt

SEQ ID NO: 22303 - DNA, 20 bp, Artificial
  CRISPR gRNA sequence
agatatttcaggacagagct

SEQ ID NO: 22304 - DNA, 20 bp, Artificial
  CRISPR gRNA sequence
attaggaaacaagacaaatc

SEQ ID NO: 22305 - DNA, 20 bp, Artificial
  CRISPR gRNA sequence
gatttttgggaaatagggac

SEQ ID NO: 22306 - DNA, 20 bp, Artificial
  CRISPR gRNA sequence
aggcagctcaacgaggaact

SEQ ID NO: 22307 - DNA, 20 bp, Artificial
  CRISPR gRNA sequence
ccttatccacctcccaagag

SEQ ID NO: 22308 - DNA, 20 bp, Artificial
  CRISPR gRNA sequence
cctccacacggagagctggg

SEQ ID NO: 22309 - DNA, 20 bp, Artificial
  CRISPR gRNA sequence
agctcctctgggaaggctgc

SEQ ID NO: 22310 - DNA, 20 bp, Artificial
  CRISPR gRNA sequence
tcctacattgcaggagtatg

SEQ ID NO: 22311 - DNA, 20 bp, Artificial
  CRISPR gRNA sequence
cgaaacactgcatggcctta

SEQ ID NO: 22312 - DNA, 20 bp, Artificial
  CRISPR gRNA sequence
aataaaacccaacattaatt

SEQ ID NO: 22313 - DNA, 20 bp, Artificial
  CRISPR gRNA sequence
ttatcaaatgaaaacataaa

SEQ ID NO: 22314 - DNA, 20 bp, Artificial
  CRISPR gRNA sequence
gaaaacataaagaagaaaaa

SEQ ID NO: 22315 - DNA, 20 bp, Artificial
  CRISPR gRNA sequence
cataaagaagaaaaacaaga

SEQ ID NO: 22316 - DNA, 20 bp, Artificial
  CRISPR gRNA sequence
aagaagaaaaacaagaaaag

SEQ ID NO: 22317 - DNA, 20 bp, Artificial
  CRISPR gRNA sequence
cagggagtaatgaagtaaat

SEQ ID NO: 22318 - DNA, 20 bp, Artificial
  CRISPR gRNA sequence
gtaaatgaagaaagcaaaat

SEQ ID NO: 22319 - DNA, 20 bp, Artificial
  CRISPR gRNA sequence
gctggggaaacagtcacgag

SEQ ID NO: 22320 - DNA, 20 bp, Artificial
  CRISPR gRNA sequence
aaggaaaaagacacacaagg

SEQ ID NO: 22321 - DNA, 20 bp, Artificial
  CRISPR gRNA sequence
aggtgacagtttagccaaca

SEQ ID NO: 22322 - DNA, 20 bp, Artificial
  CRISPR gRNA sequence
tggtcctatgtgctctactt

SEQ ID NO: 22323 - DNA, 20 bp, Artificial
  CRISPR gRNA sequence
cctggcacacagtggggact

SEQ ID NO: 22324 - DNA, 20 bp, Artificial
  CRISPR gRNA sequence
ctgctacaaagaagagcaag

SEQ ID NO: 22325 - DNA, 20 bp, Artificial
  CRISPR gRNA sequence
aggcaccatgacatgaagtc

SEQ ID NO: 22326 - DNA, 20 bp, Artificial
  CRISPR gRNA sequence
tcatatttcaggatgctgca

SEQ ID NO: 22327 - DNA, 20 bp, Artificial
  CRISPR gRNA sequence
gcttcaccttccagaagcag

SEQ ID NO: 22328 - DNA, 20 bp, Artificial
  CRISPR gRNA sequence
cttctcagcctccataactg

SEQ ID NO: 22329 - DNA, 20 bp, Artificial
  CRISPR gRNA sequence
gtggagatgccactaagggg

SEQ ID NO: 22330 - DNA, 20 bp, Artificial
  CRISPR gRNA sequence
cctggtaggggctgcatcct

SEQ ID NO: 22331 - DNA, 20 bp, Artificial
  CRISPR gRNA sequence
taaaaatggagactttgaaa

SEQ ID NO: 22332 - DNA, 20 bp, Artificial
  CRISPR gRNA sequence
tgaaacgagaaagacctagg

SEQ ID NO: 22333 - DNA, 20 bp, Artificial
  CRISPR gRNA sequence
aatttcctcatttgtaaaag

SEQ ID NO: 22334 - DNA, 20 bp, Artificial
  CRISPR gRNA sequence
gggtgtatggtatgggcttt

SEQ ID NO: 22335 - DNA, 20 bp, Artificial
  CRISPR gRNA sequence
gatggacagaagagcaagaa

SEQ ID NO: 22336 - DNA, 20 bp, Artificial
  CRISPR gRNA sequence
agcaagaagcagaaatgcgt

SEQ ID NO: 22337 - DNA, 20 bp, Artificial
  CRISPR gRNA sequence
tgctgacgggagggcaggga

SEQ ID NO: 22338 - DNA, 20 bp, Artificial
  CRISPR gRNA sequence
tcacagggtgttggaaagag

SEQ ID NO: 22339 - DNA, 20 bp, Artificial
  CRISPR gRNA sequence
tatgagaagatacccaggag

SEQ ID NO: 22340 - DNA, 20 bp, Artificial
  CRISPR gRNA sequence
tattatcctcactttgcata

SEQ ID NO: 22341 - DNA, 20 bp, Artificial
  CRISPR gRNA sequence
tattatgtattaataaaaca

SEQ ID NO: 22342 - DNA, 20 bp, Artificial
  CRISPR gRNA sequence
attaataaaacaaaagaaaa

SEQ ID NO: 22343 - DNA, 20 bp, Artificial
  CRISPR gRNA sequence
aaagtattccaccattaaag

SEQ ID NO: 22344 - DNA, 20 bp, Artificial
  CRISPR gRNA sequence
cactttgggaggctgagaca

SEQ ID NO: 22345 - DNA, 20 bp, Artificial
  CRISPR gRNA sequence
tatctctattaatttttttt

SEQ ID NO: 22346 - DNA, 20 bp, Artificial
  CRISPR gRNA sequence
tctattaatttttttttaag

SEQ ID NO: 22347 - DNA, 20 bp, Artificial
  CRISPR gRNA sequence
ctgcctctggaggctcgagg

SEQ ID NO: 22348 - DNA, 20 bp, Artificial
  CRISPR gRNA sequence
agctaatttttgtattttta

SEQ ID NO: 22349 - DNA, 20 bp, Artificial
  CRISPR gRNA sequence
gacatgcagatgaaggctgg

SEQ ID NO: 22350 - DNA, 20 bp, Artificial
  CRISPR gRNA sequence
tgccctgttctgggcccaga

SEQ ID NO: 22351 - DNA, 20 bp, Artificial
  CRISPR gRNA sequence
tacattgaagagtaagctca

SEQ ID NO: 22352 - DNA, 20 bp, Artificial
  CRISPR gRNA sequence
cacagacccccggatgtcac

SEQ ID NO: 22353 - DNA, 20 bp, Artificial
  CRISPR gRNA sequence
aatctgttctctcagagcag

SEQ ID NO: 22354 - DNA, 20 bp, Artificial
  CRISPR gRNA sequence
gtgtggttaagcacacagtc

SEQ ID NO: 22355 - DNA, 20 bp, Artificial
  CRISPR gRNA sequence
gggcatggtggctcacatct

SEQ ID NO: 22356 - DNA, 20 bp, Artificial
  CRISPR gRNA sequence
tgatagagccagactgtgtc

SEQ ID NO: 22357 - DNA, 20 bp, Artificial
  CRISPR gRNA sequence
cattggctcaacctggacaa

SEQ ID NO: 22358 - DNA, 20 bp, Artificial
  CRISPR gRNA sequence
gttttcccaatattagttct

SEQ ID NO: 22359 - DNA, 20 bp, Artificial
  CRISPR gRNA sequence
ctacttgggaggctgaggca

SEQ ID NO: 22360 - DNA, 20 bp, Artificial
  CRISPR gRNA sequence
tccgtggcaatgatatagaa

SEQ ID NO: 22361 - DNA, 20 bp, Artificial
  CRISPR gRNA sequence
accaccttccacatccaact

SEQ ID NO: 22362 - DNA, 20 bp, Artificial
  CRISPR gRNA sequence
agttaagttgcatggagccc

SEQ ID NO: 22363 - DNA, 20 bp, Artificial
  CRISPR gRNA sequence
gtagtcctccagataaactc

SEQ ID NO: 22364 - DNA, 20 bp, Artificial
  CRISPR gRNA sequence
atgattcactgagcaccccg

SEQ ID NO: 22365 - DNA, 20 bp, Artificial
  CRISPR gRNA sequence
ttactcaacctctctgagtc

SEQ ID NO: 22366 - DNA, 20 bp, Artificial
  CRISPR gRNA sequence
ggagaacgacctggcatcat

SEQ ID NO: 22367 - DNA, 20 bp, Artificial
  CRISPR gRNA sequence
ctcttgggtctatatatcct

SEQ ID NO: 22368 - DNA, 20 bp, Artificial
  CRISPR gRNA sequence
gtagatcctaaaaacatagt

SEQ ID NO: 22369 - DNA, 20 bp, Artificial
  CRISPR gRNA sequence
catagtacagaatgcaaaag

SEQ ID NO: 22370 - DNA, 20 bp, Artificial
  CRISPR gRNA sequence
aaaccccatctctactaaaa

SEQ ID NO: 22371 - DNA, 20 bp, Artificial
  CRISPR gRNA sequence
ttttataagagcacatacaa

SEQ ID NO: 22372 - DNA, 20 bp, Artificial
  CRISPR gRNA sequence
aaagatacacctgaaatgca

SEQ ID NO: 22373 - DNA, 20 bp, Artificial
  CRISPR gRNA sequence
ggaaatagggacattaatga

SEQ ID NO: 22374 - DNA, 20 bp, Artificial
  CRISPR gRNA sequence
tttaaaggcccaggggttga

SEQ ID NO: 22375 - DNA, 20 bp, Artificial
  CRISPR gRNA sequence
aggcccaggggttgaaaaga

SEQ ID NO: 22376 - DNA, 20 bp, Artificial
  CRISPR gRNA sequence
tggtacctatagatgttcac

SEQ ID NO: 22377 - DNA, 20 bp, Artificial
  CRISPR gRNA sequence
cgagacagagagaggactta

SEQ ID NO: 22378 - DNA, 20 bp, Artificial
  CRISPR gRNA sequence
catagtgaaaccccatctct

SEQ ID NO: 22379 - DNA, 20 bp, Artificial
  CRISPR gRNA sequence
aaaggatgaatgaatgaatg

SEQ ID NO: 22380 - DNA, 20 bp, Artificial
  CRISPR gRNA sequence
tcagcagttggaggcaggtt

SEQ ID NO: 22381 - DNA, 20 bp, Artificial
  CRISPR gRNA sequence
tcatgtatctgtccaaaccc

SEQ ID NO: 22382 - DNA, 20 bp, Artificial
  CRISPR gRNA sequence
ggggcctggtggtcccagga

SEQ ID NO: 22383 - DNA, 20 bp, Artificial
  CRISPR gRNA sequence
aggagaccttcggtccctgt

SEQ ID NO: 22384 - DNA, 20 bp, Artificial
  CRISPR gRNA sequence
tcggcaggcttggctgtgag

SEQ ID NO: 22385 - DNA, 20 bp, Artificial
  CRISPR gRNA sequence
ttttcttaaattaacttttt

SEQ ID NO: 22386 - DNA, 20 bp, Artificial
  CRISPR gRNA sequence
acttaaatagaccgatttta

SEQ ID NO: 22387 - DNA, 20 bp, Artificial
  CRISPR gRNA sequence
aaatatgggatatccacata

SEQ ID NO: 22388 - DNA, 20 bp, Artificial
  CRISPR gRNA sequence
tattagaatactattccgcc

SEQ ID NO: 22389 - DNA, 20 bp, Artificial
  CRISPR gRNA sequence
attttaccatgattttacaa

SEQ ID NO: 22390 - DNA, 20 bp, Artificial
  CRISPR gRNA sequence
cagtatcacttgtggttgaa

SEQ ID NO: 22391 - DNA, 20 bp, Artificial
  CRISPR gRNA sequence
cttctttaccactttgttaa

SEQ ID NO: 22392 - DNA, 20 bp, Artificial
  CRISPR gRNA sequence
aactatctatgtccttccta

SEQ ID NO: 22393 - DNA, 20 bp, Artificial
  CRISPR gRNA sequence
ttttttctctggagtgggga

SEQ ID NO: 22394 - DNA, 20 bp, Artificial
  CRISPR gRNA sequence
gatgctggccctagggagga

SEQ ID NO: 22395 - DNA, 20 bp, Artificial
  CRISPR gRNA sequence
ccatacatttcaggggagtc

SEQ ID NO: 22396 - DNA, 20 bp, Artificial
  CRISPR gRNA sequence
acactccaggaaaattgact

SEQ ID NO: 22397 - DNA, 20 bp, Artificial
  CRISPR gRNA sequence
tcctcacccccatccccaat

SEQ ID NO: 22398 - DNA, 20 bp, Artificial
  CRISPR gRNA sequence
tctttactctctccctgtta

SEQ ID NO: 22399 - DNA, 20 bp, Artificial
  CRISPR gRNA sequence
aggttcatctgtaaaatgga

SEQ ID NO: 22400 - DNA, 20 bp, Artificial
  CRISPR gRNA sequence
tgtacagaaaaagcacttta

SEQ ID NO: 22401 - DNA, 20 bp, Artificial
  CRISPR gRNA sequence
tggagaaaccccaactctac

SEQ ID NO: 22402 - DNA, 20 bp, Artificial
  CRISPR gRNA sequence
gggtcaggttcccttccagg

SEQ ID NO: 22403 - DNA, 20 bp, Artificial
  CRISPR gRNA sequence
acttatattggcttgggaaa

SEQ ID NO: 22404 - DNA, 20 bp, Artificial
  CRISPR gRNA sequence
tctgtttgtatgtgctctta

SEQ ID NO: 22405 - DNA, 20 bp, Artificial
  CRISPR gRNA sequence
agactccccgcctctgggaa

SEQ ID NO: 22406 - DNA, 20 bp, Artificial
  CRISPR gRNA sequence
tgagcctgtctcttcatctg

SEQ ID NO: 22407 - DNA, 20 bp, Artificial
  CRISPR gRNA sequence
ttctccagaactaatattgg

SEQ ID NO: 22408 - DNA, 20 bp, Artificial
  CRISPR gRNA sequence
gcagacccaatgccctgtga

SEQ ID NO: 22409 - DNA, 20 bp, Artificial
  CRISPR gRNA sequence
gaccagcgtggccaacatgg

SEQ ID NO: 22410 - DNA, 20 bp, Artificial
  CRISPR gRNA sequence
ccttcactaatgaccaccaa

SEQ ID NO: 22411 - DNA, 20 bp, Artificial
  CRISPR gRNA sequence
tgtgtgcagtgaacaacctg

SEQ ID NO: 22412 - DNA, 20 bp, Artificial
  CRISPR gRNA sequence
ttagtccattttttgttgct

SEQ ID NO: 22413 - DNA, 20 bp, Artificial
  CRISPR gRNA sequence
agtctctcttcctcttctca

SEQ ID NO: 22414 - DNA, 20 bp, Artificial
  CRISPR gRNA sequence
tcagtagatatctgttgaat

SEQ ID NO: 22415 - DNA, 20 bp, Artificial
  CRISPR gRNA sequence
tccggccagatgcgcctgga

SEQ ID NO: 22416 - DNA, 20 bp, Artificial
  CRISPR gRNA sequence
tggtcagatcttttgaagtt

SEQ ID NO: 22417 - DNA, 20 bp, Artificial
  CRISPR gRNA sequence
gtgagaacttatctccacaa

SEQ ID NO: 22418 - DNA, 20 bp, Artificial
  CRISPR gRNA sequence
aaaaaagccagaccctgtct

SEQ ID NO: 22419 - DNA, 20 bp, Artificial
  CRISPR gRNA sequence
agccagaccctgtctcaaaa

SEQ ID NO: 22420 - DNA, 20 bp, Artificial
  CRISPR gRNA sequence
gaccctgtctcaaaacaaaa

SEQ ID NO: 22421 - DNA, 20 bp, Artificial
  CRISPR gRNA sequence
aaaacaaaacaaacaaacaa

SEQ ID NO: 22422 - DNA, 20 bp, Artificial
  CRISPR gRNA sequence
agccgaagcaaaaagggaaa

SEQ ID NO: 22423 - DNA, 20 bp, Artificial
  CRISPR gRNA sequence
caggcggagcctctagaatt

SEQ ID NO: 22424 - DNA, 20 bp, Artificial
  CRISPR gRNA sequence
attgaaaactttgctgcatt

SEQ ID NO: 22425 - DNA, 20 bp, Artificial
  CRISPR gRNA sequence
gctaaggtccagaaggcaga

SEQ ID NO: 22426 - DNA, 20 bp, Artificial
  CRISPR gRNA sequence
gcctgggactatcctggttt

SEQ ID NO: 22427 - DNA, 20 bp, Artificial
  CRISPR gRNA sequence
gctgaaaaggggaaatgtct

SEQ ID NO: 22428 - DNA, 20 bp, Artificial
  CRISPR gRNA sequence
ctgaccctcacagttaaaaa

SEQ ID NO: 22429 - DNA, 20 bp, Artificial
  CRISPR gRNA sequence
ccccatctctactaaatata

SEQ ID NO: 22430 - DNA, 20 bp, Artificial
  CRISPR gRNA sequence
attcccctcatggttaaaaa

SEQ ID NO: 22431 - DNA, 20 bp, Artificial
  CRISPR gRNA sequence
cctggagacccagctttaaa

SEQ ID NO: 22432 - DNA, 20 bp, Artificial
  CRISPR gRNA sequence
tatcaataaagcattattat

SEQ ID NO: 22433 - DNA, 20 bp, Artificial
  CRISPR gRNA sequence
aagcattattatcaaaacag

SEQ ID NO: 22434 - DNA, 20 bp, Artificial
  CRISPR gRNA sequence
tcaaaacagtaaaacttttt

SEQ ID NO: 22435 - DNA, 20 bp, Artificial
  CRISPR gRNA sequence
cacagggatacagtaatgag

SEQ ID NO: 22436 - DNA, 20 bp, Artificial
  CRISPR gRNA sequence
gtctggttcataattgtgct

SEQ ID NO: 22437 - DNA, 20 bp, Artificial
  CRISPR gRNA sequence
catacataaataaaatattg

SEQ ID NO: 22438 - DNA, 20 bp, Artificial
  CRISPR gRNA sequence
tctccagggttcagagattg

SEQ ID NO: 22439 - DNA, 20 bp, Artificial
  CRISPR gRNA sequence
cttgattagtttaagcctca

SEQ ID NO: 22440 - DNA, 20 bp, Artificial
  CRISPR gRNA sequence
tggtcaaacagtgagcccag

SEQ ID NO: 22441 - DNA, 20 bp, Artificial
  CRISPR gRNA sequence
ggcgaagccctgtctctact

SEQ ID NO: 22442 - DNA, 20 bp, Artificial
  CRISPR gRNA sequence
ctacttttccattcacactg

SEQ ID NO: 22443 - DNA, 20 bp, Artificial
  CRISPR gRNA sequence
acagtggcccttctgaccct

SEQ ID NO: 22444 - DNA, 20 bp, Artificial
  CRISPR gRNA sequence
cctacataaataaaatattg

SEQ ID NO: 22445 - DNA, 20 bp, Artificial
  CRISPR gRNA sequence
cctgtctctactaaaaatat

SEQ ID NO: 22446 - DNA, 20 bp, Artificial
  CRISPR gRNA sequence
acagagcgagactccatctc

SEQ ID NO: 22447 - DNA, 20 bp, Artificial
  CRISPR gRNA sequence
ggttcccattttccaggtaa

SEQ ID NO: 22448 - DNA, 20 bp, Artificial
  CRISPR gRNA sequence
cacagcgagcccttgtctaa

SEQ ID NO: 22449 - DNA, 20 bp, Artificial
  CRISPR gRNA sequence
ggggcaggatttggggttgt

SEQ ID NO: 22450 - DNA, 20 bp, Artificial
  CRISPR gRNA sequence
agtgagactcagtctctaca

SEQ ID NO: 22451 - DNA, 20 bp, Artificial
  CRISPR gRNA sequence
accctgtctcaaaaaagaaa

SEQ ID NO: 22452 - DNA, 20 bp, Artificial
  CRISPR gRNA sequence
agcatccttgataaacatta

SEQ ID NO: 22453 - DNA, 20 bp, Artificial
  CRISPR gRNA sequence
tttagcaccttgtctctgtt

SEQ ID NO: 22454 - DNA, 20 bp, Artificial
  CRISPR gRNA sequence
gcaagaccccatctccaaaa

SEQ ID NO: 22455 - DNA, 20 bp, Artificial
  CRISPR gRNA sequence
agcaagatccctgtgtctac

SEQ ID NO: 22456 - DNA, 20 bp, Artificial
  CRISPR gRNA sequence
tggctttactcttagcataa

SEQ ID NO: 22457 - DNA, 20 bp, Artificial
  CRISPR gRNA sequence
tgctcagggggtggaaagaa

SEQ ID NO: 22458 - DNA, 20 bp, Artificial
  CRISPR gRNA sequence
ggtctcttcaagatgtggct

SEQ ID NO: 22459 - DNA, 20 bp, Artificial
  CRISPR gRNA sequence
atgtattgatgttgcaattt

SEQ ID NO: 22460 - DNA, 20 bp, Artificial
  CRISPR gRNA sequence
tgatgttgcaatttaaaaac

SEQ ID NO: 22461 - DNA, 20 bp, Artificial
  CRISPR gRNA sequence
aacatttaaaaaaaataagg

SEQ ID NO: 22462 - DNA, 20 bp, Artificial
  CRISPR gRNA sequence
gctgacgggggccccaagga

SEQ ID NO: 22463 - DNA, 20 bp, Artificial
  CRISPR gRNA sequence
tcctctgggaaggctgcaga

SEQ ID NO: 22464 - DNA, 20 bp, Artificial
  CRISPR gRNA sequence
cacaacatgggtttgagcca

SEQ ID NO: 22465 - DNA, 20 bp, Artificial
  CRISPR gRNA sequence
catgggtttgagccaaaaaa

SEQ ID NO: 22466 - DNA, 20 bp, Artificial
  CRISPR gRNA sequence
gtttgagccaaaaaacaaaa

SEQ ID NO: 22467 - DNA, 20 bp, Artificial
  CRISPR gRNA sequence
agccaaaaaacaaaacaaaa

SEQ ID NO: 22468 - DNA, 20 bp, Artificial
  CRISPR gRNA sequence
agcactcacagcaacagatt

SEQ ID NO: 22469 - DNA, 20 bp, Artificial
  CRISPR gRNA sequence
tagagatgtgataagatgaa

SEQ ID NO: 22470 - DNA, 20 bp, Artificial
  CRISPR gRNA sequence
tttcacttttattgtatctt

SEQ ID NO: 22471 - DNA, 20 bp, Artificial
  CRISPR gRNA sequence
gtgagccaccacgcctggcc

SEQ ID NO: 22472 - DNA, 20 bp, Artificial
  CRISPR gRNA sequence
gggggaaatatttatcaaat

SEQ ID NO: 22473 - DNA, 20 bp, Artificial
  CRISPR gRNA sequence
caaatgaaaacataaagaag

SEQ ID NO: 22474 - DNA, 20 bp, Artificial
  CRISPR gRNA sequence
taggttgactaagataggag

SEQ ID NO: 22475 - DNA, 20 bp, Artificial
  CRISPR gRNA sequence
cctatgtgctctactttgag

SEQ ID NO: 22476 - DNA, 20 bp, Artificial
  CRISPR gRNA sequence
aggatgaggtatgtatccat

SEQ ID NO: 22477 - DNA, 20 bp, Artificial
  CRISPR gRNA sequence
tcaccttccagaagcagaga

SEQ ID NO: 22478 - DNA, 20 bp, Artificial
  CRISPR gRNA sequence
acgtgaatgtttgtcttctc

SEQ ID NO: 22479 - DNA, 20 bp, Artificial
  CRISPR gRNA sequence
agatgccactaaggggggag

SEQ ID NO: 22480 - DNA, 20 bp, Artificial
  CRISPR gRNA sequence
tatcccacgtctctccccca

SEQ ID NO: 22481 - DNA, 20 bp, Artificial
  CRISPR gRNA sequence
tatcctcactttgcatatga

SEQ ID NO: 22482 - DNA, 20 bp, Artificial
  CRISPR gRNA sequence
tgtatcatattatgtattaa

SEQ ID NO: 22483 - DNA, 20 bp, Artificial
  CRISPR gRNA sequence
tatgtattaataaaacaaaa

SEQ ID NO: 22484 - DNA, 20 bp, Artificial
  CRISPR gRNA sequence
ataaaacaaaagaaaacaag

SEQ ID NO: 22485 - DNA, 20 bp, Artificial
  CRISPR gRNA sequence
aaaaccagatatatccacac

SEQ ID NO: 22486 - DNA, 20 bp, Artificial
  CRISPR gRNA sequence
attcaaaatagccaaaatat

SEQ ID NO: 22487 - DNA, 20 bp, Artificial
  CRISPR gRNA sequence
ttctatttatttgaaatgac

SEQ ID NO: 22488 - DNA, 20 bp, Artificial
  CRISPR gRNA sequence
ttacatctcaataaagctgt

SEQ ID NO: 22489 - DNA, 20 bp, Artificial
  CRISPR gRNA sequence
attgaagagtaagctcatga

SEQ ID NO: 22490 - DNA, 20 bp, Artificial
  CRISPR gRNA sequence
ccctatctctacaaataaca

SEQ ID NO: 22491 - DNA, 20 bp, Artificial
  CRISPR gRNA sequence
gtgagataccatctcaaaaa

SEQ ID NO: 22492 - DNA, 20 bp, Artificial
  CRISPR gRNA sequence
accatctcaaaaaaaaaaca

SEQ ID NO: 22493 - DNA, 20 bp, Artificial
  CRISPR gRNA sequence
caaaaaaaaaacaaaaaaca

SEQ ID NO: 22494 - DNA, 20 bp, Artificial
  CRISPR gRNA sequence
acttttcccctctaaagctg

SEQ ID NO: 22495 - DNA, 20 bp, Artificial
  CRISPR gRNA sequence
atgatattttaggagagaga

SEQ ID NO: 22496 - DNA, 20 bp, Artificial
  CRISPR gRNA sequence
taagatgtaaactccaaaaa

SEQ ID NO: 22497 - DNA, 20 bp, Artificial
  CRISPR gRNA sequence
aagcaaggcaagtagatcct

SEQ ID NO: 22498 - DNA, 20 bp, Artificial
  CRISPR gRNA sequence
gaccagcctggccaaggtgg

SEQ ID NO: 22499 - DNA, 20 bp, Artificial
  CRISPR gRNA sequence
ccccatctctactaaaaata

SEQ ID NO: 22500 - DNA, 20 bp, Artificial
  CRISPR gRNA sequence
ctaaaaaaaaaaaaaaaagg

SEQ ID NO: 22501 - DNA, 20 bp, Artificial
  CRISPR gRNA sequence
aatagggacattaatgaaga

SEQ ID NO: 22502 - DNA, 20 bp, Artificial
  CRISPR gRNA sequence
aacttcagagcaggaaagtg

SEQ ID NO: 22503 - DNA, 20 bp, Artificial
  CRISPR gRNA sequence
cataacaacttggaaaatct

SEQ ID NO: 22504 - DNA, 20 bp, Artificial
  CRISPR gRNA sequence
aattacctgggaagggtgtt

SEQ ID NO: 22505 - DNA, 20 bp, Artificial
  CRISPR gRNA sequence
aggcggtgtctagagtagcc

SEQ ID NO: 22506 - DNA, 20 bp, Artificial
  CRISPR gRNA sequence
ttaccatgattttacaaaaa

SEQ ID NO: 22507 - DNA, 20 bp, Artificial
  CRISPR gRNA sequence
tccatgtataaacggaaaag

SEQ ID NO: 22508 - DNA, 20 bp, Artificial
  CRISPR gRNA sequence
cagaaggattgaaggaatct

SEQ ID NO: 22509 - DNA, 20 bp, Artificial
  CRISPR gRNA sequence
tgtgcaccaccatgcccggc

SEQ ID NO: 22510 - DNA, 20 bp, Artificial
  CRISPR gRNA sequence
gcttgctatgtggcgttaag

SEQ ID NO: 22511 - DNA, 20 bp, Artificial
  CRISPR gRNA sequence
ctatgtggcgttaagcaaaa

SEQ ID NO: 22512 - DNA, 20 bp, Artificial
  CRISPR gRNA sequence
tggcgttaagcaaaacaaaa

SEQ ID NO: 22513 - DNA, 20 bp, Artificial
  CRISPR gRNA sequence
tcaggtaccttccatggatg

SEQ ID NO: 22514 - DNA, 20 bp, Artificial
  CRISPR gRNA sequence
ctgagctgggcatccgaagg

SEQ ID NO: 22515 - DNA, 20 bp, Artificial
  CRISPR gRNA sequence
tgagctgggcatccgaaggc

SEQ ID NO: 22516 - DNA, 20 bp, Artificial
  CRISPR gRNA sequence
agctgggcatccgaaggcat

SEQ ID NO: 22517 - DNA, 20 bp, Artificial
  CRISPR gRNA sequence
ggcatccgaaggcatccttg

SEQ ID NO: 22518 - DNA, 20 bp, Artificial
  CRISPR gRNA sequence
ggggaagctgagggcacgag

SEQ ID NO: 22519 - DNA, 20 bp, Artificial
  CRISPR gRNA sequence
gggaagctgagggcacgagg

SEQ ID NO: 22520 - DNA, 20 bp, Artificial
  CRISPR gRNA sequence
agggcacgaggaggggctgc

SEQ ID NO: 22521 - DNA, 20 bp, Artificial
  CRISPR gRNA sequence
ccagactccgggagctgctg

SEQ ID NO: 22522 - DNA, 20 bp, Artificial
  CRISPR gRNA sequence
cgggagctgctgcctggctg

SEQ ID NO: 22523 - DNA, 20 bp, Artificial
  CRISPR gRNA sequence
ctgcctggctgggattccta

SEQ ID NO: 22524 - DNA, 20 bp, Artificial
  CRISPR gRNA sequence
cctggctgggattcctacac

SEQ ID NO: 22525 - DNA, 20 bp, Artificial
  CRISPR gRNA sequence
gctgggattcctacacaatg

SEQ ID NO: 22526 - DNA, 20 bp, Artificial
  CRISPR gRNA sequence
ggattcctacacaatgcgtt

SEQ ID NO: 22527 - DNA, 20 bp, Artificial
  CRISPR gRNA sequence
ctacacaatgcgttgcctgg

SEQ ID NO: 22528 - DNA, 20 bp, Artificial
  CRISPR gRNA sequence
cacaatgcgttgcctggctc

SEQ ID NO: 22529 - DNA, 20 bp, Artificial
  CRISPR gRNA sequence
cctggctccacgccctgctg

SEQ ID NO: 22530 - DNA, 20 bp, Artificial
  CRISPR gRNA sequence
gctccacgccctgctgggtc

SEQ ID NO: 22531 - DNA, 20 bp, Artificial
  CRISPR gRNA sequence
cacgccctgctgggtcctac

SEQ ID NO: 22532 - DNA, 20 bp, Artificial
  CRISPR gRNA sequence
ctgggtcctacctgtcagag

SEQ ID NO: 22533 - DNA, 20 bp, Artificial
  CRISPR gRNA sequence
ggtcctacctgtcagagccc

SEQ ID NO: 22534 - DNA, 20 bp, Artificial
  CRISPR gRNA sequence
cctgtcagagccccaaggta

SEQ ID NO: 22535 - DNA, 20 bp, Artificial
  CRISPR gRNA sequence
tcagagccccaaggtaaaaa

SEQ ID NO: 22536 - DNA, 20 bp, Artificial
  CRISPR gRNA sequence
aatttagcgtgcagtctcag

SEQ ID NO: 22537 - DNA, 20 bp, Artificial
  CRISPR gRNA sequence
atttagcgtgcagtctcagc

SEQ ID NO: 22538 - DNA, 20 bp, Artificial
  CRISPR gRNA sequence
agcgtgcagtctcagctggt

SEQ ID NO: 22539 - DNA, 20 bp, Artificial
  CRISPR gRNA sequence
gcgtgcagtctcagctggtc

SEQ ID NO: 22540 - DNA, 20 bp, Artificial
  CRISPR gRNA sequence
agctggtcctgccattccag

SEQ ID NO: 22541 - DNA, 20 bp, Artificial
  CRISPR gRNA sequence
gtcctgccattccagataaa

SEQ ID NO: 22542 - DNA, 20 bp, Artificial
  CRISPR gRNA sequence
ccattccagataaacagaga

SEQ ID NO: 22543 - DNA, 20 bp, Artificial
  CRISPR gRNA sequence
cagataaacagagaaaccat

SEQ ID NO: 22544 - DNA, 20 bp, Artificial
  CRISPR gRNA sequence
tgaattggggatgggggtga

SEQ ID NO: 22545 - DNA, 20 bp, Artificial
  CRISPR gRNA sequence
aattggggatgggggtgagg

SEQ ID NO: 22546 - DNA, 20 bp, Artificial
  CRISPR gRNA sequence
gggatgggggtgaggatggg

SEQ ID NO: 22547 - DNA, 20 bp, Artificial
  CRISPR gRNA sequence
tgtcctgctggggcaggcca

SEQ ID NO: 22548 - DNA, 20 bp, Artificial
  CRISPR gRNA sequence
ctggggcaggccattggaag

SEQ ID NO: 22549 - DNA, 20 bp, Artificial
  CRISPR gRNA sequence
gggcaggccattggaagatg

SEQ ID NO: 22550 - DNA, 20 bp, Artificial
  CRISPR gRNA sequence
gaagatgtgaaagagttgtc

SEQ ID NO: 22551 - DNA, 20 bp, Artificial
  CRISPR gRNA sequence
tctatttccttccaccggag

SEQ ID NO: 22552 - DNA, 20 bp, Artificial
  CRISPR gRNA sequence
tttccttccaccggagggag

SEQ ID NO: 22553 - DNA, 20 bp, Artificial
  CRISPR gRNA sequence
ccttccaccggagggagact

SEQ ID NO: 22554 - DNA, 20 bp, Artificial
  CRISPR gRNA sequence
cttccaccggagggagactt

SEQ ID NO: 22555 - DNA, 20 bp, Artificial
  CRISPR gRNA sequence
ccaccggagggagacttcag

SEQ ID NO: 22556 - DNA, 20 bp, Artificial
  CRISPR gRNA sequence
caccggagggagacttcagg

SEQ ID NO: 22557 - DNA, 20 bp, Artificial
  CRISPR gRNA sequence
caggtcagccaggtgtctgg

SEQ ID NO: 22558 - DNA, 20 bp, Artificial
  CRISPR gRNA sequence
aggtcagccaggtgtctgga

SEQ ID NO: 22559 - DNA, 20 bp, Artificial
  CRISPR gRNA sequence
gagtatgaaccatgtatcag

SEQ ID NO: 22560 - DNA, 20 bp, Artificial
  CRISPR gRNA sequence
tagaagtcagactttcgggc

SEQ ID NO: 22561 - DNA, 20 bp, Artificial
  CRISPR gRNA sequence
gaagtcagactttcgggcag

SEQ ID NO: 22562 - DNA, 20 bp, Artificial
  CRISPR gRNA sequence
tcgggcagtgtgtcactaac

SEQ ID NO: 22563 - DNA, 20 bp, Artificial
  CRISPR gRNA sequence
cgggcagtgtgtcactaact

SEQ ID NO: 22564 - DNA, 20 bp, Artificial
  CRISPR gRNA sequence
gggcagtgtgtcactaactc

SEQ ID NO: 22565 - DNA, 20 bp, Artificial
  CRISPR gRNA sequence
actctcagcatgctggcctg

SEQ ID NO: 22566 - DNA, 20 bp, Artificial
  CRISPR gRNA sequence
tcagcatgctggcctggctc

SEQ ID NO: 22567 - DNA, 20 bp, Artificial
  CRISPR gRNA sequence
agcatgctggcctggctcgg

SEQ ID NO: 22568 - DNA, 20 bp, Artificial
  CRISPR gRNA sequence
gcctggctcggcccacagca

SEQ ID NO: 22569 - DNA, 20 bp, Artificial
  CRISPR gRNA sequence
gctcggcccacagcaaggtc

SEQ ID NO: 22570 - DNA, 20 bp, Artificial
  CRISPR gRNA sequence
ggcccacagcaaggtcttct

SEQ ID NO: 22571 - DNA, 20 bp, Artificial
  CRISPR gRNA sequence
ctcgcctccctttgggtaaa

SEQ ID NO: 22572 - DNA, 20 bp, Artificial
  CRISPR gRNA sequence
tcgcctccctttgggtaaat

SEQ ID NO: 22573 - DNA, 20 bp, Artificial
  CRISPR gRNA sequence
gcctccctttgggtaaatac

SEQ ID NO: 22574 - DNA, 20 bp, Artificial
  CRISPR gRNA sequence
cctttgggtaaatactgagg

SEQ ID NO: 22575 - DNA, 20 bp, Artificial
  CRISPR gRNA sequence
tgggtaaatactgaggggtg

SEQ ID NO: 22576 - DNA, 20 bp, Artificial
  CRISPR gRNA sequence
gggtaaatactgaggggtgc

SEQ ID NO: 22577 - DNA, 20 bp, Artificial
  CRISPR gRNA sequence
ggtaaatactgaggggtgcc

SEQ ID NO: 22578 - DNA, 20 bp, Artificial
  CRISPR gRNA sequence
aggggtgcctctgcaggacg

SEQ ID NO: 22579 - DNA, 20 bp, Artificial
  CRISPR gRNA sequence
tgcaggacgggacctctgcc

SEQ ID NO: 22580 - DNA, 20 bp, Artificial
  CRISPR gRNA sequence
caggacgggacctctgccag

SEQ ID NO: 22581 - DNA, 20 bp, Artificial
  CRISPR gRNA sequence
tgccagactccactccatac

SEQ ID NO: 22582 - DNA, 20 bp, Artificial
  CRISPR gRNA sequence
ccagactccactccataccc

SEQ ID NO: 22583 - DNA, 20 bp, Artificial
  CRISPR gRNA sequence
cactccatacccagagaagc

SEQ ID NO: 22584 - DNA, 20 bp, Artificial
  CRISPR gRNA sequence
catacccagagaagcaggga

SEQ ID NO: 22585 - DNA, 20 bp, Artificial
  CRISPR gRNA sequence
gagtcagccttgaggtgtag

SEQ ID NO: 22586 - DNA, 20 bp, Artificial
  CRISPR gRNA sequence
gaggtgtagctgttgagccc

SEQ ID NO: 22587 - DNA, 20 bp, Artificial
  CRISPR gRNA sequence
aggtgtagctgttgagccct

SEQ ID NO: 22588 - DNA, 20 bp, Artificial
  CRISPR gRNA sequence
ttgagccctcagcagctggg

SEQ ID NO: 22589 - DNA, 20 bp, Artificial
  CRISPR gRNA sequence
agccctcagcagctggggag

SEQ ID NO: 22590 - DNA, 20 bp, Artificial
  CRISPR gRNA sequence
agcagctggggagagctggc

SEQ ID NO: 22591 - DNA, 20 bp, Artificial
  CRISPR gRNA sequence
gggagagctggcggatgctg

SEQ ID NO: 22592 - DNA, 20 bp, Artificial
  CRISPR gRNA sequence
gcggatgctgccctcccccc

SEQ ID NO: 22593 - DNA, 20 bp, Artificial
  CRISPR gRNA sequence
ccctccccccagtttcctaa

SEQ ID NO: 22594 - DNA, 20 bp, Artificial
  CRISPR gRNA sequence
cccccagtttcctaatggtg

SEQ ID NO: 22595 - DNA, 20 bp, Artificial
  CRISPR gRNA sequence
cctaatggtgttgtttaaaa

SEQ ID NO: 22596 - DNA, 20 bp, Artificial
  CRISPR gRNA sequence
ctaatggtgttgtttaaaaa

SEQ ID NO: 22597 - DNA, 20 bp, Artificial
  CRISPR gRNA sequence
atggtgttgtttaaaaaggg

SEQ ID NO: 22598 - DNA, 20 bp, Artificial
  CRISPR gRNA sequence
tttaaaaagggtcaggggac

SEQ ID NO: 22599 - DNA, 20 bp, Artificial
  CRISPR gRNA sequence
aaaaagggtcaggggacggg

SEQ ID NO: 22600 - DNA, 20 bp, Artificial
  CRISPR gRNA sequence
aaaagggtcaggggacgggg

SEQ ID NO: 22601 - DNA, 20 bp, Artificial
  CRISPR gRNA sequence
gcaccggctctgaaggcagc

SEQ ID NO: 22602 - DNA, 20 bp, Artificial
  CRISPR gRNA sequence
tgaaggcagcatggcagcta

SEQ ID NO: 22603 - DNA, 20 bp, Artificial
  CRISPR gRNA sequence
aaggcagcatggcagctaca

SEQ ID NO: 22604 - DNA, 20 bp, Artificial
  CRISPR gRNA sequence
caccgttggctgggaagggt

SEQ ID NO: 22605 - DNA, 20 bp, Artificial
  CRISPR gRNA sequence
gctgggaagggtgtgcccct

SEQ ID NO: 22606 - DNA, 20 bp, Artificial
  CRISPR gRNA sequence
ggaagggtgtgcccctgaag

SEQ ID NO: 22607 - DNA, 20 bp, Artificial
  CRISPR gRNA sequence
aagaagtcgtttacattctc

SEQ ID NO: 22608 - DNA, 20 bp, Artificial
  CRISPR gRNA sequence
acattctcgagtcaattttc

SEQ ID NO: 22609 - DNA, 20 bp, Artificial
  CRISPR gRNA sequence
cattctcgagtcaattttcc

SEQ ID NO: 22610 - DNA, 20 bp, Artificial
  CRISPR gRNA sequence
tcgagtcaattttcctggag

SEQ ID NO: 22611 - DNA, 20 bp, Artificial
  CRISPR gRNA sequence
gagtcaattttcctggagtg

SEQ ID NO: 22612 - DNA, 20 bp, Artificial
  CRISPR gRNA sequence
tcctggagtgtacaatggac

SEQ ID NO: 22613 - DNA, 20 bp, Artificial
  CRISPR gRNA sequence
cctggagtgtacaatggacc

SEQ ID NO: 22614 - DNA, 20 bp, Artificial
  CRISPR gRNA sequence
ctggagtgtacaatggacct

SEQ ID NO: 22615 - DNA, 20 bp, Artificial
  CRISPR gRNA sequence
gagtgtacaatggacctgtg

SEQ ID NO: 22616 - DNA, 20 bp, Artificial
  CRISPR gRNA sequence
tgggaaagcctgtatgaaag

SEQ ID NO: 22617 - DNA, 20 bp, Artificial
  CRISPR gRNA sequence
tatgaaagggtaatgatgag

SEQ ID NO: 22618 - DNA, 20 bp, Artificial
  CRISPR gRNA sequence
gcacagtgtccaatatttta

SEQ ID NO: 22619 - DNA, 20 bp, Artificial
  CRISPR gRNA sequence
tataggaactggaattgagc

SEQ ID NO: 22620 - DNA, 20 bp, Artificial
  CRISPR gRNA sequence
ataggaactggaattgagct

SEQ ID NO: 22621 - DNA, 20 bp, Artificial
  CRISPR gRNA sequence
taggaactggaattgagctc

SEQ ID NO: 22622 - DNA, 20 bp, Artificial
  CRISPR gRNA sequence
gaattgagctcataggagct

SEQ ID NO: 22623 - DNA, 20 bp, Artificial
  CRISPR gRNA sequence
agctcataggagctcaattt

SEQ ID NO: 22624 - DNA, 20 bp, Artificial
  CRISPR gRNA sequence
ataggagctcaattttattg

SEQ ID NO: 22625 - DNA, 20 bp, Artificial
  CRISPR gRNA sequence
aattttattggcattgctgt

SEQ ID NO: 22626 - DNA, 20 bp, Artificial
  CRISPR gRNA sequence
tattggcattgctgttgttg

SEQ ID NO: 22627 - DNA, 20 bp, Artificial
  CRISPR gRNA sequence
attggcattgctgttgttgg

SEQ ID NO: 22628 - DNA, 20 bp, Artificial
  CRISPR gRNA sequence
ttggcattgctgttgttgga

SEQ ID NO: 22629 - DNA, 20 bp, Artificial
  CRISPR gRNA sequence
gcattgctgttgttggatgg

SEQ ID NO: 22630 - DNA, 20 bp, Artificial
  CRISPR gRNA sequence
ctgttgttggatggttaaag

SEQ ID NO: 22631 - DNA, 20 bp, Artificial
  CRISPR gRNA sequence
ttgttggatggttaaagggg

SEQ ID NO: 22632 - DNA, 20 bp, Artificial
  CRISPR gRNA sequence
ttggatggttaaaggggtgg

SEQ ID NO: 22633 - DNA, 20 bp, Artificial
  CRISPR gRNA sequence
gatggttaaaggggtggtat

SEQ ID NO: 22634 - DNA, 20 bp, Artificial
  CRISPR gRNA sequence
aaggggtggtatcccttttc

SEQ ID NO: 22635 - DNA, 20 bp, Artificial
  CRISPR gRNA sequence
ttctcagactcccctgaaat

SEQ ID NO: 22636 - DNA, 20 bp, Artificial
  CRISPR gRNA sequence
tctcagactcccctgaaatg

SEQ ID NO: 22637 - DNA, 20 bp, Artificial
  CRISPR gRNA sequence
ctcagactcccctgaaatgt

SEQ ID NO: 22638 - DNA, 20 bp, Artificial
  CRISPR gRNA sequence
tcagactcccctgaaatgta

SEQ ID NO: 22639 - DNA, 20 bp, Artificial
  CRISPR gRNA sequence
agactcccctgaaatgtatg

SEQ ID NO: 22640 - DNA, 20 bp, Artificial
  CRISPR gRNA sequence
ccctgaaatgtatggtttgc

SEQ ID NO: 22641 - DNA, 20 bp, Artificial
  CRISPR gRNA sequence
aaatgtatggtttgctttga

SEQ ID NO: 22642 - DNA, 20 bp, Artificial
  CRISPR gRNA sequence
gctttgaacccagagactga

SEQ ID NO: 22643 - DNA, 20 bp, Artificial
  CRISPR gRNA sequence
ctttgaacccagagactgat

SEQ ID NO: 22644 - DNA, 20 bp, Artificial
  CRISPR gRNA sequence
tgaacccagagactgatgac

SEQ ID NO: 22645 - DNA, 20 bp, Artificial
  CRISPR gRNA sequence
gaacccagagactgatgaca

SEQ ID NO: 22646 - DNA, 20 bp, Artificial
  CRISPR gRNA sequence
aacccagagactgatgacag

SEQ ID NO: 22647 - DNA, 20 bp, Artificial
  CRISPR gRNA sequence
atgacaggtctgccggtgtg

SEQ ID NO: 22648 - DNA, 20 bp, Artificial
  CRISPR gRNA sequence
ccggtgtggttgggtgcagc

SEQ ID NO: 22649 - DNA, 20 bp, Artificial
  CRISPR gRNA sequence
ggtgcagccttaagttgcta

SEQ ID NO: 22650 - DNA, 20 bp, Artificial
  CRISPR gRNA sequence
aagttgctacgggaaagtgt

SEQ ID NO: 22651 - DNA, 20 bp, Artificial
  CRISPR gRNA sequence
agttgctacgggaaagtgtt

SEQ ID NO: 22652 - DNA, 20 bp, Artificial
  CRISPR gRNA sequence
ctacgggaaagtgttggagg

SEQ ID NO: 22653 - DNA, 20 bp, Artificial
  CRISPR gRNA sequence
cgggaaagtgttggaggggg

SEQ ID NO: 22654 - DNA, 20 bp, Artificial
  CRISPR gRNA sequence
gagggggagaagtcagaggt

SEQ ID NO: 22655 - DNA, 20 bp, Artificial
  CRISPR gRNA sequence
gccccctccctcaattccag

SEQ ID NO: 22656 - DNA, 20 bp, Artificial
  CRISPR gRNA sequence
ccccctccctcaattccaga

SEQ ID NO: 22657 - DNA, 20 bp, Artificial
  CRISPR gRNA sequence
cctcaattccagatgaggaa

SEQ ID NO: 22658 - DNA, 20 bp, Artificial
  CRISPR gRNA sequence
aattccagatgaggaaattc

SEQ ID NO: 22659 - DNA, 20 bp, Artificial
  CRISPR gRNA sequence
cagatgaggaaattcaggcc

SEQ ID NO: 22660 - DNA, 20 bp, Artificial
  CRISPR gRNA sequence
aggcctgaaaagggaaagtg

SEQ ID NO: 22661 - DNA, 20 bp, Artificial
  CRISPR gRNA sequence
aaaagggaaagtgaccacct

SEQ ID NO: 22662 - DNA, 20 bp, Artificial
  CRISPR gRNA sequence
aaagtctcatgccttggagg

SEQ ID NO: 22663 - DNA, 20 bp, Artificial
  CRISPR gRNA sequence
atgccttggaggacccagca

SEQ ID NO: 22664 - DNA, 20 bp, Artificial
  CRISPR gRNA sequence
ggaggacccagcaggaatcc

SEQ ID NO: 22665 - DNA, 20 bp, Artificial
  CRISPR gRNA sequence
gaggacccagcaggaatcca

SEQ ID NO: 22666 - DNA, 20 bp, Artificial
  CRISPR gRNA sequence
tgaaaaggaccggcagggct

SEQ ID NO: 22667 - DNA, 20 bp, Artificial
  CRISPR gRNA sequence
aaaaggaccggcagggctct

SEQ ID NO: 22668 - DNA, 20 bp, Artificial
  CRISPR gRNA sequence
ttgccacggctgggggtgtg

SEQ ID NO: 22669 - DNA, 20 bp, Artificial
  CRISPR gRNA sequence
gccacggctgggggtgtggt

SEQ ID NO: 22670 - DNA, 20 bp, Artificial
  CRISPR gRNA sequence
ccacggctgggggtgtggtc

SEQ ID NO: 22671 - DNA, 20 bp, Artificial
  CRISPR gRNA sequence
ggggtgtggtcatggtaaca

SEQ ID NO: 22672 - DNA, 20 bp, Artificial
  CRISPR gRNA sequence
tccatccatggaaggtacct

SEQ ID NO: 22673 - DNA, 20 bp, Artificial
  CRISPR gRNA sequence
ccatccatggaaggtacctg

SEQ ID NO: 22674 - DNA, 20 bp, Artificial
  CRISPR gRNA sequence
catccatggaaggtacctga

SEQ ID NO: 22675 - DNA, 20 bp, Artificial
  CRISPR gRNA sequence
agggattttctcttcctccc

SEQ ID NO: 22676 - DNA, 20 bp, Artificial
  CRISPR gRNA sequence
tctcttcctccctagggcca

SEQ ID NO: 22677 - DNA, 20 bp, Artificial
  CRISPR gRNA sequence
ctcttcctccctagggccag

SEQ ID NO: 22678 - DNA, 20 bp, Artificial
  CRISPR gRNA sequence
tcttcctccctagggccagc

SEQ ID NO: 22679 - DNA, 20 bp, Artificial
  CRISPR gRNA sequence
ttcctccctagggccagcat

SEQ ID NO: 22680 - DNA, 20 bp, Artificial
  CRISPR gRNA sequence
cctccctagggccagcatca

SEQ ID NO: 22681 - DNA, 20 bp, Artificial
  CRISPR gRNA sequence
ctccctagggccagcatcag

SEQ ID NO: 22682 - DNA, 20 bp, Artificial
  CRISPR gRNA sequence
cctagggccagcatcagagg

SEQ ID NO: 22683 - DNA, 20 bp, Artificial
  CRISPR gRNA sequence
gggccagcatcagaggagtg

SEQ ID NO: 22684 - DNA, 20 bp, Artificial
  CRISPR gRNA sequence
agttagctcatctcaggggc

SEQ ID NO: 22685 - DNA, 20 bp, Artificial
  CRISPR gRNA sequence
gctcatctcaggggccatgt

SEQ ID NO: 22686 - DNA, 20 bp, Artificial
  CRISPR gRNA sequence
atctcaggggccatgtgccc

SEQ ID NO: 22687 - DNA, 20 bp, Artificial
  CRISPR gRNA sequence
aggggccatgtgccctcgga

SEQ ID NO: 22688 - DNA, 20 bp, Artificial
  CRISPR gRNA sequence
ggaggtggtttgccactttc

SEQ ID NO: 22689 - DNA, 20 bp, Artificial
  CRISPR gRNA sequence
gccactttcacggttggact

SEQ ID NO: 22690 - DNA, 20 bp, Artificial
  CRISPR gRNA sequence
ccactttcacggttggactg

SEQ ID NO: 22691 - DNA, 20 bp, Artificial
  CRISPR gRNA sequence
tcacggttggactgagttgg

SEQ ID NO: 22692 - DNA, 20 bp, Artificial
  CRISPR gRNA sequence
cacggttggactgagttgga

SEQ ID NO: 22693 - DNA, 20 bp, Artificial
  CRISPR gRNA sequence
acggttggactgagttggag

SEQ ID NO: 22694 - DNA, 20 bp, Artificial
  CRISPR gRNA sequence
gactgagttggagagaaaca

SEQ ID NO: 22695 - DNA, 20 bp, Artificial
  CRISPR gRNA sequence
agttggagagaaacagagac

SEQ ID NO: 22696 - DNA, 20 bp, Artificial
  CRISPR gRNA sequence
gagagaaacagagacccacc

SEQ ID NO: 22697 - DNA, 20 bp, Artificial
  CRISPR gRNA sequence
cctgcaactcaggacttgca

SEQ ID NO: 22698 - DNA, 20 bp, Artificial
  CRISPR gRNA sequence
caactcaggacttgcagatc

SEQ ID NO: 22699 - DNA, 20 bp, Artificial
  CRISPR gRNA sequence
aggacttgcagatcacttgc

SEQ ID NO: 22700 - DNA, 20 bp, Artificial
  CRISPR gRNA sequence
gcagatcacttgcccaagtg

SEQ ID NO: 22701 - DNA, 20 bp, Artificial
  CRISPR gRNA sequence
cagatcacttgcccaagtgg

SEQ ID NO: 22702 - DNA, 20 bp, Artificial
  CRISPR gRNA sequence
gcccaagtggctccctagct

SEQ ID NO: 22703 - DNA, 20 bp, Artificial
  CRISPR gRNA sequence
cccaagtggctccctagctc

SEQ ID NO: 22704 - DNA, 20 bp, Artificial
  CRISPR gRNA sequence
cctagctcctggctcctggc

SEQ ID NO: 22705 - DNA, 20 bp, Artificial
  CRISPR gRNA sequence
gctcctggctcctggcccgg

SEQ ID NO: 22706 - DNA, 20 bp, Artificial
  CRISPR gRNA sequence
ctggctcctggcccggggcc

SEQ ID NO: 22707 - DNA, 20 bp, Artificial
  CRISPR gRNA sequence
gctcctggcccggggcctgg

SEQ ID NO: 22708 - DNA, 20 bp, Artificial
  CRISPR gRNA sequence
ctggcccggggcctgggact

SEQ ID NO: 22709 - DNA, 20 bp, Artificial
  CRISPR gRNA sequence
gcccggggcctgggactctc

SEQ ID NO: 22710 - DNA, 20 bp, Artificial
  CRISPR gRNA sequence
ggactctccccgaagtgggg

SEQ ID NO: 22711 - DNA, 20 bp, Artificial
  CRISPR gRNA sequence
tccccgaagtggggctggcc

SEQ ID NO: 22712 - DNA, 20 bp, Artificial
  CRISPR gRNA sequence
cccgaagtggggctggccac

SEQ ID NO: 22713 - DNA, 20 bp, Artificial
  CRISPR gRNA sequence
gccactgtgaggaaccgact

SEQ ID NO: 22714 - DNA, 20 bp, Artificial
  CRISPR gRNA sequence
tgaggaaccgactggaggca

SEQ ID NO: 22715 - DNA, 20 bp, Artificial
  CRISPR gRNA sequence
gaggcagggacctcttggat

SEQ ID NO: 22716 - DNA, 20 bp, Artificial
  CRISPR gRNA sequence
ttggatgccccaggcagttg

SEQ ID NO: 22717 - DNA, 20 bp, Artificial
  CRISPR gRNA sequence
ggatgccccaggcagttggg

SEQ ID NO: 22718 - DNA, 20 bp, Artificial
  CRISPR gRNA sequence
gatgccccaggcagttggga

SEQ ID NO: 22719 - DNA, 20 bp, Artificial
  CRISPR gRNA sequence
ggatgccacttctgataaag

SEQ ID NO: 22720 - DNA, 20 bp, Artificial
  CRISPR gRNA sequence
ctgataaagcacgtggtggc

SEQ ID NO: 22721 - DNA, 20 bp, Artificial
  CRISPR gRNA sequence
tgataaagcacgtggtggcc

SEQ ID NO: 22722 - DNA, 20 bp, Artificial
  CRISPR gRNA sequence
ataaagcacgtggtggccac

SEQ ID NO: 22723 - DNA, 20 bp, Artificial
  CRISPR gRNA sequence
ggttgctccacagcctggcc

SEQ ID NO: 22724 - DNA, 20 bp, Artificial
  CRISPR gRNA sequence
gttgctccacagcctggccc

SEQ ID NO: 22725 - DNA, 20 bp, Artificial
  CRISPR gRNA sequence
ctccacagcctggcccgagc

SEQ ID NO: 22726 - DNA, 20 bp, Artificial
  CRISPR gRNA sequence
cacagcctggcccgagctca

SEQ ID NO: 22727 - DNA, 20 bp, Artificial
  CRISPR gRNA sequence
gcccgagctcagcgctgcag

SEQ ID NO: 22728 - DNA, 20 bp, Artificial
  CRISPR gRNA sequence
agcgctgcagaaagaaagtg

SEQ ID NO: 22729 - DNA, 20 bp, Artificial
  CRISPR gRNA sequence
cagaaagaaagtgaaaggga

SEQ ID NO: 22730 - DNA, 20 bp, Artificial
  CRISPR gRNA sequence
cggggaggcggggaggtagg

SEQ ID NO: 22731 - DNA, 20 bp, Artificial
  CRISPR gRNA sequence
ccacagacttgccgcggccc

SEQ ID NO: 22732 - DNA, 20 bp, Artificial
  CRISPR gRNA sequence
gccgcggccccagagctggc

SEQ ID NO: 22733 - DNA, 20 bp, Artificial
  CRISPR gRNA sequence
ccgcggccccagagctggcg

SEQ ID NO: 22734 - DNA, 20 bp, Artificial
  CRISPR gRNA sequence
gcgggagggagaggccacca

SEQ ID NO: 22735 - DNA, 20 bp, Artificial
  CRISPR gRNA sequence
ctctgtaacccctaaggtcg

SEQ ID NO: 22736 - DNA, 20 bp, Artificial
  CRISPR gRNA sequence
tgtaacccctaaggtcgggc

SEQ ID NO: 22737 - DNA, 20 bp, Artificial
  CRISPR gRNA sequence
taacccctaaggtcgggctg

SEQ ID NO: 22738 - DNA, 20 bp, Artificial
  CRISPR gRNA sequence
aggtcgggctgagaatcgag

SEQ ID NO: 22739 - DNA, 20 bp, Artificial
  CRISPR gRNA sequence
agaatcgaggctccgagact

SEQ ID NO: 22740 - DNA, 20 bp, Artificial
  CRISPR gRNA sequence
cgagactgtcagctacttgc

SEQ ID NO: 22741 - DNA, 20 bp, Artificial
  CRISPR gRNA sequence
tcagctacttgctcaaggtc

SEQ ID NO: 22742 - DNA, 20 bp, Artificial
  CRISPR gRNA sequence
cttgctcaaggtcacacagc

SEQ ID NO: 22743 - DNA, 20 bp, Artificial
  CRISPR gRNA sequence
gctcaaggtcacacagcaag

SEQ ID NO: 22744 - DNA, 20 bp, Artificial
  CRISPR gRNA sequence
ctcaaggtcacacagcaagt

SEQ ID NO: 22745 - DNA, 20 bp, Artificial
  CRISPR gRNA sequence
aaggtcacacagcaagtctg

SEQ ID NO: 22746 - DNA, 20 bp, Artificial
  CRISPR gRNA sequence
ggaggatggggggatggaat

SEQ ID NO: 22747 - DNA, 20 bp, Artificial
  CRISPR gRNA sequence
gtttccagcatccccgcaac

SEQ ID NO: 22748 - DNA, 20 bp, Artificial
  CRISPR gRNA sequence
ccagcatccccgcaacgact

SEQ ID NO: 22749 - DNA, 20 bp, Artificial
  CRISPR gRNA sequence
cagcatccccgcaacgactc

SEQ ID NO: 22750 - DNA, 20 bp, Artificial
  CRISPR gRNA sequence
tgcgcgggaaccaggagccg

SEQ ID NO: 22751 - DNA, 20 bp, Artificial
  CRISPR gRNA sequence
cgcgggaaccaggagccggg

SEQ ID NO: 22752 - DNA, 20 bp, Artificial
  CRISPR gRNA sequence
ggcttgctgtgcccagagct

SEQ ID NO: 22753 - DNA, 20 bp, Artificial
  CRISPR gRNA sequence
gcttgctgtgcccagagctc

SEQ ID NO: 22754 - DNA, 20 bp, Artificial
  CRISPR gRNA sequence
gctgtgcccagagctccggg

SEQ ID NO: 22755 - DNA, 20 bp, Artificial
  CRISPR gRNA sequence
ctgtgcccagagctccgggg

SEQ ID NO: 22756 - DNA, 20 bp, Artificial
  CRISPR gRNA sequence
tgcccagagctccggggccg

SEQ ID NO: 22757 - DNA, 20 bp, Artificial
  CRISPR gRNA sequence
cggggccgtgggcgggtggc

SEQ ID NO: 22758 - DNA, 20 bp, Artificial
  CRISPR gRNA sequence
gcggcagcttctgcagagaa

SEQ ID NO: 22759 - DNA, 20 bp, Artificial
  CRISPR gRNA sequence
ctgcagagaagccggagcgc

SEQ ID NO: 22760 - DNA, 20 bp, Artificial
  CRISPR gRNA sequence
tgcagagaagccggagcgca

SEQ ID NO: 22761 - DNA, 20 bp, Artificial
  CRISPR gRNA sequence
cagagaagccggagcgcaga

SEQ ID NO: 22762 - DNA, 20 bp, Artificial
  CRISPR gRNA sequence
ggagcgcggagcagacacac

SEQ ID NO: 22763 - DNA, 20 bp, Artificial
  CRISPR gRNA sequence
ccccggccacccttggccga

SEQ ID NO: 22764 - DNA, 20 bp, Artificial
  CRISPR gRNA sequence
ggccgactccgcgcgcccgg

SEQ ID NO: 22765 - DNA, 20 bp, Artificial
  CRISPR gRNA sequence
gccgactccgcgcgcccggg

SEQ ID NO: 22766 - DNA, 20 bp, Artificial
  CRISPR gRNA sequence
cgcgcgcccgggatcctgca

SEQ ID NO: 22767 - DNA, 20 bp, Artificial
  CRISPR gRNA sequence
cagaggtgcgcgcccttctt

SEQ ID NO: 22768 - DNA, 20 bp, Artificial
  CRISPR gRNA sequence
cttgtacgccagactttgga

SEQ ID NO: 22769 - DNA, 20 bp, Artificial
  CRISPR gRNA sequence
ttgtacgccagactttggac

SEQ ID NO: 22770 - DNA, 20 bp, Artificial
  CRISPR gRNA sequence
gtacgccagactttggacca

SEQ ID NO: 22771 - DNA, 20 bp, Artificial
  CRISPR gRNA sequence
tacgccagactttggaccag

SEQ ID NO: 22772 - DNA, 20 bp, Artificial
  CRISPR gRNA sequence
tggaccagggccgccgttcc

SEQ ID NO: 22773 - DNA, 20 bp, Artificial
  CRISPR gRNA sequence
ggaccagggccgccgttccc

SEQ ID NO: 22774 - DNA, 20 bp, Artificial
  CRISPR gRNA sequence
gaccagggccgccgttccct

SEQ ID NO: 22775 - DNA, 20 bp, Artificial
  CRISPR gRNA sequence
cctgagcttcactttccctg

SEQ ID NO: 22776 - DNA, 20 bp, Artificial
  CRISPR gRNA sequence
agcttcactttccctgttgg

SEQ ID NO: 22777 - DNA, 20 bp, Artificial
  CRISPR gRNA sequence
cactttccctgttgggtcat

SEQ ID NO: 22778 - DNA, 20 bp, Artificial
  CRISPR gRNA sequence
actttccctgttgggtcata

SEQ ID NO: 22779 - DNA, 20 bp, Artificial
  CRISPR gRNA sequence
tccctgttgggtcatattcc

SEQ ID NO: 22780 - DNA, 20 bp, Artificial
  CRISPR gRNA sequence
ccctgttgggtcatattcca

SEQ ID NO: 22781 - DNA, 20 bp, Artificial
  CRISPR gRNA sequence
cctgttgggtcatattccat

SEQ ID NO: 22782 - DNA, 20 bp, Artificial
  CRISPR gRNA sequence
ttgggtcatattccatctct

SEQ ID NO: 22783 - DNA, 20 bp, Artificial
  CRISPR gRNA sequence
ggtcatattccatctctaac

SEQ ID NO: 22784 - DNA, 20 bp, Artificial
  CRISPR gRNA sequence
catctctaactctggaatct

SEQ ID NO: 22785 - DNA, 20 bp, Artificial
  CRISPR gRNA sequence
taactctggaatcttgggta

SEQ ID NO: 22786 - DNA, 20 bp, Artificial
  CRISPR gRNA sequence
actctggaatcttgggtatt

SEQ ID NO: 22787 - DNA, 20 bp, Artificial
  CRISPR gRNA sequence
tggaatcttgggtattgggc

SEQ ID NO: 22788 - DNA, 20 bp, Artificial
  CRISPR gRNA sequence
gaatcttgggtattgggctc

SEQ ID NO: 22789 - DNA, 20 bp, Artificial
  CRISPR gRNA sequence
gggtattgggctctccaggc

SEQ ID NO: 22790 - DNA, 20 bp, Artificial
  CRISPR gRNA sequence
ggtattgggctctccaggcg

SEQ ID NO: 22791 - DNA, 20 bp, Artificial
  CRISPR gRNA sequence
ggctctccaggcggggggcc

SEQ ID NO: 22792 - DNA, 20 bp, Artificial
  CRISPR gRNA sequence
tccaggcggggggccctgct

SEQ ID NO: 22793 - DNA, 20 bp, Artificial
  CRISPR gRNA sequence
caggcggggggccctgctca

SEQ ID NO: 22794 - DNA, 20 bp, Artificial
  CRISPR gRNA sequence
ctcagggaggcagtagggag

SEQ ID NO: 22795 - DNA, 20 bp, Artificial
  CRISPR gRNA sequence
agggaggcagtagggagcca

SEQ ID NO: 22796 - DNA, 20 bp, Artificial
  CRISPR gRNA sequence
taaccagaggatgggataag

SEQ ID NO: 22797 - DNA, 20 bp, Artificial
  CRISPR gRNA sequence
aaccagaggatgggataagt

SEQ ID NO: 22798 - DNA, 20 bp, Artificial
  CRISPR gRNA sequence
accagaggatgggataagtc

SEQ ID NO: 22799 - DNA, 20 bp, Artificial
  CRISPR gRNA sequence
aactctcgttgaacatcttg

SEQ ID NO: 22800 - DNA, 20 bp, Artificial
  CRISPR gRNA sequence
tcgttgaacatcttggcgaa

SEQ ID NO: 22801 - DNA, 20 bp, Artificial
  CRISPR gRNA sequence
gttgaacatcttggcgaagg

SEQ ID NO: 22802 - DNA, 20 bp, Artificial
  CRISPR gRNA sequence
aacatcttggcgaaggtgtg

SEQ ID NO: 22803 - DNA, 20 bp, Artificial
  CRISPR gRNA sequence
ggcgaaggtgtgtgttgttg

SEQ ID NO: 22804 - DNA, 20 bp, Artificial
  CRISPR gRNA sequence
gcgaaggtgtgtgttgttgg

SEQ ID NO: 22805 - DNA, 20 bp, Artificial
  CRISPR gRNA sequence
ttgggaggggtgggggaggg

SEQ ID NO: 22806 - DNA, 20 bp, Artificial
  CRISPR gRNA sequence
ggaggggtgggggagggatc

SEQ ID NO: 22807 - DNA, 20 bp, Artificial
  CRISPR gRNA sequence
aaccgatctcttgatctctc

SEQ ID NO: 22808 - DNA, 20 bp, Artificial
  CRISPR gRNA sequence
ttgatctctcacttctctac

SEQ ID NO: 22809 - DNA, 20 bp, Artificial
  CRISPR gRNA sequence
gatctctcacttctctacct

SEQ ID NO: 22810 - DNA, 20 bp, Artificial
  CRISPR gRNA sequence
atctctcacttctctacctc

SEQ ID NO: 22811 - DNA, 20 bp, Artificial
  CRISPR gRNA sequence
tcacttctctacctcgcttt

SEQ ID NO: 22812 - DNA, 20 bp, Artificial
  CRISPR gRNA sequence
acttctctacctcgctttgg

SEQ ID NO: 22813 - DNA, 20 bp, Artificial
  CRISPR gRNA sequence
ctctacctcgctttggggcc

SEQ ID NO: 22814 - DNA, 20 bp, Artificial
  CRISPR gRNA sequence
tctacctcgctttggggccc

SEQ ID NO: 22815 - DNA, 20 bp, Artificial
  CRISPR gRNA sequence
tacctcgctttggggccctg

SEQ ID NO: 22816 - DNA, 20 bp, Artificial
  CRISPR gRNA sequence
cctcgctttggggccctgag

SEQ ID NO: 22817 - DNA, 20 bp, Artificial
  CRISPR gRNA sequence
gctttggggccctgagtcac

SEQ ID NO: 22818 - DNA, 20 bp, Artificial
  CRISPR gRNA sequence
tggggccctgagtcacaccc

SEQ ID NO: 22819 - DNA, 20 bp, Artificial
  CRISPR gRNA sequence
ggggccctgagtcacaccct

SEQ ID NO: 22820 - DNA, 20 bp, Artificial
  CRISPR gRNA sequence
gggccctgagtcacaccctc

SEQ ID NO: 22821 - DNA, 20 bp, Artificial
  CRISPR gRNA sequence
agtcacaccctctaaggaga

SEQ ID NO: 22822 - DNA, 20 bp, Artificial
  CRISPR gRNA sequence
taaggagagaggctaaagcg

SEQ ID NO: 22823 - DNA, 20 bp, Artificial
  CRISPR gRNA sequence
aggagagaggctaaagcgcc

SEQ ID NO: 22824 - DNA, 20 bp, Artificial
  CRISPR gRNA sequence
aagcgccccggaaagccagc

SEQ ID NO: 22825 - DNA, 20 bp, Artificial
  CRISPR gRNA sequence
gatctccctggggtccagga

SEQ ID NO: 22826 - DNA, 20 bp, Artificial
  CRISPR gRNA sequence
cctggggtccaggaaagccg

SEQ ID NO: 22827 - DNA, 20 bp, Artificial
  CRISPR gRNA sequence
gggtccaggaaagccggaat

SEQ ID NO: 22828 - DNA, 20 bp, Artificial
  CRISPR gRNA sequence
agcttagtctggaactctta

SEQ ID NO: 22829 - DNA, 20 bp, Artificial
  CRISPR gRNA sequence
gcttagtctggaactcttaa

SEQ ID NO: 22830 - DNA, 20 bp, Artificial
  CRISPR gRNA sequence
agtctggaactcttaaaagc

SEQ ID NO: 22831 - DNA, 20 bp, Artificial
  CRISPR gRNA sequence
gtctggaactcttaaaagcc

SEQ ID NO: 22832 - DNA, 20 bp, Artificial
  CRISPR gRNA sequence
gaactcttaaaagccgcggt

SEQ ID NO: 22833 - DNA, 20 bp, Artificial
  CRISPR gRNA sequence
ttaaaagccgcggtcctcct

SEQ ID NO: 22834 - DNA, 20 bp, Artificial
  CRISPR gRNA sequence
aaaagccgcggtcctcctga

SEQ ID NO: 22835 - DNA, 20 bp, Artificial
  CRISPR gRNA sequence
aaagccgcggtcctcctgag

SEQ ID NO: 22836 - DNA, 20 bp, Artificial
  CRISPR gRNA sequence
ctgagtcccacagcccctct

SEQ ID NO: 22837 - DNA, 20 bp, Artificial
  CRISPR gRNA sequence
agtcccacagcccctctcca

SEQ ID NO: 22838 - DNA, 20 bp, Artificial
  CRISPR gRNA sequence
tccaccctaggtggcacagg

SEQ ID NO: 22839 - DNA, 20 bp, Artificial
  CRISPR gRNA sequence
caccctaggtggcacaggag

SEQ ID NO: 22840 - DNA, 20 bp, Artificial
  CRISPR gRNA sequence
ggtggcacaggagaggtggc

SEQ ID NO: 22841 - DNA, 20 bp, Artificial
  CRISPR gRNA sequence
gaagttcaaggcatggctcc

SEQ ID NO: 22842 - DNA, 20 bp, Artificial
  CRISPR gRNA sequence
aaggcatggctccctcccca

SEQ ID NO: 22843 - DNA, 20 bp, Artificial
  CRISPR gRNA sequence
cctccccagccgcagcctgg

SEQ ID NO: 22844 - DNA, 20 bp, Artificial
  CRISPR gRNA sequence
cccagccgcagcctggagtg

SEQ ID NO: 22845 - DNA, 20 bp, Artificial
  CRISPR gRNA sequence
gagtgtctaactttggcagg

SEQ ID NO: 22846 - DNA, 20 bp, Artificial
  CRISPR gRNA sequence
actttggcaggaagtcttcc

SEQ ID NO: 22847 - DNA, 20 bp, Artificial
  CRISPR gRNA sequence
tggcaggaagtcttccgttt

SEQ ID NO: 22848 - DNA, 20 bp, Artificial
  CRISPR gRNA sequence
ggcaggaagtcttccgtttc

SEQ ID NO: 22849 - DNA, 20 bp, Artificial
  CRISPR gRNA sequence
gcaggaagtcttccgtttct

SEQ ID NO: 22850 - DNA, 20 bp, Artificial
  CRISPR gRNA sequence
ccgtttctgctccccactcc

SEQ ID NO: 22851 - DNA, 20 bp, Artificial
  CRISPR gRNA sequence
cgtttctgctccccactcca

SEQ ID NO: 22852 - DNA, 20 bp, Artificial
  CRISPR gRNA sequence
ctgctccccactccagagaa

SEQ ID NO: 22853 - DNA, 20 bp, Artificial
  CRISPR gRNA sequence
tgctccccactccagagaaa

SEQ ID NO: 22854 - DNA, 20 bp, Artificial
  CRISPR gRNA sequence
ctccccactccagagaaaaa

SEQ ID NO: 22855 - DNA, 20 bp, Artificial
  CRISPR gRNA sequence
cccactccagagaaaaaata

SEQ ID NO: 22856 - DNA, 20 bp, Artificial
  CRISPR gRNA sequence
cagagaaaaaataaataaat

SEQ ID NO: 22857 - DNA, 20 bp, Artificial
  CRISPR gRNA sequence
ctccggagtgagattaagga

SEQ ID NO: 22858 - DNA, 20 bp, Artificial
  CRISPR gRNA sequence
tccggagtgagattaaggaa

SEQ ID NO: 22859 - DNA, 20 bp, Artificial
  CRISPR gRNA sequence
cggagtgagattaaggaaac

SEQ ID NO: 22860 - DNA, 20 bp, Artificial
  CRISPR gRNA sequence
aggaaacaggtacttcttcc

SEQ ID NO: 22861 - DNA, 20 bp, Artificial
  CRISPR gRNA sequence
cttcctcttggagaaagagg

SEQ ID NO: 22862 - DNA, 20 bp, Artificial
  CRISPR gRNA sequence
ttcctcttggagaaagagga

SEQ ID NO: 22863 - DNA, 20 bp, Artificial
  CRISPR gRNA sequence
cctcttggagaaagaggagc

SEQ ID NO: 22864 - DNA, 20 bp, Artificial
  CRISPR gRNA sequence
ctcttggagaaagaggagcc

SEQ ID NO: 22865 - DNA, 20 bp, Artificial
  CRISPR gRNA sequence
ttggagaaagaggagccaaa

SEQ ID NO: 22866 - DNA, 20 bp, Artificial
  CRISPR gRNA sequence
ggagaaagaggagccaaagg

SEQ ID NO: 22867 - DNA, 20 bp, Artificial
  CRISPR gRNA sequence
gagaaagaggagccaaagga

SEQ ID NO: 22868 - DNA, 20 bp, Artificial
  CRISPR gRNA sequence
gactccaacaaatgatcacc

SEQ ID NO: 22869 - DNA, 20 bp, Artificial
  CRISPR gRNA sequence
actccaacaaatgatcacct

SEQ ID NO: 22870 - DNA, 20 bp, Artificial
  CRISPR gRNA sequence
caacaaatgatcaccttgca

SEQ ID NO: 22871 - DNA, 20 bp, Artificial
  CRISPR gRNA sequence
gcaaacccccggctccctta

SEQ ID NO: 22872 - DNA, 20 bp, Artificial
  CRISPR gRNA sequence
caaacccccggctcccttag

SEQ ID NO: 22873 - DNA, 20 bp, Artificial
  CRISPR gRNA sequence
ccttaggggatgacctggtc

SEQ ID NO: 22874 - DNA, 20 bp, Artificial
  CRISPR gRNA sequence
aggggatgacctggtctcca

SEQ ID NO: 22875 - DNA, 20 bp, Artificial
  CRISPR gRNA sequence
ggggatgacctggtctccaa

SEQ ID NO: 22876 - DNA, 20 bp, Artificial
  CRISPR gRNA sequence
gtctccaacaatctcagagc

SEQ ID NO: 22877 - DNA, 20 bp, Artificial
  CRISPR gRNA sequence
caacaatctcagagcgtttg

SEQ ID NO: 22878 - DNA, 20 bp, Artificial
  CRISPR gRNA sequence
agagcgtttggaggcagggt

SEQ ID NO: 22879 - DNA, 20 bp, Artificial
  CRISPR gRNA sequence
ggaggcagggtctttggaga

SEQ ID NO: 22880 - DNA, 20 bp, Artificial
  CRISPR gRNA sequence
gaggcagggtctttggagat

SEQ ID NO: 22881 - DNA, 20 bp, Artificial
  CRISPR gRNA sequence
tggagatgactgagtgggga

SEQ ID NO: 22882 - DNA, 20 bp, Artificial
  CRISPR gRNA sequence
ggagatgactgagtggggaa

SEQ ID NO: 22883 - DNA, 20 bp, Artificial
  CRISPR gRNA sequence
gagatgactgagtggggaat

SEQ ID NO: 22884 - DNA, 20 bp, Artificial
  CRISPR gRNA sequence
agtggggaatcccaggctcc

SEQ ID NO: 22885 - DNA, 20 bp, Artificial
  CRISPR gRNA sequence
cccacacatgaacatcacct

SEQ ID NO: 22886 - DNA, 20 bp, Artificial
  CRISPR gRNA sequence
ggatgatcaacctgttcagg

SEQ ID NO: 22887 - DNA, 20 bp, Artificial
  CRISPR gRNA sequence
ttcaggatgtaggttcccgg

SEQ ID NO: 22888 - DNA, 20 bp, Artificial
  CRISPR gRNA sequence
aggatgtaggttcccgggct

SEQ ID NO: 22889 - DNA, 20 bp, Artificial
  CRISPR gRNA sequence
ccgggctcacccccaggccc

SEQ ID NO: 22890 - DNA, 20 bp, Artificial
  CRISPR gRNA sequence
acccccaggcccggttggct

SEQ ID NO: 22891 - DNA, 20 bp, Artificial
  CRISPR gRNA sequence
gctaggcctggggtgaggct

SEQ ID NO: 22892 - DNA, 20 bp, Artificial
  CRISPR gRNA sequence
ggcctggggtgaggctgaga

SEQ ID NO: 22893 - DNA, 20 bp, Artificial
  CRISPR gRNA sequence
gggtgaggctgagatcctgc

SEQ ID NO: 22894 - DNA, 20 bp, Artificial
  CRISPR gRNA sequence
agatcctgcaggttaaacca

SEQ ID NO: 22895 - DNA, 20 bp, Artificial
  CRISPR gRNA sequence
caggttaaaccatctatccc

SEQ ID NO: 22896 - DNA, 20 bp, Artificial
  CRISPR gRNA sequence
aaccatctatcccaggtgac

SEQ ID NO: 22897 - DNA, 20 bp, Artificial
  CRISPR gRNA sequence
tcccaggtgactccaatgtt

SEQ ID NO: 22898 - DNA, 20 bp, Artificial
  CRISPR gRNA sequence
caatgttcgtttgtggggca

SEQ ID NO: 22899 - DNA, 20 bp, Artificial
  CRISPR gRNA sequence
gtttgtggggcaaaagtccc

SEQ ID NO: 22900 - DNA, 20 bp, Artificial
  CRISPR gRNA sequence
gtggggcaaaagtccctcaa

SEQ ID NO: 22901 - DNA, 20 bp, Artificial
  CRISPR gRNA sequence
tggggcaaaagtccctcaag

SEQ ID NO: 22902 - DNA, 20 bp, Artificial
  CRISPR gRNA sequence
aagtcagagacactgggagg

SEQ ID NO: 22903 - DNA, 20 bp, Artificial
  CRISPR gRNA sequence
ggaggcgctgatgtggtctc

SEQ ID NO: 22904 - DNA, 20 bp, Artificial
  CRISPR gRNA sequence
atgtggtctcatctctttac

SEQ ID NO: 22905 - DNA, 20 bp, Artificial
  CRISPR gRNA sequence
atctctttactctctccctg

SEQ ID NO: 22906 - DNA, 20 bp, Artificial
  CRISPR gRNA sequence
tttactctctccctgttaca

SEQ ID NO: 22907 - DNA, 20 bp, Artificial
  CRISPR gRNA sequence
tactctctccctgttacaaa

SEQ ID NO: 22908 - DNA, 20 bp, Artificial
  CRISPR gRNA sequence
actctctccctgttacaaaa

SEQ ID NO: 22909 - DNA, 20 bp, Artificial
  CRISPR gRNA sequence
ctctctccctgttacaaaac

SEQ ID NO: 22910 - DNA, 20 bp, Artificial
  CRISPR gRNA sequence
tctccctgttacaaaacctc

SEQ ID NO: 22911 - DNA, 20 bp, Artificial
  CRISPR gRNA sequence
tccctgttacaaaacctcta

SEQ ID NO: 22912 - DNA, 20 bp, Artificial
  CRISPR gRNA sequence
cctgttacaaaacctctatc

SEQ ID NO: 22913 - DNA, 20 bp, Artificial
  CRISPR gRNA sequence
ttacaaaacctctatcagaa

SEQ ID NO: 22914 - DNA, 20 bp, Artificial
  CRISPR gRNA sequence
caaaacctctatcagaaaag

SEQ ID NO: 22915 - DNA, 20 bp, Artificial
  CRISPR gRNA sequence
tatcagaaaaggagtaccag

SEQ ID NO: 22916 - DNA, 20 bp, Artificial
  CRISPR gRNA sequence
tcagaaaaggagtaccagga

SEQ ID NO: 22917 - DNA, 20 bp, Artificial
  CRISPR gRNA sequence
tgttttgttttgcttaacgc

SEQ ID NO: 22918 - DNA, 20 bp, Artificial
  CRISPR gRNA sequence
gttttgttttgcttaacgcc

SEQ ID NO: 22919 - DNA, 20 bp, Artificial
  CRISPR gRNA sequence
ttttgttttgcttaacgcca

SEQ ID NO: 22920 - DNA, 20 bp, Artificial
  CRISPR gRNA sequence
tgttttgcttaacgccacat

SEQ ID NO: 22921 - DNA, 20 bp, Artificial
  CRISPR gRNA sequence
gttttgcttaacgccacata

SEQ ID NO: 22922 - DNA, 20 bp, Artificial
  CRISPR gRNA sequence
ttttgcttaacgccacatag

SEQ ID NO: 22923 - DNA, 20 bp, Artificial
  CRISPR gRNA sequence
tgcttaacgccacatagcaa

SEQ ID NO: 22924 - DNA, 20 bp, Artificial
  CRISPR gRNA sequence
gcttaacgccacatagcaag

SEQ ID NO: 22925 - DNA, 20 bp, Artificial
  CRISPR gRNA sequence
cttaacgccacatagcaagc

SEQ ID NO: 22926 - DNA, 20 bp, Artificial
  CRISPR gRNA sequence
aacgccacatagcaagcagt

SEQ ID NO: 22927 - DNA, 20 bp, Artificial
  CRISPR gRNA sequence
acgccacatagcaagcagtt

SEQ ID NO: 22928 - DNA, 20 bp, Artificial
  CRISPR gRNA sequence
gcagacgcaggatttgaacc

SEQ ID NO: 22929 - DNA, 20 bp, Artificial
  CRISPR gRNA sequence
cagacgcaggatttgaaccc

SEQ ID NO: 22930 - DNA, 20 bp, Artificial
  CRISPR gRNA sequence
gaaccctggtctactgagag

SEQ ID NO: 22931 - DNA, 20 bp, Artificial
  CRISPR gRNA sequence
aaccctggtctactgagagc

SEQ ID NO: 22932 - DNA, 20 bp, Artificial
  CRISPR gRNA sequence
gtctactgagagcccagccc

SEQ ID NO: 22933 - DNA, 20 bp, Artificial
  CRISPR gRNA sequence
ctgagagcccagcccagtgc

SEQ ID NO: 22934 - DNA, 20 bp, Artificial
  CRISPR gRNA sequence
agagcccagcccagtgcagc

SEQ ID NO: 22935 - DNA, 20 bp, Artificial
  CRISPR gRNA sequence
cacaaatgcagggcaggtcc

SEQ ID NO: 22936 - DNA, 20 bp, Artificial
  CRISPR gRNA sequence
ttgatacccagtctgtctga

SEQ ID NO: 22937 - DNA, 20 bp, Artificial
  CRISPR gRNA sequence
atacccagtctgtctgatgg

SEQ ID NO: 22938 - DNA, 20 bp, Artificial
  CRISPR gRNA sequence
tctgatggctggggcttggt

SEQ ID NO: 22939 - DNA, 20 bp, Artificial
  CRISPR gRNA sequence
atggctggggcttggtttca

SEQ ID NO: 22940 - DNA, 20 bp, Artificial
  CRISPR gRNA sequence
gggcttggtttcatgtccta

SEQ ID NO: 22941 - DNA, 20 bp, Artificial
  CRISPR gRNA sequence
ggtttcatgtcctaagaccc

SEQ ID NO: 22942 - DNA, 20 bp, Artificial
  CRISPR gRNA sequence
gtttcatgtcctaagaccca

SEQ ID NO: 22943 - DNA, 20 bp, Artificial
  CRISPR gRNA sequence
catgtcctaagacccagcct

SEQ ID NO: 22944 - DNA, 20 bp, Artificial
  CRISPR gRNA sequence
atgtcctaagacccagcctc

SEQ ID NO: 22945 - DNA, 20 bp, Artificial
  CRISPR gRNA sequence
agacccagcctcagatacct

SEQ ID NO: 22946 - DNA, 20 bp, Artificial
  CRISPR gRNA sequence
agataccttgagaagagcag

SEQ ID NO: 22947 - DNA, 20 bp, Artificial
  CRISPR gRNA sequence
gagaagagcagaatcagaaa

SEQ ID NO: 22948 - DNA, 20 bp, Artificial
  CRISPR gRNA sequence
agaagagcagaatcagaaat

SEQ ID NO: 22949 - DNA, 20 bp, Artificial
  CRISPR gRNA sequence
acccaaggaaactctggatt

SEQ ID NO: 22950 - DNA, 20 bp, Artificial
  CRISPR gRNA sequence
tggattagttccaggcaatc

SEQ ID NO: 22951 - DNA, 20 bp, Artificial
  CRISPR gRNA sequence
gattagttccaggcaatcag

SEQ ID NO: 22952 - DNA, 20 bp, Artificial
  CRISPR gRNA sequence
gttccaggcaatcagggaag

SEQ ID NO: 22953 - DNA, 20 bp, Artificial
  CRISPR gRNA sequence
caggcaatcagggaagtggc

SEQ ID NO: 22954 - DNA, 20 bp, Artificial
  CRISPR gRNA sequence
gagggaggtaggaaacttct

SEQ ID NO: 22955 - DNA, 20 bp, Artificial
  CRISPR gRNA sequence
ctggacttagcctcagattt

SEQ ID NO: 22956 - DNA, 20 bp, Artificial
  CRISPR gRNA sequence
tggacttagcctcagatttg

SEQ ID NO: 22957 - DNA, 20 bp, Artificial
  CRISPR gRNA sequence
gacttagcctcagatttgcc

SEQ ID NO: 22958 - DNA, 20 bp, Artificial
  CRISPR gRNA sequence
agcctcagatttgccttgag

SEQ ID NO: 22959 - DNA, 20 bp, Artificial
  CRISPR gRNA sequence
gcctcagatttgccttgagt

SEQ ID NO: 22960 - DNA, 20 bp, Artificial
  CRISPR gRNA sequence
agatttgccttgagtcacac

SEQ ID NO: 22961 - DNA, 20 bp, Artificial
  CRISPR gRNA sequence
gccttgagtcacactgacaa

SEQ ID NO: 22962 - DNA, 20 bp, Artificial
  CRISPR gRNA sequence
ccttgagtcacactgacaag

SEQ ID NO: 22963 - DNA, 20 bp, Artificial
  CRISPR gRNA sequence
gagtcacactgacaagtgac

SEQ ID NO: 22964 - DNA, 20 bp, Artificial
  CRISPR gRNA sequence
agtcacactgacaagtgact

SEQ ID NO: 22965 - DNA, 20 bp, Artificial
  CRISPR gRNA sequence
acaagtgacttcccctctct

SEQ ID NO: 22966 - DNA, 20 bp, Artificial
  CRISPR gRNA sequence
cccctctctgaggttcatct

SEQ ID NO: 22967 - DNA, 20 bp, Artificial
  CRISPR gRNA sequence
ccctctctgaggttcatctg

SEQ ID NO: 22968 - DNA, 20 bp, Artificial
  CRISPR gRNA sequence
tctgaggttcatctgtaaaa

SEQ ID NO: 22969 - DNA, 20 bp, Artificial
  CRISPR gRNA sequence
tgaggttcatctgtaaaatg

SEQ ID NO: 22970 - DNA, 20 bp, Artificial
  CRISPR gRNA sequence
aggttcatctgtaaaatgga

SEQ ID NO: 22971 - DNA, 20 bp, Artificial
  CRISPR gRNA sequence
atctgtaaaatggataaaac

SEQ ID NO: 22972 - DNA, 20 bp, Artificial
  CRISPR gRNA sequence
taaaatggataaaacatgag

SEQ ID NO: 22973 - DNA, 20 bp, Artificial
  CRISPR gRNA sequence
gcttgatgatgtctgatgtg

SEQ ID NO: 22974 - DNA, 20 bp, Artificial
  CRISPR gRNA sequence
cttgatgatgtctgatgtgt

SEQ ID NO: 22975 - DNA, 20 bp, Artificial
  CRISPR gRNA sequence
gatgatgtctgatgtgtaca

SEQ ID NO: 22976 - DNA, 20 bp, Artificial
  CRISPR gRNA sequence
atgatgtctgatgtgtacag

SEQ ID NO: 22977 - DNA, 20 bp, Artificial
  CRISPR gRNA sequence
atgtgtacagaaaaagcact

SEQ ID NO: 22978 - DNA, 20 bp, Artificial
  CRISPR gRNA sequence
tagaaaaccaccaaagaata

SEQ ID NO: 22979 - DNA, 20 bp, Artificial
  CRISPR gRNA sequence
agaaaaccaccaaagaatat

SEQ ID NO: 22980 - DNA, 20 bp, Artificial
  CRISPR gRNA sequence
gaaaaccaccaaagaatatt

SEQ ID NO: 22981 - DNA, 20 bp, Artificial
  CRISPR gRNA sequence
atgcattgggaataattatt

SEQ ID NO: 22982 - DNA, 20 bp, Artificial
  CRISPR gRNA sequence
ggaataattattatagatcc

SEQ ID NO: 22983 - DNA, 20 bp, Artificial
  CRISPR gRNA sequence
ttatagatcctaaagggatt

SEQ ID NO: 22984 - DNA, 20 bp, Artificial
  CRISPR gRNA sequence
tagatcctaaagggattgtt

SEQ ID NO: 22985 - DNA, 20 bp, Artificial
  CRISPR gRNA sequence
aagggattgtttagaaagat

SEQ ID NO: 22986 - DNA, 20 bp, Artificial
  CRISPR gRNA sequence
tttagaaagatcagagaggg

SEQ ID NO: 22987 - DNA, 20 bp, Artificial
  CRISPR gRNA sequence
agaaagatcagagaggggcc

SEQ ID NO: 22988 - DNA, 20 bp, Artificial
  CRISPR gRNA sequence
gaaagatcagagaggggccg

SEQ ID NO: 22989 - DNA, 20 bp, Artificial
  CRISPR gRNA sequence
acacctgtaatcctagcact

SEQ ID NO: 22990 - DNA, 20 bp, Artificial
  CRISPR gRNA sequence
taatcctagcactttgggag

SEQ ID NO: 22991 - DNA, 20 bp, Artificial
  CRISPR gRNA sequence
gcactttgggaggccgaggc

SEQ ID NO: 22992 - DNA, 20 bp, Artificial
  CRISPR gRNA sequence
tgggaggccgaggcgggtgg

SEQ ID NO: 22993 - DNA, 20 bp, Artificial
  CRISPR gRNA sequence
gggaggccgaggcgggtgga

SEQ ID NO: 22994 - DNA, 20 bp, Artificial
  CRISPR gRNA sequence
ggaggccgaggcgggtggat

SEQ ID NO: 22995 - DNA, 20 bp, Artificial
  CRISPR gRNA sequence
cttgaggccaggagttcaag

SEQ ID NO: 22996 - DNA, 20 bp, Artificial
  CRISPR gRNA sequence
gaggccaggagttcaagacc

SEQ ID NO: 22997 - DNA, 20 bp, Artificial
  CRISPR gRNA sequence
aggccaggagttcaagacca

SEQ ID NO: 22998 - DNA, 20 bp, Artificial
  CRISPR gRNA sequence
aagaccagcctgggcaacct

SEQ ID NO: 22999 - DNA, 20 bp, Artificial
  CRISPR gRNA sequence
ggcaacctggagaaacccca

SEQ ID NO: 23000 - DNA, 20 bp, Artificial
  CRISPR gRNA sequence
gagaaaccccaactctacta

SEQ ID NO: 23001 - DNA, 20 bp, Artificial
  CRISPR gRNA sequence
tactaaaacacttttttgtg

SEQ ID NO: 23002 - DNA, 20 bp, Artificial
  CRISPR gRNA sequence
ctaaaacacttttttgtgtt

SEQ ID NO: 23003 - DNA, 20 bp, Artificial
  CRISPR gRNA sequence
aaacacttttttgtgtttta

SEQ ID NO: 23004 - DNA, 20 bp, Artificial
  CRISPR gRNA sequence
ttttgtgttttagccgggca

SEQ ID NO: 23005 - DNA, 20 bp, Artificial
  CRISPR gRNA sequence
tttgtgttttagccgggcat

SEQ ID NO: 23006 - DNA, 20 bp, Artificial
  CRISPR gRNA sequence
ttgtgttttagccgggcatg

SEQ ID NO: 23007 - DNA, 20 bp, Artificial
  CRISPR gRNA sequence
tgtgttttagccgggcatgg

SEQ ID NO: 23008 - DNA, 20 bp, Artificial
  CRISPR gRNA sequence
gtgttttagccgggcatggt

SEQ ID NO: 23009 - DNA, 20 bp, Artificial
  CRISPR gRNA sequence
tgttttagccgggcatggtg

SEQ ID NO: 23010 - DNA, 20 bp, Artificial
  CRISPR gRNA sequence
tagccgggcatggtggtgca

SEQ ID NO: 23011 - DNA, 20 bp, Artificial
  CRISPR gRNA sequence
agccgggcatggtggtgcac

SEQ ID NO: 23012 - DNA, 20 bp, Artificial
  CRISPR gRNA sequence
gccgggcatggtggtgcaca

SEQ ID NO: 23013 - DNA, 20 bp, Artificial
  CRISPR gRNA sequence
taatctcaactacttgggag

SEQ ID NO: 23014 - DNA, 20 bp, Artificial
  CRISPR gRNA sequence
aactacttgggaggctgagg

SEQ ID NO: 23015 - DNA, 20 bp, Artificial
  CRISPR gRNA sequence
cttgggaggctgaggcacga

SEQ ID NO: 23016 - DNA, 20 bp, Artificial
  CRISPR gRNA sequence
gggaggctgaggcacgagaa

SEQ ID NO: 23017 - DNA, 20 bp, Artificial
  CRISPR gRNA sequence
ggaggctgaggcacgagaat

SEQ ID NO: 23018 - DNA, 20 bp, Artificial
  CRISPR gRNA sequence
aggcacgagaatcacttgaa

SEQ ID NO: 23019 - DNA, 20 bp, Artificial
  CRISPR gRNA sequence
gaacccaagaggcggagttt

SEQ ID NO: 23020 - DNA, 20 bp, Artificial
  CRISPR gRNA sequence
aacccaagaggcggagttta

SEQ ID NO: 23021 - DNA, 20 bp, Artificial
  CRISPR gRNA sequence
acccgagaggtggaggttac

SEQ ID NO: 23022 - DNA, 20 bp, Artificial
  CRISPR gRNA sequence
cccgagaggtggaggttacc

SEQ ID NO: 23023 - DNA, 20 bp, Artificial
  CRISPR gRNA sequence
cccgagagctgagattgcac

SEQ ID NO: 23024 - DNA, 20 bp, Artificial
  CRISPR gRNA sequence
agattgcaccactgcacgcc

SEQ ID NO: 23025 - DNA, 20 bp, Artificial
  CRISPR gRNA sequence
caccactgcacgccagcctg

SEQ ID NO: 23026 - DNA, 20 bp, Artificial
  CRISPR gRNA sequence
cacgccagcctgggcaacag

SEQ ID NO: 23027 - DNA, 20 bp, Artificial
  CRISPR gRNA sequence
ggcaacagagcaagactgtc

SEQ ID NO: 23028 - DNA, 20 bp, Artificial
  CRISPR gRNA sequence
tctcaggaaaaaaaaaagag

SEQ ID NO: 23029 - DNA, 20 bp, Artificial
  CRISPR gRNA sequence
aggaaaaaaaaaagagagag

SEQ ID NO: 23030 - DNA, 20 bp, Artificial
  CRISPR gRNA sequence
ccaaagaccaagacacacac

SEQ ID NO: 23031 - DNA, 20 bp, Artificial
  CRISPR gRNA sequence
caaagaccaagacacacaca

SEQ ID NO: 23032 - DNA, 20 bp, Artificial
  CRISPR gRNA sequence
agaaaggggcattagttacc

SEQ ID NO: 23033 - DNA, 20 bp, Artificial
  CRISPR gRNA sequence
gttaccaccgattctcatag

SEQ ID NO: 23034 - DNA, 20 bp, Artificial
  CRISPR gRNA sequence
ccaccgattctcataggaag

SEQ ID NO: 23035 - DNA, 20 bp, Artificial
  CRISPR gRNA sequence
tcataggaaggacatagata

SEQ ID NO: 23036 - DNA, 20 bp, Artificial
  CRISPR gRNA sequence
ataggaaggacatagatagt

SEQ ID NO: 23037 - DNA, 20 bp, Artificial
  CRISPR gRNA sequence
tcagattccttcaatccttc

SEQ ID NO: 23038 - DNA, 20 bp, Artificial
  CRISPR gRNA sequence
cagattccttcaatccttct

SEQ ID NO: 23039 - DNA, 20 bp, Artificial
  CRISPR gRNA sequence
agattccttcaatccttctg

SEQ ID NO: 23040 - DNA, 20 bp, Artificial
  CRISPR gRNA sequence
cttcaatccttctgacatca

SEQ ID NO: 23041 - DNA, 20 bp, Artificial
  CRISPR gRNA sequence
caatccttctgacatcaagg

SEQ ID NO: 23042 - DNA, 20 bp, Artificial
  CRISPR gRNA sequence
aatccttctgacatcaagga

SEQ ID NO: 23043 - DNA, 20 bp, Artificial
  CRISPR gRNA sequence
ctgacatcaaggacaaagtc

SEQ ID NO: 23044 - DNA, 20 bp, Artificial
  CRISPR gRNA sequence
tgacatcaaggacaaagtct

SEQ ID NO: 23045 - DNA, 20 bp, Artificial
  CRISPR gRNA sequence
acatcaaggacaaagtctct

SEQ ID NO: 23046 - DNA, 20 bp, Artificial
  CRISPR gRNA sequence
tgattttccctgatgtttga

SEQ ID NO: 23047 - DNA, 20 bp, Artificial
  CRISPR gRNA sequence
attttccctgatgtttgaca

SEQ ID NO: 23048 - DNA, 20 bp, Artificial
  CRISPR gRNA sequence
tccctgatgtttgacagtgc

SEQ ID NO: 23049 - DNA, 20 bp, Artificial
  CRISPR gRNA sequence
ccctgatgtttgacagtgcc

SEQ ID NO: 23050 - DNA, 20 bp, Artificial
  CRISPR gRNA sequence
cctgatgtttgacagtgccc

SEQ ID NO: 23051 - DNA, 20 bp, Artificial
  CRISPR gRNA sequence
atgtttgacagtgccctaat

SEQ ID NO: 23052 - DNA, 20 bp, Artificial
  CRISPR gRNA sequence
gacagtgccctaatgcttgc

SEQ ID NO: 23053 - DNA, 20 bp, Artificial
  CRISPR gRNA sequence
acagtgccctaatgcttgct

SEQ ID NO: 23054 - DNA, 20 bp, Artificial
  CRISPR gRNA sequence
atgcttgctaagatttcttt

SEQ ID NO: 23055 - DNA, 20 bp, Artificial
  CRISPR gRNA sequence
gctaagatttctttttaaca

SEQ ID NO: 23056 - DNA, 20 bp, Artificial
  CRISPR gRNA sequence
ctaagatttctttttaacaa

SEQ ID NO: 23057 - DNA, 20 bp, Artificial
  CRISPR gRNA sequence
agatttctttttaacaaagt

SEQ ID NO: 23058 - DNA, 20 bp, Artificial
  CRISPR gRNA sequence
ctttttaacaaagtggtaaa

SEQ ID NO: 23059 - DNA, 20 bp, Artificial
  CRISPR gRNA sequence
tttttaacaaagtggtaaag

SEQ ID NO: 23060 - DNA, 20 bp, Artificial
  CRISPR gRNA sequence
tttaacaaagtggtaaagaa

SEQ ID NO: 23061 - DNA, 20 bp, Artificial
  CRISPR gRNA sequence
ttaacaaagtggtaaagaag

SEQ ID NO: 23062 - DNA, 20 bp, Artificial
  CRISPR gRNA sequence
taacaaagtggtaaagaagc

SEQ ID NO: 23063 - DNA, 20 bp, Artificial
  CRISPR gRNA sequence
aacaaagtggtaaagaagct

SEQ ID NO: 23064 - DNA, 20 bp, Artificial
  CRISPR gRNA sequence
acaaagtggtaaagaagctg

SEQ ID NO: 23065 - DNA, 20 bp, Artificial
  CRISPR gRNA sequence
agattattttagtaacattg

SEQ ID NO: 23066 - DNA, 20 bp, Artificial
  CRISPR gRNA sequence
ttttagtaacattgtttctt

SEQ ID NO: 23067 - DNA, 20 bp, Artificial
  CRISPR gRNA sequence
tagtaacattgtttcttttt

SEQ ID NO: 23068 - DNA, 20 bp, Artificial
  CRISPR gRNA sequence
agtaacattgtttctttttc

SEQ ID NO: 23069 - DNA, 20 bp, Artificial
  CRISPR gRNA sequence
gtaacattgtttctttttca

SEQ ID NO: 23070 - DNA, 20 bp, Artificial
  CRISPR gRNA sequence
tttctttttcaaccacaagt

SEQ ID NO: 23071 - DNA, 20 bp, Artificial
  CRISPR gRNA sequence
ctttttcaaccacaagtgat

SEQ ID NO: 23072 - DNA, 20 bp, Artificial
  CRISPR gRNA sequence
tttttcaaccacaagtgata

SEQ ID NO: 23073 - DNA, 20 bp, Artificial
  CRISPR gRNA sequence
tttcaaccacaagtgatact

SEQ ID NO: 23074 - DNA, 20 bp, Artificial
  CRISPR gRNA sequence
ttcaaccacaagtgatactg

SEQ ID NO: 23075 - DNA, 20 bp, Artificial
  CRISPR gRNA sequence
tcaaccacaagtgatactgt

SEQ ID NO: 23076 - DNA, 20 bp, Artificial
  CRISPR gRNA sequence
caaccacaagtgatactgtt

SEQ ID NO: 23077 - DNA, 20 bp, Artificial
  CRISPR gRNA sequence
aaccacaagtgatactgttg

SEQ ID NO: 23078 - DNA, 20 bp, Artificial
  CRISPR gRNA sequence
ttggtttggttttgcttttc

SEQ ID NO: 23079 - DNA, 20 bp, Artificial
  CRISPR gRNA sequence
gtttggttttgcttttccgt

SEQ ID NO: 23080 - DNA, 20 bp, Artificial
  CRISPR gRNA sequence
ggttttgcttttccgtttat

SEQ ID NO: 23081 - DNA, 20 bp, Artificial
  CRISPR gRNA sequence
gttttgcttttccgtttata

SEQ ID NO: 23082 - DNA, 20 bp, Artificial
  CRISPR gRNA sequence
tgcttttccgtttatacatg

SEQ ID NO: 23083 - DNA, 20 bp, Artificial
  CRISPR gRNA sequence
gcttttccgtttatacatgg

SEQ ID NO: 23084 - DNA, 20 bp, Artificial
  CRISPR gRNA sequence
cttttccgtttatacatgga

SEQ ID NO: 23085 - DNA, 20 bp, Artificial
  CRISPR gRNA sequence
ttccgtttatacatggaaaa

SEQ ID NO: 23086 - DNA, 20 bp, Artificial
  CRISPR gRNA sequence
tccgtttatacatggaaaaa

SEQ ID NO: 23087 - DNA, 20 bp, Artificial
  CRISPR gRNA sequence
ccgtttatacatggaaaaaa

SEQ ID NO: 23088 - DNA, 20 bp, Artificial
  CRISPR gRNA sequence
cgtttatacatggaaaaaaa

SEQ ID NO: 23089 - DNA, 20 bp, Artificial
  CRISPR gRNA sequence
atacatggaaaaaaaagttt

SEQ ID NO: 23090 - DNA, 20 bp, Artificial
  CRISPR gRNA sequence
tacatggaaaaaaaagtttt

SEQ ID NO: 23091 - DNA, 20 bp, Artificial
  CRISPR gRNA sequence
tctttttgtaaaatcatggt

SEQ ID NO: 23092 - DNA, 20 bp, Artificial
  CRISPR gRNA sequence
ctttttgtaaaatcatggta

SEQ ID NO: 23093 - DNA, 20 bp, Artificial
  CRISPR gRNA sequence
tttttgtaaaatcatggtaa

SEQ ID NO: 23094 - DNA, 20 bp, Artificial
  CRISPR gRNA sequence
tttgtaaaatcatggtaaaa

SEQ ID NO: 23095 - DNA, 20 bp, Artificial
  CRISPR gRNA sequence
ttgtaaaatcatggtaaaat

SEQ ID NO: 23096 - DNA, 20 bp, Artificial
  CRISPR gRNA sequence
tgtaaaatcatggtaaaata

SEQ ID NO: 23097 - DNA, 20 bp, Artificial
  CRISPR gRNA sequence
gtaaaatcatggtaaaatac

SEQ ID NO: 23098 - DNA, 20 bp, Artificial
  CRISPR gRNA sequence
taaaatcatggtaaaataca

SEQ ID NO: 23099 - DNA, 20 bp, Artificial
  CRISPR gRNA sequence
accattttaaccactttcaa

SEQ ID NO: 23100 - DNA, 20 bp, Artificial
  CRISPR gRNA sequence
ccattttaaccactttcaaa

SEQ ID NO: 23101 - DNA, 20 bp, Artificial
  CRISPR gRNA sequence
taaccactttcaaatgtaca

SEQ ID NO: 23102 - DNA, 20 bp, Artificial
  CRISPR gRNA sequence
aaccactttcaaatgtacat

SEQ ID NO: 23103 - DNA, 20 bp, Artificial
  CRISPR gRNA sequence
accactttcaaatgtacatt

SEQ ID NO: 23104 - DNA, 20 bp, Artificial
  CRISPR gRNA sequence
tcaaatgtacatttcagtgg

SEQ ID NO: 23105 - DNA, 20 bp, Artificial
  CRISPR gRNA sequence
caaatgtacatttcagtggc

SEQ ID NO: 23106 - DNA, 20 bp, Artificial
  CRISPR gRNA sequence
aaatgtacatttcagtggca

SEQ ID NO: 23107 - DNA, 20 bp, Artificial
  CRISPR gRNA sequence
cagtggcattaaatatttca

SEQ ID NO: 23108 - DNA, 20 bp, Artificial
  CRISPR gRNA sequence
agtggcattaaatatttcaa

SEQ ID NO: 23109 - DNA, 20 bp, Artificial
  CRISPR gRNA sequence
aatatttcaaactgttgtgc

SEQ ID NO: 23110 - DNA, 20 bp, Artificial
  CRISPR gRNA sequence
caaactgttgtgcaacctcc

SEQ ID NO: 23111 - DNA, 20 bp, Artificial
  CRISPR gRNA sequence
aaactgttgtgcaacctccg

SEQ ID NO: 23112 - DNA, 20 bp, Artificial
  CRISPR gRNA sequence
ttgtgcaacctccgctacca

SEQ ID NO: 23113 - DNA, 20 bp, Artificial
  CRISPR gRNA sequence
tgcaacctccgctaccatcc

SEQ ID NO: 23114 - DNA, 20 bp, Artificial
  CRISPR gRNA sequence
cgctaccatccatctccaga

SEQ ID NO: 23115 - DNA, 20 bp, Artificial
  CRISPR gRNA sequence
ccatccatctccagaacttt

SEQ ID NO: 23116 - DNA, 20 bp, Artificial
  CRISPR gRNA sequence
cagaactttttcatcctccc

SEQ ID NO: 23117 - DNA, 20 bp, Artificial
  CRISPR gRNA sequence
tttcatcctcccaaactgaa

SEQ ID NO: 23118 - DNA, 20 bp, Artificial
  CRISPR gRNA sequence
ttcatcctcccaaactgaaa

SEQ ID NO: 23119 - DNA, 20 bp, Artificial
  CRISPR gRNA sequence
tcatcctcccaaactgaaac

SEQ ID NO: 23120 - DNA, 20 bp, Artificial
  CRISPR gRNA sequence
catcctcccaaactgaaact

SEQ ID NO: 23121 - DNA, 20 bp, Artificial
  CRISPR gRNA sequence
atcctcccaaactgaaactc

SEQ ID NO: 23122 - DNA, 20 bp, Artificial
  CRISPR gRNA sequence
ccaaactgaaactctaccca

SEQ ID NO: 23123 - DNA, 20 bp, Artificial
  CRISPR gRNA sequence
aaactctacccaataagcaa

SEQ ID NO: 23124 - DNA, 20 bp, Artificial
  CRISPR gRNA sequence
tacccaataagcaataactc

SEQ ID NO: 23125 - DNA, 20 bp, Artificial
  CRISPR gRNA sequence
cccaataagcaataactccc

SEQ ID NO: 23126 - DNA, 20 bp, Artificial
  CRISPR gRNA sequence
cccactgccccttccaccca

SEQ ID NO: 23127 - DNA, 20 bp, Artificial
  CRISPR gRNA sequence
ccccttccacccagctcgtg

SEQ ID NO: 23128 - DNA, 20 bp, Artificial
  CRISPR gRNA sequence
ccacccagctcgtggtaact

SEQ ID NO: 23129 - DNA, 20 bp, Artificial
  CRISPR gRNA sequence
cacccagctcgtggtaactc

SEQ ID NO: 23130 - DNA, 20 bp, Artificial
  CRISPR gRNA sequence
gtggtaactccaacttcctg

SEQ ID NO: 23131 - DNA, 20 bp, Artificial
  CRISPR gRNA sequence
caacttcctgtctctatgtt

SEQ ID NO: 23132 - DNA, 20 bp, Artificial
  CRISPR gRNA sequence
cctgtctctatgttttgggc

SEQ ID NO: 23133 - DNA, 20 bp, Artificial
  CRISPR gRNA sequence
ctgtctctatgttttgggct

SEQ ID NO: 23134 - DNA, 20 bp, Artificial
  CRISPR gRNA sequence
tctctatgttttgggctact

SEQ ID NO: 23135 - DNA, 20 bp, Artificial
  CRISPR gRNA sequence
tatgttttgggctactctag

SEQ ID NO: 23136 - DNA, 20 bp, Artificial
  CRISPR gRNA sequence
tgttttgggctactctagac

SEQ ID NO: 23137 - DNA, 20 bp, Artificial
  CRISPR gRNA sequence
tgggctactctagacaccgc

SEQ ID NO: 23138 - DNA, 20 bp, Artificial
  CRISPR gRNA sequence
gggctactctagacaccgcc

SEQ ID NO: 23139 - DNA, 20 bp, Artificial
  CRISPR gRNA sequence
ggctactctagacaccgcct

SEQ ID NO: 23140 - DNA, 20 bp, Artificial
  CRISPR gRNA sequence
ctctagacaccgcctataaa

SEQ ID NO: 23141 - DNA, 20 bp, Artificial
  CRISPR gRNA sequence
tagacaccgcctataaatag

SEQ ID NO: 23142 - DNA, 20 bp, Artificial
  CRISPR gRNA sequence
gacaccgcctataaatagaa

SEQ ID NO: 23143 - DNA, 20 bp, Artificial
  CRISPR gRNA sequence
taaatagaattacgtgatat

SEQ ID NO: 23144 - DNA, 20 bp, Artificial
  CRISPR gRNA sequence
cgtgatatttgtctttttgt

SEQ ID NO: 23145 - DNA, 20 bp, Artificial
  CRISPR gRNA sequence
gtctttttgtgcctggcttc

SEQ ID NO: 23146 - DNA, 20 bp, Artificial
  CRISPR gRNA sequence
tctttttgtgcctggcttct

SEQ ID NO: 23147 - DNA, 20 bp, Artificial
  CRISPR gRNA sequence
tttgtgcctggcttctttca

SEQ ID NO: 23148 - DNA, 20 bp, Artificial
  CRISPR gRNA sequence
ttgtgcctggcttctttcac

SEQ ID NO: 23149 - DNA, 20 bp, Artificial
  CRISPR gRNA sequence
tgtgcctggcttctttcact

SEQ ID NO: 23150 - DNA, 20 bp, Artificial
  CRISPR gRNA sequence
gtgcctggcttctttcactt

SEQ ID NO: 23151 - DNA, 20 bp, Artificial
  CRISPR gRNA sequence
tgcctggcttctttcactta

SEQ ID NO: 23152 - DNA, 20 bp, Artificial
  CRISPR gRNA sequence
gcttctttcacttagcataa

SEQ ID NO: 23153 - DNA, 20 bp, Artificial
  CRISPR gRNA sequence
ctttcacttagcataatgtc

SEQ ID NO: 23154 - DNA, 20 bp, Artificial
  CRISPR gRNA sequence
tttcacttagcataatgtct

SEQ ID NO: 23155 - DNA, 20 bp, Artificial
  CRISPR gRNA sequence
tcacttagcataatgtcttc

SEQ ID NO: 23156 - DNA, 20 bp, Artificial
  CRISPR gRNA sequence
cacttagcataatgtcttcc

SEQ ID NO: 23157 - DNA, 20 bp, Artificial
  CRISPR gRNA sequence
acttagcataatgtcttcca

SEQ ID NO: 23158 - DNA, 20 bp, Artificial
  CRISPR gRNA sequence
agcataatgtcttccaggtt

SEQ ID NO: 23159 - DNA, 20 bp, Artificial
  CRISPR gRNA sequence
gcataatgtcttccaggttc

SEQ ID NO: 23160 - DNA, 20 bp, Artificial
  CRISPR gRNA sequence
ccaggttcatccatgtcgtg

SEQ ID NO: 23161 - DNA, 20 bp, Artificial
  CRISPR gRNA sequence
caggttcatccatgtcgtgc

SEQ ID NO: 23162 - DNA, 20 bp, Artificial
  CRISPR gRNA sequence
atccatgtcgtgccatgtgt

SEQ ID NO: 23163 - DNA, 20 bp, Artificial
  CRISPR gRNA sequence
ctttctatggcggaatagta

SEQ ID NO: 23164 - DNA, 20 bp, Artificial
  CRISPR gRNA sequence
tctatggcggaatagtattc

SEQ ID NO: 23165 - DNA, 20 bp, Artificial
  CRISPR gRNA sequence
ctatggcggaatagtattct

SEQ ID NO: 23166 - DNA, 20 bp, Artificial
  CRISPR gRNA sequence
tatggcggaatagtattcta

SEQ ID NO: 23167 - DNA, 20 bp, Artificial
  CRISPR gRNA sequence
tggcggaatagtattctaat

SEQ ID NO: 23168 - DNA, 20 bp, Artificial
  CRISPR gRNA sequence
taatatgtggatatcccata

SEQ ID NO: 23169 - DNA, 20 bp, Artificial
  CRISPR gRNA sequence
atatgtggatatcccatatt

SEQ ID NO: 23170 - DNA, 20 bp, Artificial
  CRISPR gRNA sequence
tgttcatccattcatttgtt

SEQ ID NO: 23171 - DNA, 20 bp, Artificial
  CRISPR gRNA sequence
gttcatccattcatttgttg

SEQ ID NO: 23172 - DNA, 20 bp, Artificial
  CRISPR gRNA sequence
ttcatccattcatttgttga

SEQ ID NO: 23173 - DNA, 20 bp, Artificial
  CRISPR gRNA sequence
atccattcatttgttgatag

SEQ ID NO: 23174 - DNA, 20 bp, Artificial
  CRISPR gRNA sequence
atttgttgatagacacttgg

SEQ ID NO: 23175 - DNA, 20 bp, Artificial
  CRISPR gRNA sequence
gttgatagacacttgggttg

SEQ ID NO: 23176 - DNA, 20 bp, Artificial
  CRISPR gRNA sequence
ttgatagacacttgggttgt

SEQ ID NO: 23177 - DNA, 20 bp, Artificial
  CRISPR gRNA sequence
atagacacttgggttgttcc

SEQ ID NO: 23178 - DNA, 20 bp, Artificial
  CRISPR gRNA sequence
gggttgttcctacctcttga

SEQ ID NO: 23179 - DNA, 20 bp, Artificial
  CRISPR gRNA sequence
ggttgttcctacctcttgac

SEQ ID NO: 23180 - DNA, 20 bp, Artificial
  CRISPR gRNA sequence
ttcctacctcttgactattg

SEQ ID NO: 23181 - DNA, 20 bp, Artificial
  CRISPR gRNA sequence
ctacctcttgactattgtga

SEQ ID NO: 23182 - DNA, 20 bp, Artificial
  CRISPR gRNA sequence
cctcttgactattgtgaata

SEQ ID NO: 23183 - DNA, 20 bp, Artificial
  CRISPR gRNA sequence
ttgactattgtgaataatct

SEQ ID NO: 23184 - DNA, 20 bp, Artificial
  CRISPR gRNA sequence
gactattgtgaataatcttg

SEQ ID NO: 23185 - DNA, 20 bp, Artificial
  CRISPR gRNA sequence
actattgtgaataatcttgc

SEQ ID NO: 23186 - DNA, 20 bp, Artificial
  CRISPR gRNA sequence
ttgtgaataatcttgctagg

SEQ ID NO: 23187 - DNA, 20 bp, Artificial
  CRISPR gRNA sequence
tgaataatcttgctaggtac

SEQ ID NO: 23188 - DNA, 20 bp, Artificial
  CRISPR gRNA sequence
gctaggtacatgggtggaca

SEQ ID NO: 23189 - DNA, 20 bp, Artificial
  CRISPR gRNA sequence
ctaggtacatgggtggacaa

SEQ ID NO: 23190 - DNA, 20 bp, Artificial
  CRISPR gRNA sequence
ggtacatgggtggacaaata

SEQ ID NO: 23191 - DNA, 20 bp, Artificial
  CRISPR gRNA sequence
tctgactccccgctttcaac

SEQ ID NO: 23192 - DNA, 20 bp, Artificial
  CRISPR gRNA sequence
actccccgctttcaactcta

SEQ ID NO: 23193 - DNA, 20 bp, Artificial
  CRISPR gRNA sequence
cccgctttcaactctagaaa

SEQ ID NO: 23194 - DNA, 20 bp, Artificial
  CRISPR gRNA sequence
tcaactctagaaagctttct

SEQ ID NO: 23195 - DNA, 20 bp, Artificial
  CRISPR gRNA sequence
caactctagaaagctttctt

SEQ ID NO: 23196 - DNA, 20 bp, Artificial
  CRISPR gRNA sequence
aactctagaaagctttcttt

SEQ ID NO: 23197 - DNA, 20 bp, Artificial
  CRISPR gRNA sequence
tagaaagctttcttttaaaa

SEQ ID NO: 23198 - DNA, 20 bp, Artificial
  CRISPR gRNA sequence
gaaagctttcttttaaaatc

SEQ ID NO: 23199 - DNA, 20 bp, Artificial
  CRISPR gRNA sequence
tcttttaaaatcggtctatt

SEQ ID NO: 23200 - DNA, 20 bp, Artificial
  CRISPR gRNA sequence
cttttaaaatcggtctattt

SEQ ID NO: 23201 - DNA, 20 bp, Artificial
  CRISPR gRNA sequence
ttttaaaatcggtctattta

SEQ ID NO: 23202 - DNA, 20 bp, Artificial
  CRISPR gRNA sequence
ttaaaatcggtctatttaag

SEQ ID NO: 23203 - DNA, 20 bp, Artificial
  CRISPR gRNA sequence
taaaatcggtctatttaagt

SEQ ID NO: 23204 - DNA, 20 bp, Artificial
  CRISPR gRNA sequence
aaaatcggtctatttaagtt

SEQ ID NO: 23205 - DNA, 20 bp, Artificial
  CRISPR gRNA sequence
aaatcggtctatttaagttt

SEQ ID NO: 23206 - DNA, 20 bp, Artificial
  CRISPR gRNA sequence
tttaagtttctttaaaaagt

SEQ ID NO: 23207 - DNA, 20 bp, Artificial
  CRISPR gRNA sequence
aagtttctttaaaaagttaa

SEQ ID NO: 23208 - DNA, 20 bp, Artificial
  CRISPR gRNA sequence
agtttctttaaaaagttaat

SEQ ID NO: 23209 - DNA, 20 bp, Artificial
  CRISPR gRNA sequence
ctttaaaaagttaatttaag

SEQ ID NO: 23210 - DNA, 20 bp, Artificial
  CRISPR gRNA sequence
tttaaaaagttaatttaaga

SEQ ID NO: 23211 - DNA, 20 bp, Artificial
  CRISPR gRNA sequence
taaaaagttaatttaagaaa

SEQ ID NO: 23212 - DNA, 20 bp, Artificial
  CRISPR gRNA sequence
aaaaagttaatttaagaaaa

SEQ ID NO: 23213 - DNA, 20 bp, Artificial
  CRISPR gRNA sequence
aaaagttaatttaagaaaaa

SEQ ID NO: 23214 - DNA, 20 bp, Artificial
  CRISPR gRNA sequence
atttaagaaaaatactaagg

SEQ ID NO: 23215 - DNA, 20 bp, Artificial
  CRISPR gRNA sequence
aagaaaaatactaaggtaaa

SEQ ID NO: 23216 - DNA, 20 bp, Artificial
  CRISPR gRNA sequence
agaaaaatactaaggtaaat

SEQ ID NO: 23217 - DNA, 20 bp, Artificial
  CRISPR gRNA sequence
aggtaaattgtagaacaggt

SEQ ID NO: 23218 - DNA, 20 bp, Artificial
  CRISPR gRNA sequence
tagaacaggtgatatgtcaa

SEQ ID NO: 23219 - DNA, 20 bp, Artificial
  CRISPR gRNA sequence
taaagatggaagacgaatgc

SEQ ID NO: 23220 - DNA, 20 bp, Artificial
  CRISPR gRNA sequence
cagtttgggaaaccggatga

SEQ ID NO: 23221 - DNA, 20 bp, Artificial
  CRISPR gRNA sequence
gggaaaccggatgagaggaa

SEQ ID NO: 23222 - DNA, 20 bp, Artificial
  CRISPR gRNA sequence
ggaaaccggatgagaggaaa

SEQ ID NO: 23223 - DNA, 20 bp, Artificial
  CRISPR gRNA sequence
gaagctattgtaaaatctat

SEQ ID NO: 23224 - DNA, 20 bp, Artificial
  CRISPR gRNA sequence
ttgtaaaatctatgctgagg

SEQ ID NO: 23225 - DNA, 20 bp, Artificial
  CRISPR gRNA sequence
taaaatctatgctgagggtc

SEQ ID NO: 23226 - DNA, 20 bp, Artificial
  CRISPR gRNA sequence
tgctgagggtctggtgacta

SEQ ID NO: 23227 - DNA, 20 bp, Artificial
  CRISPR gRNA sequence
agggtctggtgactactaga

SEQ ID NO: 23228 - DNA, 20 bp, Artificial
  CRISPR gRNA sequence
gtgactactagaccaagggc

SEQ ID NO: 23229 - DNA, 20 bp, Artificial
  CRISPR gRNA sequence
ctagaccaagggcatggcag

SEQ ID NO: 23230 - DNA, 20 bp, Artificial
  CRISPR gRNA sequence
gaccaagggcatggcagcag

SEQ ID NO: 23231 - DNA, 20 bp, Artificial
  CRISPR gRNA sequence
aaagacttcaggaaggaaag

SEQ ID NO: 23232 - DNA, 20 bp, Artificial
  CRISPR gRNA sequence
caggaaggaaagatataaga

SEQ ID NO: 23233 - DNA, 20 bp, Artificial
  CRISPR gRNA sequence
aggaaggaaagatataagaa

SEQ ID NO: 23234 - DNA, 20 bp, Artificial
  CRISPR gRNA sequence
agaaaggggcctggtgcagt

SEQ ID NO: 23235 - DNA, 20 bp, Artificial
  CRISPR gRNA sequence
gtgcagtggctcatgcctgt

SEQ ID NO: 23236 - DNA, 20 bp, Artificial
  CRISPR gRNA sequence
atgcctgtaattccatcacc

SEQ ID NO: 23237 - DNA, 20 bp, Artificial
  CRISPR gRNA sequence
taattccatcaccttgggag

SEQ ID NO: 23238 - DNA, 20 bp, Artificial
  CRISPR gRNA sequence
catcaccttgggaggtcaag

SEQ ID NO: 23239 - DNA, 20 bp, Artificial
  CRISPR gRNA sequence
gggaggtcaaggcaggatga

SEQ ID NO: 23240 - DNA, 20 bp, Artificial
  CRISPR gRNA sequence
ggaggtcaaggcaggatgat

SEQ ID NO: 23241 - DNA, 20 bp, Artificial
  CRISPR gRNA sequence
gagaccaggagttcaagacc

SEQ ID NO: 23242 - DNA, 20 bp, Artificial
  CRISPR gRNA sequence
agaccaggagttcaagacca

SEQ ID NO: 23243 - DNA, 20 bp, Artificial
  CRISPR gRNA sequence
aagaccagcctgggcaacag

SEQ ID NO: 23244 - DNA, 20 bp, Artificial
  CRISPR gRNA sequence
ggcaacagagcaagaccttt

SEQ ID NO: 23245 - DNA, 20 bp, Artificial
  CRISPR gRNA sequence
tttttaggaaaaaaatatat

SEQ ID NO: 23246 - DNA, 20 bp, Artificial
  CRISPR gRNA sequence
ttttaggaaaaaaatatata

SEQ ID NO: 23247 - DNA, 20 bp, Artificial
  CRISPR gRNA sequence
tttaggaaaaaaatatataa

SEQ ID NO: 23248 - DNA, 20 bp, Artificial
  CRISPR gRNA sequence
ttaggaaaaaaatatataaa

SEQ ID NO: 23249 - DNA, 20 bp, Artificial
  CRISPR gRNA sequence
taggaaaaaaatatataaat

SEQ ID NO: 23250 - DNA, 20 bp, Artificial
  CRISPR gRNA sequence
aggaaaaaaatatataaatt

SEQ ID NO: 23251 - DNA, 20 bp, Artificial
  CRISPR gRNA sequence
ggaaaaaaatatataaatta

SEQ ID NO: 23252 - DNA, 20 bp, Artificial
  CRISPR gRNA sequence
ataaaaataaatttttgaaa

SEQ ID NO: 23253 - DNA, 20 bp, Artificial
  CRISPR gRNA sequence
ttgaaaatacagattccagg

SEQ ID NO: 23254 - DNA, 20 bp, Artificial
  CRISPR gRNA sequence
tgaaaatacagattccaggc

SEQ ID NO: 23255 - DNA, 20 bp, Artificial
  CRISPR gRNA sequence
gaaaatacagattccaggcc

SEQ ID NO: 23256 - DNA, 20 bp, Artificial
  CRISPR gRNA sequence
aaaatacagattccaggccg

SEQ ID NO: 23257 - DNA, 20 bp, Artificial
  CRISPR gRNA sequence
caggccgggcatggtggctc

SEQ ID NO: 23258 - DNA, 20 bp, Artificial
  CRISPR gRNA sequence
acacctgtaaccccagcact

SEQ ID NO: 23259 - DNA, 20 bp, Artificial
  CRISPR gRNA sequence
taaccccagcactttgggag

SEQ ID NO: 23260 - DNA, 20 bp, Artificial
  CRISPR gRNA sequence
tgggaggctgaggccggtgg

SEQ ID NO: 23261 - DNA, 20 bp, Artificial
  CRISPR gRNA sequence
gggaggctgaggccggtgga

SEQ ID NO: 23262 - DNA, 20 bp, Artificial
  CRISPR gRNA sequence
ggaggctgaggccggtggat

SEQ ID NO: 23263 - DNA, 20 bp, Artificial
  CRISPR gRNA sequence
aggccggtggatcacctggg

SEQ ID NO: 23264 - DNA, 20 bp, Artificial
  CRISPR gRNA sequence
ggatcaggagttcgagacca

SEQ ID NO: 23265 - DNA, 20 bp, Artificial
  CRISPR gRNA sequence
gagaccagcctgggcaacat

SEQ ID NO: 23266 - DNA, 20 bp, Artificial
  CRISPR gRNA sequence
ggcaacatggtgaaacaccg

SEQ ID NO: 23267 - DNA, 20 bp, Artificial
  CRISPR gRNA sequence
tcctaaaaatacaaaattag

SEQ ID NO: 23268 - DNA, 20 bp, Artificial
  CRISPR gRNA sequence
ctaaaaatacaaaattagcc

SEQ ID NO: 23269 - DNA, 20 bp, Artificial
  CRISPR gRNA sequence
aaaatacaaaattagccggg

SEQ ID NO: 23270 - DNA, 20 bp, Artificial
  CRISPR gRNA sequence
gccgggtgtagtggtgcatg

SEQ ID NO: 23271 - DNA, 20 bp, Artificial
  CRISPR gRNA sequence
taatcccagctactcggtag

SEQ ID NO: 23272 - DNA, 20 bp, Artificial
  CRISPR gRNA sequence
ctcggtaggctggtggagga

SEQ ID NO: 23273 - DNA, 20 bp, Artificial
  CRISPR gRNA sequence
ggtaggctggtggaggagaa

SEQ ID NO: 23274 - DNA, 20 bp, Artificial
  CRISPR gRNA sequence
gtggaggagaatcgcctgaa

SEQ ID NO: 23275 - DNA, 20 bp, Artificial
  CRISPR gRNA sequence
aacccaggaggcggagattg

SEQ ID NO: 23276 - DNA, 20 bp, Artificial
  CRISPR gRNA sequence
cggtgagccgagatcacacc

SEQ ID NO: 23277 - DNA, 20 bp, Artificial
  CRISPR gRNA sequence
cactccagcctgggcaacaa

SEQ ID NO: 23278 - DNA, 20 bp, Artificial
  CRISPR gRNA sequence
cagcctgggcaacaagagtg

SEQ ID NO: 23279 - DNA, 20 bp, Artificial
  CRISPR gRNA sequence
ggcaacaagagtgaaactcc

SEQ ID NO: 23280 - DNA, 20 bp, Artificial
  CRISPR gRNA sequence
cgtctcaaaaaaaatgaaag

SEQ ID NO: 23281 - DNA, 20 bp, Artificial
  CRISPR gRNA sequence
aaaaaaaatgaaagaaaata

SEQ ID NO: 23282 - DNA, 20 bp, Artificial
  CRISPR gRNA sequence
ctgggcccggctgcagactc

SEQ ID NO: 23283 - DNA, 20 bp, Artificial
  CRISPR gRNA sequence
ggcccggctgcagactccct

SEQ ID NO: 23284 - DNA, 20 bp, Artificial
  CRISPR gRNA sequence
cagactccctgaatagaatc

SEQ ID NO: 23285 - DNA, 20 bp, Artificial
  CRISPR gRNA sequence
cctgaatagaatcactgggg

SEQ ID NO: 23286 - DNA, 20 bp, Artificial
  CRISPR gRNA sequence
aatagaatcactgggggtga

SEQ ID NO: 23287 - DNA, 20 bp, Artificial
  CRISPR gRNA sequence
ggggtgaggcccaggacgct

SEQ ID NO: 23288 - DNA, 20 bp, Artificial
  CRISPR gRNA sequence
tgtttttaacacccttccca

SEQ ID NO: 23289 - DNA, 20 bp, Artificial
  CRISPR gRNA sequence
ttaacacccttcccaggtaa

SEQ ID NO: 23290 - DNA, 20 bp, Artificial
  CRISPR gRNA sequence
taacacccttcccaggtaat

SEQ ID NO: 23291 - DNA, 20 bp, Artificial
  CRISPR gRNA sequence
aacacccttcccaggtaatt

SEQ ID NO: 23292 - DNA, 20 bp, Artificial
  CRISPR gRNA sequence
acacccttcccaggtaattc

SEQ ID NO: 23293 - DNA, 20 bp, Artificial
  CRISPR gRNA sequence
cccaggtaattctcactcac

SEQ ID NO: 23294 - DNA, 20 bp, Artificial
  CRISPR gRNA sequence
ccaggtaattctcactcaca

SEQ ID NO: 23295 - DNA, 20 bp, Artificial
  CRISPR gRNA sequence
tcactcacagccaagcctgc

SEQ ID NO: 23296 - DNA, 20 bp, Artificial
  CRISPR gRNA sequence
actcacagccaagcctgccg

SEQ ID NO: 23297 - DNA, 20 bp, Artificial
  CRISPR gRNA sequence
acagccaagcctgccgatgg

SEQ ID NO: 23298 - DNA, 20 bp, Artificial
  CRISPR gRNA sequence
ccgatggctggactccgtag

SEQ ID NO: 23299 - DNA, 20 bp, Artificial
  CRISPR gRNA sequence
gactccgtagtcagatctca

SEQ ID NO: 23300 - DNA, 20 bp, Artificial
  CRISPR gRNA sequence
cgtagtcagatctcagcaag

SEQ ID NO: 23301 - DNA, 20 bp, Artificial
  CRISPR gRNA sequence
agcaagcaggactggctcgt

SEQ ID NO: 23302 - DNA, 20 bp, Artificial
  CRISPR gRNA sequence
gctcgtggttcatcttgggg

SEQ ID NO: 23303 - DNA, 20 bp, Artificial
  CRISPR gRNA sequence
gtggttcatcttggggtctc

SEQ ID NO: 23304 - DNA, 20 bp, Artificial
  CRISPR gRNA sequence
atcttggggtctccagcacc

SEQ ID NO: 23305 - DNA, 20 bp, Artificial
  CRISPR gRNA sequence
ggggtctccagcacccagca

SEQ ID NO: 23306 - DNA, 20 bp, Artificial
  CRISPR gRNA sequence
gggtctccagcacccagcag

SEQ ID NO: 23307 - DNA, 20 bp, Artificial
  CRISPR gRNA sequence
cagcacccagcagagtgctg

SEQ ID NO: 23308 - DNA, 20 bp, Artificial
  CRISPR gRNA sequence
gcggggggactgtgttaagt

SEQ ID NO: 23309 - DNA, 20 bp, Artificial
  CRISPR gRNA sequence
tgttaagtagagccggatgg

SEQ ID NO: 23310 - DNA, 20 bp, Artificial
  CRISPR gRNA sequence
agtagagccggatgggtcag

SEQ ID NO: 23311 - DNA, 20 bp, Artificial
  CRISPR gRNA sequence
gagtgtggggcctggctttg

SEQ ID NO: 23312 - DNA, 20 bp, Artificial
  CRISPR gRNA sequence
gctttgctaactgcagtcac

SEQ ID NO: 23313 - DNA, 20 bp, Artificial
  CRISPR gRNA sequence
tgctaactgcagtcacaaga

SEQ ID NO: 23314 - DNA, 20 bp, Artificial
  CRISPR gRNA sequence
gctaactgcagtcacaagat

SEQ ID NO: 23315 - DNA, 20 bp, Artificial
  CRISPR gRNA sequence
ctaactgcagtcacaagatc

SEQ ID NO: 23316 - DNA, 20 bp, Artificial
  CRISPR gRNA sequence
actgcagtcacaagatcctc

SEQ ID NO: 23317 - DNA, 20 bp, Artificial
  CRISPR gRNA sequence
cagtcacaagatcctcatca

SEQ ID NO: 23318 - DNA, 20 bp, Artificial
  CRISPR gRNA sequence
atcactccaccccctacccc

SEQ ID NO: 23319 - DNA, 20 bp, Artificial
  CRISPR gRNA sequence
caccccctaccccagcacca

SEQ ID NO: 23320 - DNA, 20 bp, Artificial
  CRISPR gRNA sequence
ccccagcaccagggtcaggt

SEQ ID NO: 23321 - DNA, 20 bp, Artificial
  CRISPR gRNA sequence
ccttccaggaaaaacttgtt

SEQ ID NO: 23322 - DNA, 20 bp, Artificial
  CRISPR gRNA sequence
ccaggaaaaacttgttggac

SEQ ID NO: 23323 - DNA, 20 bp, Artificial
  CRISPR gRNA sequence
caggaaaaacttgttggact

SEQ ID NO: 23324 - DNA, 20 bp, Artificial
  CRISPR gRNA sequence
gttggactcctttccaggtc

SEQ ID NO: 23325 - DNA, 20 bp, Artificial
  CRISPR gRNA sequence
ttggactcctttccaggtca

SEQ ID NO: 23326 - DNA, 20 bp, Artificial
  CRISPR gRNA sequence
gactcctttccaggtcattg

SEQ ID NO: 23327 - DNA, 20 bp, Artificial
  CRISPR gRNA sequence
ctttccaggtcattgactgc

SEQ ID NO: 23328 - DNA, 20 bp, Artificial
  CRISPR gRNA sequence
tccaggtcattgactgcagt

SEQ ID NO: 23329 - DNA, 20 bp, Artificial
  CRISPR gRNA sequence
ccaggtcattgactgcagtt

SEQ ID NO: 23330 - DNA, 20 bp, Artificial
  CRISPR gRNA sequence
caggtcattgactgcagtta

SEQ ID NO: 23331 - DNA, 20 bp, Artificial
  CRISPR gRNA sequence
actgcagttaggagtggcat

SEQ ID NO: 23332 - DNA, 20 bp, Artificial
  CRISPR gRNA sequence
cagttaggagtggcatgcag

SEQ ID NO: 23333 - DNA, 20 bp, Artificial
  CRISPR gRNA sequence
ggagtggcatgcagaaggga

SEQ ID NO: 23334 - DNA, 20 bp, Artificial
  CRISPR gRNA sequence
tctggagctgggacagacca

SEQ ID NO: 23335 - DNA, 20 bp, Artificial
  CRISPR gRNA sequence
gagctgggacagaccaggca

SEQ ID NO: 23336 - DNA, 20 bp, Artificial
  CRISPR gRNA sequence
ggacagaccaggcaagcggg

SEQ ID NO: 23337 - DNA, 20 bp, Artificial
  CRISPR gRNA sequence
ttatcccaaccctgcattct

SEQ ID NO: 23338 - DNA, 20 bp, Artificial
  CRISPR gRNA sequence
atcccaaccctgcattctgg

SEQ ID NO: 23339 - DNA, 20 bp, Artificial
  CRISPR gRNA sequence
tcccaaccctgcattctgga

SEQ ID NO: 23340 - DNA, 20 bp, Artificial
  CRISPR gRNA sequence
cattctggacagggaccgaa

SEQ ID NO: 23341 - DNA, 20 bp, Artificial
  CRISPR gRNA sequence
tggacagggaccgaaggtct

SEQ ID NO: 23342 - DNA, 20 bp, Artificial
  CRISPR gRNA sequence
gacagggaccgaaggtctcc

SEQ ID NO: 23343 - DNA, 20 bp, Artificial
  CRISPR gRNA sequence
ctggctgcagctcatacagc

SEQ ID NO: 23344 - DNA, 20 bp, Artificial
  CRISPR gRNA sequence
gctgcagctcatacagctca

SEQ ID NO: 23345 - DNA, 20 bp, Artificial
  CRISPR gRNA sequence
cagctcatacagctcatctt

SEQ ID NO: 23346 - DNA, 20 bp, Artificial
  CRISPR gRNA sequence
atacagctcatcttcattct

SEQ ID NO: 23347 - DNA, 20 bp, Artificial
  CRISPR gRNA sequence
atcttcattctcatcctggg

SEQ ID NO: 23348 - DNA, 20 bp, Artificial
  CRISPR gRNA sequence
cattctcatcctgggaccac

SEQ ID NO: 23349 - DNA, 20 bp, Artificial
  CRISPR gRNA sequence
attctcatcctgggaccacc

SEQ ID NO: 23350 - DNA, 20 bp, Artificial
  CRISPR gRNA sequence
tcatcctgggaccaccaggc

SEQ ID NO: 23351 - DNA, 20 bp, Artificial
  CRISPR gRNA sequence
atcctgggaccaccaggccc

SEQ ID NO: 23352 - DNA, 20 bp, Artificial
  CRISPR gRNA sequence
ggaccaccaggcccctcacc

SEQ ID NO: 23353 - DNA, 20 bp, Artificial
  CRISPR gRNA sequence
acccacaataactttaccct

SEQ ID NO: 23354 - DNA, 20 bp, Artificial
  CRISPR gRNA sequence
taccctttactggcaaatgc

SEQ ID NO: 23355 - DNA, 20 bp, Artificial
  CRISPR gRNA sequence
accctttactggcaaatgca

SEQ ID NO: 23356 - DNA, 20 bp, Artificial
  CRISPR gRNA sequence
ccctttactggcaaatgcac

SEQ ID NO: 23357 - DNA, 20 bp, Artificial
  CRISPR gRNA sequence
tactggcaaatgcacaagct

SEQ ID NO: 23358 - DNA, 20 bp, Artificial
  CRISPR gRNA sequence
actggcaaatgcacaagctg

SEQ ID NO: 23359 - DNA, 20 bp, Artificial
  CRISPR gRNA sequence
ctggcaaatgcacaagctgg

SEQ ID NO: 23360 - DNA, 20 bp, Artificial
  CRISPR gRNA sequence
gcaaatgcacaagctggaga

SEQ ID NO: 23361 - DNA, 20 bp, Artificial
  CRISPR gRNA sequence
gagatgatggcccattcgag

SEQ ID NO: 23362 - DNA, 20 bp, Artificial
  CRISPR gRNA sequence
gagttttaagattttccaag

SEQ ID NO: 23363 - DNA, 20 bp, Artificial
  CRISPR gRNA sequence
taagattttccaagttgtta

SEQ ID NO: 23364 - DNA, 20 bp, Artificial
  CRISPR gRNA sequence
aagattttccaagttgttat

SEQ ID NO: 23365 - DNA, 20 bp, Artificial
  CRISPR gRNA sequence
agattttccaagttgttatg

SEQ ID NO: 23366 - DNA, 20 bp, Artificial
  CRISPR gRNA sequence
tccaagttgttatgaggtca

SEQ ID NO: 23367 - DNA, 20 bp, Artificial
  CRISPR gRNA sequence
ccaagttgttatgaggtcag

SEQ ID NO: 23368 - DNA, 20 bp, Artificial
  CRISPR gRNA sequence
caagttgttatgaggtcagt

SEQ ID NO: 23369 - DNA, 20 bp, Artificial
  CRISPR gRNA sequence
ttatgaggtcagtgtcctca

SEQ ID NO: 23370 - DNA, 20 bp, Artificial
  CRISPR gRNA sequence
tgaggtcagtgtcctcaatc

SEQ ID NO: 23371 - DNA, 20 bp, Artificial
  CRISPR gRNA sequence
aatcgggacccagagaagat

SEQ ID NO: 23372 - DNA, 20 bp, Artificial
  CRISPR gRNA sequence
gcctgaactttcagaggggg

SEQ ID NO: 23373 - DNA, 20 bp, Artificial
  CRISPR gRNA sequence
cctgaactttcagagggggc

SEQ ID NO: 23374 - DNA, 20 bp, Artificial
  CRISPR gRNA sequence
aactttcagagggggcatct

SEQ ID NO: 23375 - DNA, 20 bp, Artificial
  CRISPR gRNA sequence
tcagagggggcatctgtggt

SEQ ID NO: 23376 - DNA, 20 bp, Artificial
  CRISPR gRNA sequence
cagagggggcatctgtggtg

SEQ ID NO: 23377 - DNA, 20 bp, Artificial
  CRISPR gRNA sequence
agagggggcatctgtggtgt

SEQ ID NO: 23378 - DNA, 20 bp, Artificial
  CRISPR gRNA sequence
tggtgtcttttgtggggtcc

SEQ ID NO: 23379 - DNA, 20 bp, Artificial
  CRISPR gRNA sequence
ttgtggggtcctgtaggatt

SEQ ID NO: 23380 - DNA, 20 bp, Artificial
  CRISPR gRNA sequence
tgtggggtcctgtaggattt

SEQ ID NO: 23381 - DNA, 20 bp, Artificial
  CRISPR gRNA sequence
gtggggtcctgtaggatttc

SEQ ID NO: 23382 - DNA, 20 bp, Artificial
  CRISPR gRNA sequence
tggggtcctgtaggatttcc

SEQ ID NO: 23383 - DNA, 20 bp, Artificial
  CRISPR gRNA sequence
taggatttccacgtccctct

SEQ ID NO: 23384 - DNA, 20 bp, Artificial
  CRISPR gRNA sequence
ccacgtccctcttggaggaa

SEQ ID NO: 23385 - DNA, 20 bp, Artificial
  CRISPR gRNA sequence
cacgtccctcttggaggaaa

SEQ ID NO: 23386 - DNA, 20 bp, Artificial
  CRISPR gRNA sequence
ttggaggaaaaatagaagta

SEQ ID NO: 23387 - DNA, 20 bp, Artificial
  CRISPR gRNA sequence
ggaggaaaaatagaagtaag

SEQ ID NO: 23388 - DNA, 20 bp, Artificial
  CRISPR gRNA sequence
gaggaaaaatagaagtaagt

SEQ ID NO: 23389 - DNA, 20 bp, Artificial
  CRISPR gRNA sequence
tctcaggtcagattgtctgg

SEQ ID NO: 23390 - DNA, 20 bp, Artificial
  CRISPR gRNA sequence
aggtcagattgtctgggaag

SEQ ID NO: 23391 - DNA, 20 bp, Artificial
  CRISPR gRNA sequence
tctgggaagccaagtaggag

SEQ ID NO: 23392 - DNA, 20 bp, Artificial
  CRISPR gRNA sequence
ggaagccaagtaggagatgg

SEQ ID NO: 23393 - DNA, 20 bp, Artificial
  CRISPR gRNA sequence
gcatataggaggtttactgg

SEQ ID NO: 23394 - DNA, 20 bp, Artificial
  CRISPR gRNA sequence
catataggaggtttactggg

SEQ ID NO: 23395 - DNA, 20 bp, Artificial
  CRISPR gRNA sequence
actggggacattcacaggag

SEQ ID NO: 23396 - DNA, 20 bp, Artificial
  CRISPR gRNA sequence
ctggggacattcacaggagg

SEQ ID NO: 23397 - DNA, 20 bp, Artificial
  CRISPR gRNA sequence
gggacattcacaggagggaa

SEQ ID NO: 23398 - DNA, 20 bp, Artificial
  CRISPR gRNA sequence
acaggagggaacacccgaag

SEQ ID NO: 23399 - DNA, 20 bp, Artificial
  CRISPR gRNA sequence
ggaagcagcaggagttgagg

SEQ ID NO: 23400 - DNA, 20 bp, Artificial
  CRISPR gRNA sequence
aggtgcaatgcagtcacaac

SEQ ID NO: 23401 - DNA, 20 bp, Artificial
  CRISPR gRNA sequence
agccaatcccatagggagca

SEQ ID NO: 23402 - DNA, 20 bp, Artificial
  CRISPR gRNA sequence
gccaatcccatagggagcac

SEQ ID NO: 23403 - DNA, 20 bp, Artificial
  CRISPR gRNA sequence
aagctgggacagcaaggaag

SEQ ID NO: 23404 - DNA, 20 bp, Artificial
  CRISPR gRNA sequence
ggacagcaaggaagctagac

SEQ ID NO: 23405 - DNA, 20 bp, Artificial
  CRISPR gRNA sequence
gaccttcacatccctcatct

SEQ ID NO: 23406 - DNA, 20 bp, Artificial
  CRISPR gRNA sequence
cacatccctcatctacctcc

SEQ ID NO: 23407 - DNA, 20 bp, Artificial
  CRISPR gRNA sequence
acatccctcatctacctccg

SEQ ID NO: 23408 - DNA, 20 bp, Artificial
  CRISPR gRNA sequence
atctacctccgtcctcccat

SEQ ID NO: 23409 - DNA, 20 bp, Artificial
  CRISPR gRNA sequence
cctccgtcctcccatacagg

SEQ ID NO: 23410 - DNA, 20 bp, Artificial
  CRISPR gRNA sequence
cgtcctcccatacaggcata

SEQ ID NO: 23411 - DNA, 20 bp, Artificial
  CRISPR gRNA sequence
ccatacaggcatagcctccc

SEQ ID NO: 23412 - DNA, 20 bp, Artificial
  CRISPR gRNA sequence
ccccatgatgaacactcagc

SEQ ID NO: 23413 - DNA, 20 bp, Artificial
  CRISPR gRNA sequence
agcaccagactgatacattt

SEQ ID NO: 23414 - DNA, 20 bp, Artificial
  CRISPR gRNA sequence
atacatttgttataatcaat

SEQ ID NO: 23415 - DNA, 20 bp, Artificial
  CRISPR gRNA sequence
gttataatcaatgaacctac

SEQ ID NO: 23416 - DNA, 20 bp, Artificial
  CRISPR gRNA sequence
ttataatcaatgaacctaca

SEQ ID NO: 23417 - DNA, 20 bp, Artificial
  CRISPR gRNA sequence
taatcaatgaacctacattg

SEQ ID NO: 23418 - DNA, 20 bp, Artificial
  CRISPR gRNA sequence
cattgatgcatcattattac

SEQ ID NO: 23419 - DNA, 20 bp, Artificial
  CRISPR gRNA sequence
atgcatcattattacccaag

SEQ ID NO: 23420 - DNA, 20 bp, Artificial
  CRISPR gRNA sequence
ttacccaaggtccatggttt

SEQ ID NO: 23421 - DNA, 20 bp, Artificial
  CRISPR gRNA sequence
cccaaggtccatggtttgtt

SEQ ID NO: 23422 - DNA, 20 bp, Artificial
  CRISPR gRNA sequence
gtttacatgagggtttactc

SEQ ID NO: 23423 - DNA, 20 bp, Artificial
  CRISPR gRNA sequence
tttacatgagggtttactct

SEQ ID NO: 23424 - DNA, 20 bp, Artificial
  CRISPR gRNA sequence
acatgagggtttactcttgg

SEQ ID NO: 23425 - DNA, 20 bp, Artificial
  CRISPR gRNA sequence
catgagggtttactcttggt

SEQ ID NO: 23426 - DNA, 20 bp, Artificial
  CRISPR gRNA sequence
actcttggtgttgtacattc

SEQ ID NO: 23427 - DNA, 20 bp, Artificial
  CRISPR gRNA sequence
ctcttggtgttgtacattct

SEQ ID NO: 23428 - DNA, 20 bp, Artificial
  CRISPR gRNA sequence
ttggtgttgtacattctgtg

SEQ ID NO: 23429 - DNA, 20 bp, Artificial
  CRISPR gRNA sequence
ggtgttgtacattctgtggg

SEQ ID NO: 23430 - DNA, 20 bp, Artificial
  CRISPR gRNA sequence
gtgttgtacattctgtgggt

SEQ ID NO: 23431 - DNA, 20 bp, Artificial
  CRISPR gRNA sequence
tacattctgtgggtttggac

SEQ ID NO: 23432 - DNA, 20 bp, Artificial
  CRISPR gRNA sequence
tgtgggtttggacagataca

SEQ ID NO: 23433 - DNA, 20 bp, Artificial
  CRISPR gRNA sequence
tgggtttggacagatacatg

SEQ ID NO: 23434 - DNA, 20 bp, Artificial
  CRISPR gRNA sequence
ggacagatacatgatgtaat

SEQ ID NO: 23435 - DNA, 20 bp, Artificial
  CRISPR gRNA sequence
gacagatacatgatgtaatg

SEQ ID NO: 23436 - DNA, 20 bp, Artificial
  CRISPR gRNA sequence
tagtatcacacagactcatt

SEQ ID NO: 23437 - DNA, 20 bp, Artificial
  CRISPR gRNA sequence
atttcacttgtgactgagct

SEQ ID NO: 23438 - DNA, 20 bp, Artificial
  CRISPR gRNA sequence
cacttgtgactgagcttgtc

SEQ ID NO: 23439 - DNA, 20 bp, Artificial
  CRISPR gRNA sequence
acttgtgactgagcttgtcc

SEQ ID NO: 23440 - DNA, 20 bp, Artificial
  CRISPR gRNA sequence
gtgactgagcttgtccttct

SEQ ID NO: 23441 - DNA, 20 bp, Artificial
  CRISPR gRNA sequence
tgactgagcttgtccttctt

SEQ ID NO: 23442 - DNA, 20 bp, Artificial
  CRISPR gRNA sequence
agcttgtccttctttcttta

SEQ ID NO: 23443 - DNA, 20 bp, Artificial
  CRISPR gRNA sequence
gtccttctttctttaacctg

SEQ ID NO: 23444 - DNA, 20 bp, Artificial
  CRISPR gRNA sequence
tccttctttctttaacctgc

SEQ ID NO: 23445 - DNA, 20 bp, Artificial
  CRISPR gRNA sequence
ctttctttaacctgcctcca

SEQ ID NO: 23446 - DNA, 20 bp, Artificial
  CRISPR gRNA sequence
tttctttaacctgcctccaa

SEQ ID NO: 23447 - DNA, 20 bp, Artificial
  CRISPR gRNA sequence
tctttaacctgcctccaact

SEQ ID NO: 23448 - DNA, 20 bp, Artificial
  CRISPR gRNA sequence
ctttaacctgcctccaactg

SEQ ID NO: 23449 - DNA, 20 bp, Artificial
  CRISPR gRNA sequence
tttaacctgcctccaactgc

SEQ ID NO: 23450 - DNA, 20 bp, Artificial
  CRISPR gRNA sequence
taacctgcctccaactgctg

SEQ ID NO: 23451 - DNA, 20 bp, Artificial
  CRISPR gRNA sequence
aacctgcctccaactgctga

SEQ ID NO: 23452 - DNA, 20 bp, Artificial
  CRISPR gRNA sequence
acctgcctccaactgctgag

SEQ ID NO: 23453 - DNA, 20 bp, Artificial
  CRISPR gRNA sequence
cctccaactgctgagaagcc

SEQ ID NO: 23454 - DNA, 20 bp, Artificial
  CRISPR gRNA sequence
caactgctgagaagcccttt

SEQ ID NO: 23455 - DNA, 20 bp, Artificial
  CRISPR gRNA sequence
ctgagaagccctttggctag

SEQ ID NO: 23456 - DNA, 20 bp, Artificial
  CRISPR gRNA sequence
agaagccctttggctaggga

SEQ ID NO: 23457 - DNA, 20 bp, Artificial
  CRISPR gRNA sequence
tggctagggattgcagccaa

SEQ ID NO: 23458 - DNA, 20 bp, Artificial
  CRISPR gRNA sequence
ggctagggattgcagccaat

SEQ ID NO: 23459 - DNA, 20 bp, Artificial
  CRISPR gRNA sequence
gctagggattgcagccaatt

SEQ ID NO: 23460 - DNA, 20 bp, Artificial
  CRISPR gRNA sequence
gggattgcagccaattttaa

SEQ ID NO: 23461 - DNA, 20 bp, Artificial
  CRISPR gRNA sequence
cagccaattttaatttgttt

SEQ ID NO: 23462 - DNA, 20 bp, Artificial
  CRISPR gRNA sequence
taatttgttttccactttcc

SEQ ID NO: 23463 - DNA, 20 bp, Artificial
  CRISPR gRNA sequence
aatttgttttccactttcct

SEQ ID NO: 23464 - DNA, 20 bp, Artificial
  CRISPR gRNA sequence
atttgttttccactttcctg

SEQ ID NO: 23465 - DNA, 20 bp, Artificial
  CRISPR gRNA sequence
gttttccactttcctgctct

SEQ ID NO: 23466 - DNA, 20 bp, Artificial
  CRISPR gRNA sequence
ttttccactttcctgctctg

SEQ ID NO: 23467 - DNA, 20 bp, Artificial
  CRISPR gRNA sequence
tccactttcctgctctgaag

SEQ ID NO: 23468 - DNA, 20 bp, Artificial
  CRISPR gRNA sequence
ccactttcctgctctgaagt

SEQ ID NO: 23469 - DNA, 20 bp, Artificial
  CRISPR gRNA sequence
cactttcctgctctgaagtt

SEQ ID NO: 23470 - DNA, 20 bp, Artificial
  CRISPR gRNA sequence
tcctgctctgaagttacttt

SEQ ID NO: 23471 - DNA, 20 bp, Artificial
  CRISPR gRNA sequence
cctgctctgaagttactttg

SEQ ID NO: 23472 - DNA, 20 bp, Artificial
  CRISPR gRNA sequence
ctgctctgaagttactttgt

SEQ ID NO: 23473 - DNA, 20 bp, Artificial
  CRISPR gRNA sequence
ctctgaagttactttgtttg

SEQ ID NO: 23474 - DNA, 20 bp, Artificial
  CRISPR gRNA sequence
tgaagttactttgtttgcca

SEQ ID NO: 23475 - DNA, 20 bp, Artificial
  CRISPR gRNA sequence
aagttactttgtttgccaga

SEQ ID NO: 23476 - DNA, 20 bp, Artificial
  CRISPR gRNA sequence
ctttgtttgccagaggctgg

SEQ ID NO: 23477 - DNA, 20 bp, Artificial
  CRISPR gRNA sequence
tgtttgccagaggctggttg

SEQ ID NO: 23478 - DNA, 20 bp, Artificial
  CRISPR gRNA sequence
gtttgccagaggctggttgg

SEQ ID NO: 23479 - DNA, 20 bp, Artificial
  CRISPR gRNA sequence
tttgccagaggctggttggt

SEQ ID NO: 23480 - DNA, 20 bp, Artificial
  CRISPR gRNA sequence
gccagaggctggttggttca

SEQ ID NO: 23481 - DNA, 20 bp, Artificial
  CRISPR gRNA sequence
ccagaggctggttggttcaa

SEQ ID NO: 23482 - DNA, 20 bp, Artificial
  CRISPR gRNA sequence
gttggttcaaacccaaaggg

SEQ ID NO: 23483 - DNA, 20 bp, Artificial
  CRISPR gRNA sequence
gttcaaacccaaagggcagg

SEQ ID NO: 23484 - DNA, 20 bp, Artificial
  CRISPR gRNA sequence
aaacccaaagggcagggagc

SEQ ID NO: 23485 - DNA, 20 bp, Artificial
  CRISPR gRNA sequence
caatggaaatccattcaacg

SEQ ID NO: 23486 - DNA, 20 bp, Artificial
  CRISPR gRNA sequence
aacggtgctggaattgggat

SEQ ID NO: 23487 - DNA, 20 bp, Artificial
  CRISPR gRNA sequence
gaattgggatggcaaaaagg

SEQ ID NO: 23488 - DNA, 20 bp, Artificial
  CRISPR gRNA sequence
ggatggcaaaaaggagcagc

SEQ ID NO: 23489 - DNA, 20 bp, Artificial
  CRISPR gRNA sequence
tttgcatcccacagttccca

SEQ ID NO: 23490 - DNA, 20 bp, Artificial
  CRISPR gRNA sequence
tgcatcccacagttcccagg

SEQ ID NO: 23491 - DNA, 20 bp, Artificial
  CRISPR gRNA sequence
gcatcccacagttcccaggg

SEQ ID NO: 23492 - DNA, 20 bp, Artificial
  CRISPR gRNA sequence
catcccacagttcccaggga

SEQ ID NO: 23493 - DNA, 20 bp, Artificial
  CRISPR gRNA sequence
ccagggagcttaccattctt

SEQ ID NO: 23494 - DNA, 20 bp, Artificial
  CRISPR gRNA sequence
accattctttcattcattca

SEQ ID NO: 23495 - DNA, 20 bp, Artificial
  CRISPR gRNA sequence
ccattctttcattcattcat

SEQ ID NO: 23496 - DNA, 20 bp, Artificial
  CRISPR gRNA sequence
tttcattcattcattcatcc

SEQ ID NO: 23497 - DNA, 20 bp, Artificial
  CRISPR gRNA sequence
tcattcattcattcatcctt

SEQ ID NO: 23498 - DNA, 20 bp, Artificial
  CRISPR gRNA sequence
cattcattcattcatccttt

SEQ ID NO: 23499 - DNA, 20 bp, Artificial
  CRISPR gRNA sequence
attcattcattcatcctttc

SEQ ID NO: 23500 - DNA, 20 bp, Artificial
  CRISPR gRNA sequence
attcattcatcctttcattt

SEQ ID NO: 23501 - DNA, 20 bp, Artificial
  CRISPR gRNA sequence
attcatcctttcatttatga

SEQ ID NO: 23502 - DNA, 20 bp, Artificial
  CRISPR gRNA sequence
atcctttcatttatgagaca

SEQ ID NO: 23503 - DNA, 20 bp, Artificial
  CRISPR gRNA sequence
tcatttatgagacaaagtct

SEQ ID NO: 23504 - DNA, 20 bp, Artificial
  CRISPR gRNA sequence
catttatgagacaaagtctc

SEQ ID NO: 23505 - DNA, 20 bp, Artificial
  CRISPR gRNA sequence
atttatgagacaaagtctca

SEQ ID NO: 23506 - DNA, 20 bp, Artificial
  CRISPR gRNA sequence
atgagacaaagtctcactct

SEQ ID NO: 23507 - DNA, 20 bp, Artificial
  CRISPR gRNA sequence
tgagacaaagtctcactctg

SEQ ID NO: 23508 - DNA, 20 bp, Artificial
  CRISPR gRNA sequence
actctgttgcccaggttgga

SEQ ID NO: 23509 - DNA, 20 bp, Artificial
  CRISPR gRNA sequence
tgttgcccaggttggagtgc

SEQ ID NO: 23510 - DNA, 20 bp, Artificial
  CRISPR gRNA sequence
ttgcccaggttggagtgcag

SEQ ID NO: 23511 - DNA, 20 bp, Artificial
  CRISPR gRNA sequence
cccaggttggagtgcagtgg

SEQ ID NO: 23512 - DNA, 20 bp, Artificial
  CRISPR gRNA sequence
gagtgcagtggcacagtcat

SEQ ID NO: 23513 - DNA, 20 bp, Artificial
  CRISPR gRNA sequence
ctcactgcagcctcaagctc

SEQ ID NO: 23514 - DNA, 20 bp, Artificial
  CRISPR gRNA sequence
actgcagcctcaagctcctg

SEQ ID NO: 23515 - DNA, 20 bp, Artificial
  CRISPR gRNA sequence
cagcctcaagctcctgagct

SEQ ID NO: 23516 - DNA, 20 bp, Artificial
  CRISPR gRNA sequence
aagctcctgagctcaagcca

SEQ ID NO: 23517 - DNA, 20 bp, Artificial
  CRISPR gRNA sequence
ctgagctcaagccatcctcc

SEQ ID NO: 23518 - DNA, 20 bp, Artificial
  CRISPR gRNA sequence
agctcaagccatcctcctgc

SEQ ID NO: 23519 - DNA, 20 bp, Artificial
  CRISPR gRNA sequence
aagccatcctcctgcctcag

SEQ ID NO: 23520 - DNA, 20 bp, Artificial
  CRISPR gRNA sequence
ctgcctcagcctcccaagta

SEQ ID NO: 23521 - DNA, 20 bp, Artificial
  CRISPR gRNA sequence
cctcagcctcccaagtagcc

SEQ ID NO: 23522 - DNA, 20 bp, Artificial
  CRISPR gRNA sequence
agcctcccaagtagccgaga

SEQ ID NO: 23523 - DNA, 20 bp, Artificial
  CRISPR gRNA sequence
ccaagtagccgagactacaa

SEQ ID NO: 23524 - DNA, 20 bp, Artificial
  CRISPR gRNA sequence
caagggcactccaccacacc

SEQ ID NO: 23525 - DNA, 20 bp, Artificial
  CRISPR gRNA sequence
caccacacccagctaatttt

SEQ ID NO: 23526 - DNA, 20 bp, Artificial
  CRISPR gRNA sequence
atttttgtatcttttatttc

SEQ ID NO: 23527 - DNA, 20 bp, Artificial
  CRISPR gRNA sequence
ttgtatcttttatttctgaa

SEQ ID NO: 23528 - DNA, 20 bp, Artificial
  CRISPR gRNA sequence
tgtatcttttatttctgaag

SEQ ID NO: 23529 - DNA, 20 bp, Artificial
  CRISPR gRNA sequence
gtatcttttatttctgaaga

SEQ ID NO: 23530 - DNA, 20 bp, Artificial
  CRISPR gRNA sequence
tatcttttatttctgaagag

SEQ ID NO: 23531 - DNA, 20 bp, Artificial
  CRISPR gRNA sequence
ttatttctgaagagatgggg

SEQ ID NO: 23532 - DNA, 20 bp, Artificial
  CRISPR gRNA sequence
tatttctgaagagatggggt

SEQ ID NO: 23533 - DNA, 20 bp, Artificial
  CRISPR gRNA sequence
atttctgaagagatggggtt

SEQ ID NO: 23534 - DNA, 20 bp, Artificial
  CRISPR gRNA sequence
tttctgaagagatggggttt

SEQ ID NO: 23535 - DNA, 20 bp, Artificial
  CRISPR gRNA sequence
ctgaagagatggggtttcac

SEQ ID NO: 23536 - DNA, 20 bp, Artificial
  CRISPR gRNA sequence
tgaagagatggggtttcact

SEQ ID NO: 23537 - DNA, 20 bp, Artificial
  CRISPR gRNA sequence
aagagatggggtttcactat

SEQ ID NO: 23538 - DNA, 20 bp, Artificial
  CRISPR gRNA sequence
cactatgttgcccaggctgg

SEQ ID NO: 23539 - DNA, 20 bp, Artificial
  CRISPR gRNA sequence
actatgttgcccaggctggt

SEQ ID NO: 23540 - DNA, 20 bp, Artificial
  CRISPR gRNA sequence
tgttgcccaggctggtctca

SEQ ID NO: 23541 - DNA, 20 bp, Artificial
  CRISPR gRNA sequence
cccaggctggtctcaaactc

SEQ ID NO: 23542 - DNA, 20 bp, Artificial
  CRISPR gRNA sequence
gtctcaaactcctggcctca

SEQ ID NO: 23543 - DNA, 20 bp, Artificial
  CRISPR gRNA sequence
aaactcctggcctcaagtca

SEQ ID NO: 23544 - DNA, 20 bp, Artificial
  CRISPR gRNA sequence
ctggcctcaagtcatcctcc

SEQ ID NO: 23545 - DNA, 20 bp, Artificial
  CRISPR gRNA sequence
gcctcaagtcatcctccctc

SEQ ID NO: 23546 - DNA, 20 bp, Artificial
  CRISPR gRNA sequence
aagtcatcctccctcctcag

SEQ ID NO: 23547 - DNA, 20 bp, Artificial
  CRISPR gRNA sequence
cctcctcagcctcccaaagt

SEQ ID NO: 23548 - DNA, 20 bp, Artificial
  CRISPR gRNA sequence
ctcagcctcccaaagtgctg

SEQ ID NO: 23549 - DNA, 20 bp, Artificial
  CRISPR gRNA sequence
agcctcccaaagtgctggga

SEQ ID NO: 23550 - DNA, 20 bp, Artificial
  CRISPR gRNA sequence
ccaaagtgctgggattacag

SEQ ID NO: 23551 - DNA, 20 bp, Artificial
  CRISPR gRNA sequence
ggattacaggtgtgatctca

SEQ ID NO: 23552 - DNA, 20 bp, Artificial
  CRISPR gRNA sequence
caggtgtgatctcagacagc

SEQ ID NO: 23553 - DNA, 20 bp, Artificial
  CRISPR gRNA sequence
agacagcttacctcttaatc

SEQ ID NO: 23554 - DNA, 20 bp, Artificial
  CRISPR gRNA sequence
acctcttaatcacctttcca

SEQ ID NO: 23555 - DNA, 20 bp, Artificial
  CRISPR gRNA sequence
cctcttaatcacctttccat

SEQ ID NO: 23556 - DNA, 20 bp, Artificial
  CRISPR gRNA sequence
ttaatcacctttccatctga

SEQ ID NO: 23557 - DNA, 20 bp, Artificial
  CRISPR gRNA sequence
aatcacctttccatctgagc

SEQ ID NO: 23558 - DNA, 20 bp, Artificial
  CRISPR gRNA sequence
atcacctttccatctgagct

SEQ ID NO: 23559 - DNA, 20 bp, Artificial
  CRISPR gRNA sequence
tccatctgagctggcagcag

SEQ ID NO: 23560 - DNA, 20 bp, Artificial
  CRISPR gRNA sequence
ccatctgagctggcagcaga

SEQ ID NO: 23561 - DNA, 20 bp, Artificial
  CRISPR gRNA sequence
catctgagctggcagcagag

SEQ ID NO: 23562 - DNA, 20 bp, Artificial
  CRISPR gRNA sequence
agctggcagcagagctggga

SEQ ID NO: 23563 - DNA, 20 bp, Artificial
  CRISPR gRNA sequence
gcagcagagctgggaaagtg

SEQ ID NO: 23564 - DNA, 20 bp, Artificial
  CRISPR gRNA sequence
ggaaagtgcacccaacaccc

SEQ ID NO: 23565 - DNA, 20 bp, Artificial
  CRISPR gRNA sequence
caactttagtgcttcctgct

SEQ ID NO: 23566 - DNA, 20 bp, Artificial
  CRISPR gRNA sequence
tagtgcttcctgctccttct

SEQ ID NO: 23567 - DNA, 20 bp, Artificial
  CRISPR gRNA sequence
agtgcttcctgctccttctc

SEQ ID NO: 23568 - DNA, 20 bp, Artificial
  CRISPR gRNA sequence
gtgcttcctgctccttctct

SEQ ID NO: 23569 - DNA, 20 bp, Artificial
  CRISPR gRNA sequence
cctgctccttctctgtgtgg

SEQ ID NO: 23570 - DNA, 20 bp, Artificial
  CRISPR gRNA sequence
ctgctccttctctgtgtgga

SEQ ID NO: 23571 - DNA, 20 bp, Artificial
  CRISPR gRNA sequence
ctccttctctgtgtggaact

SEQ ID NO: 23572 - DNA, 20 bp, Artificial
  CRISPR gRNA sequence
cttctctgtgtggaactggc

SEQ ID NO: 23573 - DNA, 20 bp, Artificial
  CRISPR gRNA sequence
ctctgtgtggaactggcctg

SEQ ID NO: 23574 - DNA, 20 bp, Artificial
  CRISPR gRNA sequence
tctgtgtggaactggcctgt

SEQ ID NO: 23575 - DNA, 20 bp, Artificial
  CRISPR gRNA sequence
tgtgtggaactggcctgttt

SEQ ID NO: 23576 - DNA, 20 bp, Artificial
  CRISPR gRNA sequence
tgtggaactggcctgtttgg

SEQ ID NO: 23577 - DNA, 20 bp, Artificial
  CRISPR gRNA sequence
gcctgtttgggtacccaggg

SEQ ID NO: 23578 - DNA, 20 bp, Artificial
  CRISPR gRNA sequence
tttgggtacccagggccagt

SEQ ID NO: 23579 - DNA, 20 bp, Artificial
  CRISPR gRNA sequence
gggtacccagggccagtccc

SEQ ID NO: 23580 - DNA, 20 bp, Artificial
  CRISPR gRNA sequence
ggtacccagggccagtcccc

SEQ ID NO: 23581 - DNA, 20 bp, Artificial
  CRISPR gRNA sequence
caagaccctctgtagaaaaa

SEQ ID NO: 23582 - DNA, 20 bp, Artificial
  CRISPR gRNA sequence
tgtagaaaaagaccctactg

SEQ ID NO: 23583 - DNA, 20 bp, Artificial
  CRISPR gRNA sequence
tagaaaaagaccctactgta

SEQ ID NO: 23584 - DNA, 20 bp, Artificial
  CRISPR gRNA sequence
ctgtacacctcaattccatt

SEQ ID NO: 23585 - DNA, 20 bp, Artificial
  CRISPR gRNA sequence
tacacctcaattccattgca

SEQ ID NO: 23586 - DNA, 20 bp, Artificial
  CRISPR gRNA sequence
aattccattgcaggacagga

SEQ ID NO: 23587 - DNA, 20 bp, Artificial
  CRISPR gRNA sequence
cattgcaggacaggacataa

SEQ ID NO: 23588 - DNA, 20 bp, Artificial
  CRISPR gRNA sequence
caggacaggacataattgaa

SEQ ID NO: 23589 - DNA, 20 bp, Artificial
  CRISPR gRNA sequence
aatcctgcctctccctgccc

SEQ ID NO: 23590 - DNA, 20 bp, Artificial
  CRISPR gRNA sequence
cctctccctgccccagtcac

SEQ ID NO: 23591 - DNA, 20 bp, Artificial
  CRISPR gRNA sequence
tccctgccccagtcacccat

SEQ ID NO: 23592 - DNA, 20 bp, Artificial
  CRISPR gRNA sequence
cctgccccagtcacccatcc

SEQ ID NO: 23593 - DNA, 20 bp, Artificial
  CRISPR gRNA sequence
ccccagtcacccatccctcc

SEQ ID NO: 23594 - DNA, 20 bp, Artificial
  CRISPR gRNA sequence
ccaagccattatcttgggac

SEQ ID NO: 23595 - DNA, 20 bp, Artificial
  CRISPR gRNA sequence
tcttgggacctgcaagggcc

SEQ ID NO: 23596 - DNA, 20 bp, Artificial
  CRISPR gRNA sequence
gggacctgcaagggcctcca

SEQ ID NO: 23597 - DNA, 20 bp, Artificial
  CRISPR gRNA sequence
ggacctgcaagggcctccaa

SEQ ID NO: 23598 - DNA, 20 bp, Artificial
  CRISPR gRNA sequence
caagggcctccaagccaagg

SEQ ID NO: 23599 - DNA, 20 bp, Artificial
  CRISPR gRNA sequence
caagccaagggtggcaaatc

SEQ ID NO: 23600 - DNA, 20 bp, Artificial
  CRISPR gRNA sequence
tggtaacaattgtgtgtact

SEQ ID NO: 23601 - DNA, 20 bp, Artificial
  CRISPR gRNA sequence
gtaacaattgtgtgtactct

SEQ ID NO: 23602 - DNA, 20 bp, Artificial
  CRISPR gRNA sequence
tgtgtactctatatagagac

SEQ ID NO: 23603 - DNA, 20 bp, Artificial
  CRISPR gRNA sequence
tatatagagacattgtgatg

SEQ ID NO: 23604 - DNA, 20 bp, Artificial
  CRISPR gRNA sequence
tatagagacattgtgatggt

SEQ ID NO: 23605 - DNA, 20 bp, Artificial
  CRISPR gRNA sequence
tgatggtgatttagacacac

SEQ ID NO: 23606 - DNA, 20 bp, Artificial
  CRISPR gRNA sequence
agacacacacacacttatat

SEQ ID NO: 23607 - DNA, 20 bp, Artificial
  CRISPR gRNA sequence
gacacacacacacttatatt

SEQ ID NO: 23608 - DNA, 20 bp, Artificial
  CRISPR gRNA sequence
atattggcttgggaaacaaa

SEQ ID NO: 23609 - DNA, 20 bp, Artificial
  CRISPR gRNA sequence
tattggcttgggaaacaaaa

SEQ ID NO: 23610 - DNA, 20 bp, Artificial
  CRISPR gRNA sequence
gcttgggaaacaaaacaaat

SEQ ID NO: 23611 - DNA, 20 bp, Artificial
  CRISPR gRNA sequence
gggaaacaaaacaaataggc

SEQ ID NO: 23612 - DNA, 20 bp, Artificial
  CRISPR gRNA sequence
ggaaacaaaacaaataggcc

SEQ ID NO: 23613 - DNA, 20 bp, Artificial
  CRISPR gRNA sequence
tcgactggattcaacttttg

SEQ ID NO: 23614 - DNA, 20 bp, Artificial
  CRISPR gRNA sequence
gattcaacttttgattttgc

SEQ ID NO: 23615 - DNA, 20 bp, Artificial
  CRISPR gRNA sequence
aacttttgattttgcagcca

SEQ ID NO: 23616 - DNA, 20 bp, Artificial
  CRISPR gRNA sequence
ttgattttgcagccaagccc

SEQ ID NO: 23617 - DNA, 20 bp, Artificial
  CRISPR gRNA sequence
tgattttgcagccaagcccc

SEQ ID NO: 23618 - DNA, 20 bp, Artificial
  CRISPR gRNA sequence
gattttgcagccaagcccct

SEQ ID NO: 23619 - DNA, 20 bp, Artificial
  CRISPR gRNA sequence
attttgcagccaagcccctg

SEQ ID NO: 23620 - DNA, 20 bp, Artificial
  CRISPR gRNA sequence
tgcagccaagcccctgtggc

SEQ ID NO: 23621 - DNA, 20 bp, Artificial
  CRISPR gRNA sequence
gcagccaagcccctgtggca

SEQ ID NO: 23622 - DNA, 20 bp, Artificial
  CRISPR gRNA sequence
cagccaagcccctgtggcac

SEQ ID NO: 23623 - DNA, 20 bp, Artificial
  CRISPR gRNA sequence
tggcacagctgaggagcttg

SEQ ID NO: 23624 - DNA, 20 bp, Artificial
  CRISPR gRNA sequence
aggagcttgcaggtcagaaa

SEQ ID NO: 23625 - DNA, 20 bp, Artificial
  CRISPR gRNA sequence
gcaggtcagaaaggggattt

SEQ ID NO: 23626 - DNA, 20 bp, Artificial
  CRISPR gRNA sequence
caggtcagaaaggggattta

SEQ ID NO: 23627 - DNA, 20 bp, Artificial
  CRISPR gRNA sequence
agagccaaccaatagcaata

SEQ ID NO: 23628 - DNA, 20 bp, Artificial
  CRISPR gRNA sequence
gagccaaccaatagcaatat

SEQ ID NO: 23629 - DNA, 20 bp, Artificial
  CRISPR gRNA sequence
cagacctctcctgacacgaa

SEQ ID NO: 23630 - DNA, 20 bp, Artificial
  CRISPR gRNA sequence
tcctgacacgaagctcatct

SEQ ID NO: 23631 - DNA, 20 bp, Artificial
  CRISPR gRNA sequence
ctgacacgaagctcatctga

SEQ ID NO: 23632 - DNA, 20 bp, Artificial
  CRISPR gRNA sequence
acacgaagctcatctgacct

SEQ ID NO: 23633 - DNA, 20 bp, Artificial
  CRISPR gRNA sequence
atctgacctcctgcccccat

SEQ ID NO: 23634 - DNA, 20 bp, Artificial
  CRISPR gRNA sequence
acctcctgcccccattacac

SEQ ID NO: 23635 - DNA, 20 bp, Artificial
  CRISPR gRNA sequence
ctgcccccattacacacata

SEQ ID NO: 23636 - DNA, 20 bp, Artificial
  CRISPR gRNA sequence
cccccattacacacatacac

SEQ ID NO: 23637 - DNA, 20 bp, Artificial
  CRISPR gRNA sequence
cacacatacacatgcacaca

SEQ ID NO: 23638 - DNA, 20 bp, Artificial
  CRISPR gRNA sequence
ctagtctccctgccttgagg

SEQ ID NO: 23639 - DNA, 20 bp, Artificial
  CRISPR gRNA sequence
tagtctccctgccttgagga

SEQ ID NO: 23640 - DNA, 20 bp, Artificial
  CRISPR gRNA sequence
gtctccctgccttgaggaca

SEQ ID NO: 23641 - DNA, 20 bp, Artificial
  CRISPR gRNA sequence
cctgccttgaggacaaatga

SEQ ID NO: 23642 - DNA, 20 bp, Artificial
  CRISPR gRNA sequence
ccttgaggacaaatgatcag

SEQ ID NO: 23643 - DNA, 20 bp, Artificial
  CRISPR gRNA sequence
gaggacaaatgatcagatcc

SEQ ID NO: 23644 - DNA, 20 bp, Artificial
  CRISPR gRNA sequence
aggacaaatgatcagatcct

SEQ ID NO: 23645 - DNA, 20 bp, Artificial
  CRISPR gRNA sequence
caactgtttccaggcccata

SEQ ID NO: 23646 - DNA, 20 bp, Artificial
  CRISPR gRNA sequence
tttccaggcccataagcccc

SEQ ID NO: 23647 - DNA, 20 bp, Artificial
  CRISPR gRNA sequence
ccaggcccataagcccctga

SEQ ID NO: 23648 - DNA, 20 bp, Artificial
  CRISPR gRNA sequence
caggcccataagcccctgag

SEQ ID NO: 23649 - DNA, 20 bp, Artificial
  CRISPR gRNA sequence
agcattgcagtgttgctaca

SEQ ID NO: 23650 - DNA, 20 bp, Artificial
  CRISPR gRNA sequence
cagtgttgctacatgcctta

SEQ ID NO: 23651 - DNA, 20 bp, Artificial
  CRISPR gRNA sequence
ctacatgccttagtttcctc

SEQ ID NO: 23652 - DNA, 20 bp, Artificial
  CRISPR gRNA sequence
catgccttagtttcctctcc

SEQ ID NO: 23653 - DNA, 20 bp, Artificial
  CRISPR gRNA sequence
agtttcctctccgtctcctg

SEQ ID NO: 23654 - DNA, 20 bp, Artificial
  CRISPR gRNA sequence
gtttcctctccgtctcctgt

SEQ ID NO: 23655 - DNA, 20 bp, Artificial
  CRISPR gRNA sequence
cctctccgtctcctgtgacc

SEQ ID NO: 23656 - DNA, 20 bp, Artificial
  CRISPR gRNA sequence
ctctccgtctcctgtgacct

SEQ ID NO: 23657 - DNA, 20 bp, Artificial
  CRISPR gRNA sequence
tccgtctcctgtgacctcct

SEQ ID NO: 23658 - DNA, 20 bp, Artificial
  CRISPR gRNA sequence
cgtctcctgtgacctcctcg

SEQ ID NO: 23659 - DNA, 20 bp, Artificial
  CRISPR gRNA sequence
ctgtgacctcctcgtgccac

SEQ ID NO: 23660 - DNA, 20 bp, Artificial
  CRISPR gRNA sequence
tgacctcctcgtgccactcc

SEQ ID NO: 23661 - DNA, 20 bp, Artificial
  CRISPR gRNA sequence
ctcgtgccactccaggaagt

SEQ ID NO: 23662 - DNA, 20 bp, Artificial
  CRISPR gRNA sequence
gtgccactccaggaagtgaa

SEQ ID NO: 23663 - DNA, 20 bp, Artificial
  CRISPR gRNA sequence
caggaagtgaaagtcttgag

SEQ ID NO: 23664 - DNA, 20 bp, Artificial
  CRISPR gRNA sequence
gagtgagaccagtagtttct

SEQ ID NO: 23665 - DNA, 20 bp, Artificial
  CRISPR gRNA sequence
agtgagaccagtagtttctc

SEQ ID NO: 23666 - DNA, 20 bp, Artificial
  CRISPR gRNA sequence
ctcttaagtcctctctctgt

SEQ ID NO: 23667 - DNA, 20 bp, Artificial
  CRISPR gRNA sequence
tcttaagtcctctctctgtc

SEQ ID NO: 23668 - DNA, 20 bp, Artificial
  CRISPR gRNA sequence
ttaagtcctctctctgtctc

SEQ ID NO: 23669 - DNA, 20 bp, Artificial
  CRISPR gRNA sequence
aagtcctctctctgtctcgt

SEQ ID NO: 23670 - DNA, 20 bp, Artificial
  CRISPR gRNA sequence
agtcctctctctgtctcgtt

SEQ ID NO: 23671 - DNA, 20 bp, Artificial
  CRISPR gRNA sequence
tctctgtctcgttctcctgg

SEQ ID NO: 23672 - DNA, 20 bp, Artificial
  CRISPR gRNA sequence
tctgtctcgttctcctggga

SEQ ID NO: 23673 - DNA, 20 bp, Artificial
  CRISPR gRNA sequence
tgtctcgttctcctgggata

SEQ ID NO: 23674 - DNA, 20 bp, Artificial
  CRISPR gRNA sequence
tctcgttctcctgggatatc

SEQ ID NO: 23675 - DNA, 20 bp, Artificial
  CRISPR gRNA sequence
gttctcctgggatatctaca

SEQ ID NO: 23676 - DNA, 20 bp, Artificial
  CRISPR gRNA sequence
tcctgggatatctacacttg

SEQ ID NO: 23677 - DNA, 20 bp, Artificial
  CRISPR gRNA sequence
ctgggatatctacacttggt

SEQ ID NO: 23678 - DNA, 20 bp, Artificial
  CRISPR gRNA sequence
ggatatctacacttggtttg

SEQ ID NO: 23679 - DNA, 20 bp, Artificial
  CRISPR gRNA sequence
cacttggtttgcaaacagca

SEQ ID NO: 23680 - DNA, 20 bp, Artificial
  CRISPR gRNA sequence
ggtttgcaaacagcaggctg

SEQ ID NO: 23681 - DNA, 20 bp, Artificial
  CRISPR gRNA sequence
gtttgcaaacagcaggctgg

SEQ ID NO: 23682 - DNA, 20 bp, Artificial
  CRISPR gRNA sequence
gcaaacagcaggctggagag

SEQ ID NO: 23683 - DNA, 20 bp, Artificial
  CRISPR gRNA sequence
caaacagcaggctggagagt

SEQ ID NO: 23684 - DNA, 20 bp, Artificial
  CRISPR gRNA sequence
gagagtgaggggcttcttcc

SEQ ID NO: 23685 - DNA, 20 bp, Artificial
  CRISPR gRNA sequence
cttcctctacatccagctcc

SEQ ID NO: 23686 - DNA, 20 bp, Artificial
  CRISPR gRNA sequence
ttcctctacatccagctcct

SEQ ID NO: 23687 - DNA, 20 bp, Artificial
  CRISPR gRNA sequence
cctctacatccagctcctcc

SEQ ID NO: 23688 - DNA, 20 bp, Artificial
  CRISPR gRNA sequence
ctctacatccagctcctccc

SEQ ID NO: 23689 - DNA, 20 bp, Artificial
  CRISPR gRNA sequence
tacatccagctcctccccca

SEQ ID NO: 23690 - DNA, 20 bp, Artificial
  CRISPR gRNA sequence
catccagctcctcccccatc

SEQ ID NO: 23691 - DNA, 20 bp, Artificial
  CRISPR gRNA sequence
ctcccccatcctgctccaag

SEQ ID NO: 23692 - DNA, 20 bp, Artificial
  CRISPR gRNA sequence
ccccatcctgctccaagtcc

SEQ ID NO: 23693 - DNA, 20 bp, Artificial
  CRISPR gRNA sequence
ctccaagtccagcatgttcc

SEQ ID NO: 23694 - DNA, 20 bp, Artificial
  CRISPR gRNA sequence
caagtccagcatgttcctat

SEQ ID NO: 23695 - DNA, 20 bp, Artificial
  CRISPR gRNA sequence
ctatctcttccccaggaccc

SEQ ID NO: 23696 - DNA, 20 bp, Artificial
  CRISPR gRNA sequence
tctcttccccaggaccctgg

SEQ ID NO: 23697 - DNA, 20 bp, Artificial
  CRISPR gRNA sequence
ttccccaggaccctgggctc

SEQ ID NO: 23698 - DNA, 20 bp, Artificial
  CRISPR gRNA sequence
ccccaggaccctgggctctt

SEQ ID NO: 23699 - DNA, 20 bp, Artificial
  CRISPR gRNA sequence
cccaggaccctgggctcttg

SEQ ID NO: 23700 - DNA, 20 bp, Artificial
  CRISPR gRNA sequence
ggctcttgggcacaaatcaa

SEQ ID NO: 23701 - DNA, 20 bp, Artificial
  CRISPR gRNA sequence
ttgggcacaaatcaagccat

SEQ ID NO: 23702 - DNA, 20 bp, Artificial
  CRISPR gRNA sequence
gggcacaaatcaagccatca

SEQ ID NO: 23703 - DNA, 20 bp, Artificial
  CRISPR gRNA sequence
ggcacaaatcaagccatcac

SEQ ID NO: 23704 - DNA, 20 bp, Artificial
  CRISPR gRNA sequence
tggggtggcaagagcagagg

SEQ ID NO: 23705 - DNA, 20 bp, Artificial
  CRISPR gRNA sequence
gtttctttgtgaacatctat

SEQ ID NO: 23706 - DNA, 20 bp, Artificial
  CRISPR gRNA sequence
tttctttgtgaacatctata

SEQ ID NO: 23707 - DNA, 20 bp, Artificial
  CRISPR gRNA sequence
ctttgtgaacatctataggt

SEQ ID NO: 23708 - DNA, 20 bp, Artificial
  CRISPR gRNA sequence
tttgtgaacatctataggta

SEQ ID NO: 23709 - DNA, 20 bp, Artificial
  CRISPR gRNA sequence
tgtgaacatctataggtacc

SEQ ID NO: 23710 - DNA, 20 bp, Artificial
  CRISPR gRNA sequence
gtgaacatctataggtacca

SEQ ID NO: 23711 - DNA, 20 bp, Artificial
  CRISPR gRNA sequence
tgaacatctataggtaccag

SEQ ID NO: 23712 - DNA, 20 bp, Artificial
  CRISPR gRNA sequence
taggtaccaggctctgtgca

SEQ ID NO: 23713 - DNA, 20 bp, Artificial
  CRISPR gRNA sequence
tgtgcaggccctattgttgg

SEQ ID NO: 23714 - DNA, 20 bp, Artificial
  CRISPR gRNA sequence
tgcaggccctattgttggtg

SEQ ID NO: 23715 - DNA, 20 bp, Artificial
  CRISPR gRNA sequence
ttgttggtgagccatagagg

SEQ ID NO: 23716 - DNA, 20 bp, Artificial
  CRISPR gRNA sequence
ttggtgagccatagaggtac

SEQ ID NO: 23717 - DNA, 20 bp, Artificial
  CRISPR gRNA sequence
gtgagccatagaggtaccaa

SEQ ID NO: 23718 - DNA, 20 bp, Artificial
  CRISPR gRNA sequence
accccatgaatcctcctttg

SEQ ID NO: 23719 - DNA, 20 bp, Artificial
  CRISPR gRNA sequence
ctttgtttcttttcttttca

SEQ ID NO: 23720 - DNA, 20 bp, Artificial
  CRISPR gRNA sequence
tgtttcttttcttttcaacc

SEQ ID NO: 23721 - DNA, 20 bp, Artificial
  CRISPR gRNA sequence
gtttcttttcttttcaaccc

SEQ ID NO: 23722 - DNA, 20 bp, Artificial
  CRISPR gRNA sequence
tttcttttcttttcaacccc

SEQ ID NO: 23723 - DNA, 20 bp, Artificial
  CRISPR gRNA sequence
cttttcttttcaacccctgg

SEQ ID NO: 23724 - DNA, 20 bp, Artificial
  CRISPR gRNA sequence
ttttcttttcaacccctggg

SEQ ID NO: 23725 - DNA, 20 bp, Artificial
  CRISPR gRNA sequence
ttcttttcaacccctgggcc

SEQ ID NO: 23726 - DNA, 20 bp, Artificial
  CRISPR gRNA sequence
tcttttcaacccctgggcct

SEQ ID NO: 23727 - DNA, 20 bp, Artificial
  CRISPR gRNA sequence
cttttcaacccctgggcctt

SEQ ID NO: 23728 - DNA, 20 bp, Artificial
  CRISPR gRNA sequence
ttttcaacccctgggccttt

SEQ ID NO: 23729 - DNA, 20 bp, Artificial
  CRISPR gRNA sequence
ttcaacccctgggcctttaa

SEQ ID NO: 23730 - DNA, 20 bp, Artificial
  CRISPR gRNA sequence
tcaacccctgggcctttaaa

SEQ ID NO: 23731 - DNA, 20 bp, Artificial
  CRISPR gRNA sequence
caacccctgggcctttaaac

SEQ ID NO: 23732 - DNA, 20 bp, Artificial
  CRISPR gRNA sequence
aacccctgggcctttaaacc

SEQ ID NO: 23733 - DNA, 20 bp, Artificial
  CRISPR gRNA sequence
ggcctttaaaccttcgatta

SEQ ID NO: 23734 - DNA, 20 bp, Artificial
  CRISPR gRNA sequence
taaaccttcgattaactgcc

SEQ ID NO: 23735 - DNA, 20 bp, Artificial
  CRISPR gRNA sequence
aaaccttcgattaactgccc

SEQ ID NO: 23736 - DNA, 20 bp, Artificial
  CRISPR gRNA sequence
aaccttcgattaactgccca

SEQ ID NO: 23737 - DNA, 20 bp, Artificial
  CRISPR gRNA sequence
cgattaactgcccagtgcag

SEQ ID NO: 23738 - DNA, 20 bp, Artificial
  CRISPR gRNA sequence
gattaactgcccagtgcagc

SEQ ID NO: 23739 - DNA, 20 bp, Artificial
  CRISPR gRNA sequence
actgcccagtgcagcccagg

SEQ ID NO: 23740 - DNA, 20 bp, Artificial
  CRISPR gRNA sequence
cccagtgcagcccaggtcat

SEQ ID NO: 23741 - DNA, 20 bp, Artificial
  CRISPR gRNA sequence
tgatctttggttcacatgag

SEQ ID NO: 23742 - DNA, 20 bp, Artificial
  CRISPR gRNA sequence
tggttcacatgagggttttc

SEQ ID NO: 23743 - DNA, 20 bp, Artificial
  CRISPR gRNA sequence
ggttcacatgagggttttct

SEQ ID NO: 23744 - DNA, 20 bp, Artificial
  CRISPR gRNA sequence
gttcacatgagggttttctc

SEQ ID NO: 23745 - DNA, 20 bp, Artificial
  CRISPR gRNA sequence
acatgagggttttctcttca

SEQ ID NO: 23746 - DNA, 20 bp, Artificial
  CRISPR gRNA sequence
tctcttcattaatgtcccta

SEQ ID NO: 23747 - DNA, 20 bp, Artificial
  CRISPR gRNA sequence
ctcttcattaatgtccctat

SEQ ID NO: 23748 - DNA, 20 bp, Artificial
  CRISPR gRNA sequence
tcttcattaatgtccctatt

SEQ ID NO: 23749 - DNA, 20 bp, Artificial
  CRISPR gRNA sequence
ttcattaatgtccctatttc

SEQ ID NO: 23750 - DNA, 20 bp, Artificial
  CRISPR gRNA sequence
cattaatgtccctatttccc

SEQ ID NO: 23751 - DNA, 20 bp, Artificial
  CRISPR gRNA sequence
attaatgtccctatttccca

SEQ ID NO: 23752 - DNA, 20 bp, Artificial
  CRISPR gRNA sequence
atgtccctatttcccatact

SEQ ID NO: 23753 - DNA, 20 bp, Artificial
  CRISPR gRNA sequence
tttcccatactgggtgccca

SEQ ID NO: 23754 - DNA, 20 bp, Artificial
  CRISPR gRNA sequence
cccatactgggtgcccattc

SEQ ID NO: 23755 - DNA, 20 bp, Artificial
  CRISPR gRNA sequence
ccatactgggtgcccattct

SEQ ID NO: 23756 - DNA, 20 bp, Artificial
  CRISPR gRNA sequence
ggtgcccattctaatgcatt

SEQ ID NO: 23757 - DNA, 20 bp, Artificial
  CRISPR gRNA sequence
taatgcatttcaggtgtatc

SEQ ID NO: 23758 - DNA, 20 bp, Artificial
  CRISPR gRNA sequence
atgcatttcaggtgtatctt

SEQ ID NO: 23759 - DNA, 20 bp, Artificial
  CRISPR gRNA sequence
caggtgtatctttctgtttg

SEQ ID NO: 23760 - DNA, 20 bp, Artificial
  CRISPR gRNA sequence
aggtgtatctttctgtttgt

SEQ ID NO: 23761 - DNA, 20 bp, Artificial
  CRISPR gRNA sequence
tctgtttgtatgtgctctta

SEQ ID NO: 23762 - DNA, 20 bp, Artificial
  CRISPR gRNA sequence
ctgtttgtatgtgctcttat

SEQ ID NO: 23763 - DNA, 20 bp, Artificial
  CRISPR gRNA sequence
tgtttgtatgtgctcttata

SEQ ID NO: 23764 - DNA, 20 bp, Artificial
  CRISPR gRNA sequence
tttgtatgtgctcttataaa

SEQ ID NO: 23765 - DNA, 20 bp, Artificial
  CRISPR gRNA sequence
gtatgtgctcttataaaaca

SEQ ID NO: 23766 - DNA, 20 bp, Artificial
  CRISPR gRNA sequence
tatgtgctcttataaaacat

SEQ ID NO: 23767 - DNA, 20 bp, Artificial
  CRISPR gRNA sequence
ttataaaacatgttttgcct

SEQ ID NO: 23768 - DNA, 20 bp, Artificial
  CRISPR gRNA sequence
ataaaacatgttttgccttt

SEQ ID NO: 23769 - DNA, 20 bp, Artificial
  CRISPR gRNA sequence
taaaacatgttttgcctttt

SEQ ID NO: 23770 - DNA, 20 bp, Artificial
  CRISPR gRNA sequence
tgcctttttttttttttttt

SEQ ID NO: 23771 - DNA, 20 bp, Artificial
  CRISPR gRNA sequence
gcctttttttttttttttta

SEQ ID NO: 23772 - DNA, 20 bp, Artificial
  CRISPR gRNA sequence
ccttttttttttttttttag

SEQ ID NO: 23773 - DNA, 20 bp, Artificial
  CRISPR gRNA sequence
ttttttttttttttagatgg

SEQ ID NO: 23774 - DNA, 20 bp, Artificial
  CRISPR gRNA sequence
tttttttttttttagatgga

SEQ ID NO: 23775 - DNA, 20 bp, Artificial
  CRISPR gRNA sequence
ttttttttttttagatggag

SEQ ID NO: 23776 - DNA, 20 bp, Artificial
  CRISPR gRNA sequence
tttttttttttagatggagt

SEQ ID NO: 23777 - DNA, 20 bp, Artificial
  CRISPR gRNA sequence
ttttttttttagatggagtc

SEQ ID NO: 23778 - DNA, 20 bp, Artificial
  CRISPR gRNA sequence
tttttttttagatggagtct

SEQ ID NO: 23779 - DNA, 20 bp, Artificial
  CRISPR gRNA sequence
ttttttttagatggagtctc

SEQ ID NO: 23780 - DNA, 20 bp, Artificial
  CRISPR gRNA sequence
tttttttagatggagtctca

SEQ ID NO: 23781 - DNA, 20 bp, Artificial
  CRISPR gRNA sequence
ttttttagatggagtctcac

SEQ ID NO: 23782 - DNA, 20 bp, Artificial
  CRISPR gRNA sequence
tttttagatggagtctcact

SEQ ID NO: 23783 - DNA, 20 bp, Artificial
  CRISPR gRNA sequence
ttttagatggagtctcactc

SEQ ID NO: 23784 - DNA, 20 bp, Artificial
  CRISPR gRNA sequence
tttagatggagtctcactct

SEQ ID NO: 23785 - DNA, 20 bp, Artificial
  CRISPR gRNA sequence
ttagatggagtctcactctg

SEQ ID NO: 23786 - DNA, 20 bp, Artificial
  CRISPR gRNA sequence
tagatggagtctcactctgt

SEQ ID NO: 23787 - DNA, 20 bp, Artificial
  CRISPR gRNA sequence
agatggagtctcactctgtc

SEQ ID NO: 23788 - DNA, 20 bp, Artificial
  CRISPR gRNA sequence
gatggagtctcactctgtca

SEQ ID NO: 23789 - DNA, 20 bp, Artificial
  CRISPR gRNA sequence
actctgtcacccaggctgag

SEQ ID NO: 23790 - DNA, 20 bp, Artificial
  CRISPR gRNA sequence
tgtcacccaggctgagtttt

SEQ ID NO: 23791 - DNA, 20 bp, Artificial
  CRISPR gRNA sequence
tcacccaggctgagttttct

SEQ ID NO: 23792 - DNA, 20 bp, Artificial
  CRISPR gRNA sequence
agttttctatttttagtaga

SEQ ID NO: 23793 - DNA, 20 bp, Artificial
  CRISPR gRNA sequence
tctatttttagtagagatgg

SEQ ID NO: 23794 - DNA, 20 bp, Artificial
  CRISPR gRNA sequence
ctatttttagtagagatggg

SEQ ID NO: 23795 - DNA, 20 bp, Artificial
  CRISPR gRNA sequence
tatttttagtagagatgggg

SEQ ID NO: 23796 - DNA, 20 bp, Artificial
  CRISPR gRNA sequence
tttttagtagagatggggtt

SEQ ID NO: 23797 - DNA, 20 bp, Artificial
  CRISPR gRNA sequence
ttagtagagatggggtttta

SEQ ID NO: 23798 - DNA, 20 bp, Artificial
  CRISPR gRNA sequence
tagtagagatggggttttac

SEQ ID NO: 23799 - DNA, 20 bp, Artificial
  CRISPR gRNA sequence
agtagagatggggttttacc

SEQ ID NO: 23800 - DNA, 20 bp, Artificial
  CRISPR gRNA sequence
gtagagatggggttttacca

SEQ ID NO: 23801 - DNA, 20 bp, Artificial
  CRISPR gRNA sequence
taccaccttggccaggctgg

SEQ ID NO: 23802 - DNA, 20 bp, Artificial
  CRISPR gRNA sequence
accaccttggccaggctggt

SEQ ID NO: 23803 - DNA, 20 bp, Artificial
  CRISPR gRNA sequence
ccaccttggccaggctggtc

SEQ ID NO: 23804 - DNA, 20 bp, Artificial
  CRISPR gRNA sequence
ggccaggctggtctcaaact

SEQ ID NO: 23805 - DNA, 20 bp, Artificial
  CRISPR gRNA sequence
gccaggctggtctcaaactc

SEQ ID NO: 23806 - DNA, 20 bp, Artificial
  CRISPR gRNA sequence
gtctcaaactcctgacctca

SEQ ID NO: 23807 - DNA, 20 bp, Artificial
  CRISPR gRNA sequence
aaactcctgacctcaggtga

SEQ ID NO: 23808 - DNA, 20 bp, Artificial
  CRISPR gRNA sequence
ctgacctcaggtgatccacc

SEQ ID NO: 23809 - DNA, 20 bp, Artificial
  CRISPR gRNA sequence
acctcaggtgatccacccgc

SEQ ID NO: 23810 - DNA, 20 bp, Artificial
  CRISPR gRNA sequence
aggtgatccacccgcctcgg

SEQ ID NO: 23811 - DNA, 20 bp, Artificial
  CRISPR gRNA sequence
ggcctcccaaagtgctggaa

SEQ ID NO: 23812 - DNA, 20 bp, Artificial
  CRISPR gRNA sequence
ccaaagtgctggaattacag

SEQ ID NO: 23813 - DNA, 20 bp, Artificial
  CRISPR gRNA sequence
gaattacaggtgcgagtcac

SEQ ID NO: 23814 - DNA, 20 bp, Artificial
  CRISPR gRNA sequence
caggtgcgagtcaccacgcc

SEQ ID NO: 23815 - DNA, 20 bp, Artificial
  CRISPR gRNA sequence
gccacagtttcttacttttg

SEQ ID NO: 23816 - DNA, 20 bp, Artificial
  CRISPR gRNA sequence
cttacttttgcattctgtac

SEQ ID NO: 23817 - DNA, 20 bp, Artificial
  CRISPR gRNA sequence
ttacttttgcattctgtact

SEQ ID NO: 23818 - DNA, 20 bp, Artificial
  CRISPR gRNA sequence
acttttgcattctgtactat

SEQ ID NO: 23819 - DNA, 20 bp, Artificial
  CRISPR gRNA sequence
cttttgcattctgtactatg

SEQ ID NO: 23820 - DNA, 20 bp, Artificial
  CRISPR gRNA sequence
ttgcattctgtactatgttt

SEQ ID NO: 23821 - DNA, 20 bp, Artificial
  CRISPR gRNA sequence
tgcattctgtactatgtttt

SEQ ID NO: 23822 - DNA, 20 bp, Artificial
  CRISPR gRNA sequence
gcattctgtactatgttttt

SEQ ID NO: 23823 - DNA, 20 bp, Artificial
  CRISPR gRNA sequence
cattctgtactatgttttta

SEQ ID NO: 23824 - DNA, 20 bp, Artificial
  CRISPR gRNA sequence
tgtactatgtttttaggatc

SEQ ID NO: 23825 - DNA, 20 bp, Artificial
  CRISPR gRNA sequence
tactatgtttttaggatcta

SEQ ID NO: 23826 - DNA, 20 bp, Artificial
  CRISPR gRNA sequence
tgtttttaggatctacttgc

SEQ ID NO: 23827 - DNA, 20 bp, Artificial
  CRISPR gRNA sequence
ttaggatctacttgccttgc

SEQ ID NO: 23828 - DNA, 20 bp, Artificial
  CRISPR gRNA sequence
taggatctacttgccttgct

SEQ ID NO: 23829 - DNA, 20 bp, Artificial
  CRISPR gRNA sequence
aggatctacttgccttgctt

SEQ ID NO: 23830 - DNA, 20 bp, Artificial
  CRISPR gRNA sequence
ggatctacttgccttgcttc

SEQ ID NO: 23831 - DNA, 20 bp, Artificial
  CRISPR gRNA sequence
cttgccttgcttctgatgca

SEQ ID NO: 23832 - DNA, 20 bp, Artificial
  CRISPR gRNA sequence
gccttgcttctgatgcattt

SEQ ID NO: 23833 - DNA, 20 bp, Artificial
  CRISPR gRNA sequence
ccttgcttctgatgcatttg

SEQ ID NO: 23834 - DNA, 20 bp, Artificial
  CRISPR gRNA sequence
gcttctgatgcatttgatct

SEQ ID NO: 23835 - DNA, 20 bp, Artificial
  CRISPR gRNA sequence
cttctgatgcatttgatctt

SEQ ID NO: 23836 - DNA, 20 bp, Artificial
  CRISPR gRNA sequence
ctgatgcatttgatctttgc

SEQ ID NO: 23837 - DNA, 20 bp, Artificial
  CRISPR gRNA sequence
tgatgcatttgatctttgct

SEQ ID NO: 23838 - DNA, 20 bp, Artificial
  CRISPR gRNA sequence
atgcatttgatctttgcttc

SEQ ID NO: 23839 - DNA, 20 bp, Artificial
  CRISPR gRNA sequence
gatctttgcttctaatcacg

SEQ ID NO: 23840 - DNA, 20 bp, Artificial
  CRISPR gRNA sequence
atctttgcttctaatcacgg

SEQ ID NO: 23841 - DNA, 20 bp, Artificial
  CRISPR gRNA sequence
tgcttctaatcacggacatt

SEQ ID NO: 23842 - DNA, 20 bp, Artificial
  CRISPR gRNA sequence
gcttctaatcacggacattg

SEQ ID NO: 23843 - DNA, 20 bp, Artificial
  CRISPR gRNA sequence
cttctaatcacggacattgt

SEQ ID NO: 23844 - DNA, 20 bp, Artificial
  CRISPR gRNA sequence
ctaatcacggacattgttct

SEQ ID NO: 23845 - DNA, 20 bp, Artificial
  CRISPR gRNA sequence
taatcacggacattgttctc

SEQ ID NO: 23846 - DNA, 20 bp, Artificial
  CRISPR gRNA sequence
atcacggacattgttctcta

SEQ ID NO: 23847 - DNA, 20 bp, Artificial
  CRISPR gRNA sequence
ttctctatggagtgcagggg

SEQ ID NO: 23848 - DNA, 20 bp, Artificial
  CRISPR gRNA sequence
tctatggagtgcaggggtta

SEQ ID NO: 23849 - DNA, 20 bp, Artificial
  CRISPR gRNA sequence
tatggagtgcaggggttact

SEQ ID NO: 23850 - DNA, 20 bp, Artificial
  CRISPR gRNA sequence
tggagtgcaggggttacttt

SEQ ID NO: 23851 - DNA, 20 bp, Artificial
  CRISPR gRNA sequence
cttttcacctgtccacaccc

SEQ ID NO: 23852 - DNA, 20 bp, Artificial
  CRISPR gRNA sequence
ttcacctgtccacaccccca

SEQ ID NO: 23853 - DNA, 20 bp, Artificial
  CRISPR gRNA sequence
tcacctgtccacacccccag

SEQ ID NO: 23854 - DNA, 20 bp, Artificial
  CRISPR gRNA sequence
cacctgtccacacccccagt

SEQ ID NO: 23855 - DNA, 20 bp, Artificial
  CRISPR gRNA sequence
acctgtccacacccccagtg

SEQ ID NO: 23856 - DNA, 20 bp, Artificial
  CRISPR gRNA sequence
tccacacccccagtgatgga

SEQ ID NO: 23857 - DNA, 20 bp, Artificial
  CRISPR gRNA sequence
ggtgacctccaactctctgt

SEQ ID NO: 23858 - DNA, 20 bp, Artificial
  CRISPR gRNA sequence
caactctctgtcaccacaaa

SEQ ID NO: 23859 - DNA, 20 bp, Artificial
  CRISPR gRNA sequence
tctgtcaccacaaataacac

SEQ ID NO: 23860 - DNA, 20 bp, Artificial
  CRISPR gRNA sequence
tgtcaccacaaataacacag

SEQ ID NO: 23861 - DNA, 20 bp, Artificial
  CRISPR gRNA sequence
tcaccacaaataacacagca

SEQ ID NO: 23862 - DNA, 20 bp, Artificial
  CRISPR gRNA sequence
agatgggttctcctggggag

SEQ ID NO: 23863 - DNA, 20 bp, Artificial
  CRISPR gRNA sequence
tcctggggagttgtgggaac

SEQ ID NO: 23864 - DNA, 20 bp, Artificial
  CRISPR gRNA sequence
ctggggagttgtgggaacat

SEQ ID NO: 23865 - DNA, 20 bp, Artificial
  CRISPR gRNA sequence
gggagttgtgggaacatttc

SEQ ID NO: 23866 - DNA, 20 bp, Artificial
  CRISPR gRNA sequence
tgggaacatttcttcaggat

SEQ ID NO: 23867 - DNA, 20 bp, Artificial
  CRISPR gRNA sequence
cttcaggatatatagaccca

SEQ ID NO: 23868 - DNA, 20 bp, Artificial
  CRISPR gRNA sequence
ttcaggatatatagacccaa

SEQ ID NO: 23869 - DNA, 20 bp, Artificial
  CRISPR gRNA sequence
caggatatatagacccaaga

SEQ ID NO: 23870 - DNA, 20 bp, Artificial
  CRISPR gRNA sequence
aggatatatagacccaagag

SEQ ID NO: 23871 - DNA, 20 bp, Artificial
  CRISPR gRNA sequence
aattgccaggtggtaggatc

SEQ ID NO: 23872 - DNA, 20 bp, Artificial
  CRISPR gRNA sequence
ccaggtggtaggatctacat

SEQ ID NO: 23873 - DNA, 20 bp, Artificial
  CRISPR gRNA sequence
catatccttagatattctac

SEQ ID NO: 23874 - DNA, 20 bp, Artificial
  CRISPR gRNA sequence
agatattctacatgatgcca

SEQ ID NO: 23875 - DNA, 20 bp, Artificial
  CRISPR gRNA sequence
gatattctacatgatgccag

SEQ ID NO: 23876 - DNA, 20 bp, Artificial
  CRISPR gRNA sequence
tacatgatgccaggtcgttc

SEQ ID NO: 23877 - DNA, 20 bp, Artificial
  CRISPR gRNA sequence
catgatgccaggtcgttctc

SEQ ID NO: 23878 - DNA, 20 bp, Artificial
  CRISPR gRNA sequence
tccagagcggccccatccat

SEQ ID NO: 23879 - DNA, 20 bp, Artificial
  CRISPR gRNA sequence
cagagcggccccatccatct

SEQ ID NO: 23880 - DNA, 20 bp, Artificial
  CRISPR gRNA sequence
cattcccacaaacccgtgta

SEQ ID NO: 23881 - DNA, 20 bp, Artificial
  CRISPR gRNA sequence
ccacaaacccgtgtaaccaa

SEQ ID NO: 23882 - DNA, 20 bp, Artificial
  CRISPR gRNA sequence
ggcatttcccagatgtctaa

SEQ ID NO: 23883 - DNA, 20 bp, Artificial
  CRISPR gRNA sequence
gcatttcccagatgtctaac

SEQ ID NO: 23884 - DNA, 20 bp, Artificial
  CRISPR gRNA sequence
cccagatgtctaacttttgc

SEQ ID NO: 23885 - DNA, 20 bp, Artificial
  CRISPR gRNA sequence
ccagatgtctaacttttgcc

SEQ ID NO: 23886 - DNA, 20 bp, Artificial
  CRISPR gRNA sequence
acttttgccagttgtacagt

SEQ ID NO: 23887 - DNA, 20 bp, Artificial
  CRISPR gRNA sequence
ttgccagttgtacagtatca

SEQ ID NO: 23888 - DNA, 20 bp, Artificial
  CRISPR gRNA sequence
tgccagttgtacagtatcaa

SEQ ID NO: 23889 - DNA, 20 bp, Artificial
  CRISPR gRNA sequence
gccagttgtacagtatcaag

SEQ ID NO: 23890 - DNA, 20 bp, Artificial
  CRISPR gRNA sequence
ccagttgtacagtatcaagt

SEQ ID NO: 23891 - DNA, 20 bp, Artificial
  CRISPR gRNA sequence
tacagtatcaagtgtcactt

SEQ ID NO: 23892 - DNA, 20 bp, Artificial
  CRISPR gRNA sequence
tgctgttttatttttggagt

SEQ ID NO: 23893 - DNA, 20 bp, Artificial
  CRISPR gRNA sequence
gctgttttatttttggagtt

SEQ ID NO: 23894 - DNA, 20 bp, Artificial
  CRISPR gRNA sequence
ctgttttatttttggagttt

SEQ ID NO: 23895 - DNA, 20 bp, Artificial
  CRISPR gRNA sequence
ttttatttttggagtttaca

SEQ ID NO: 23896 - DNA, 20 bp, Artificial
  CRISPR gRNA sequence
tatttttggagtttacatct

SEQ ID NO: 23897 - DNA, 20 bp, Artificial
  CRISPR gRNA sequence
atttttggagtttacatctt

SEQ ID NO: 23898 - DNA, 20 bp, Artificial
  CRISPR gRNA sequence
tttttggagtttacatctta

SEQ ID NO: 23899 - DNA, 20 bp, Artificial
  CRISPR gRNA sequence
ttggagtttacatcttagta

SEQ ID NO: 23900 - DNA, 20 bp, Artificial
  CRISPR gRNA sequence
tggagtttacatcttagtac

SEQ ID NO: 23901 - DNA, 20 bp, Artificial
  CRISPR gRNA sequence
ggagtttacatcttagtacc

SEQ ID NO: 23902 - DNA, 20 bp, Artificial
  CRISPR gRNA sequence
gagtttacatcttagtacca

SEQ ID NO: 23903 - DNA, 20 bp, Artificial
  CRISPR gRNA sequence
acatcttagtaccacttact

SEQ ID NO: 23904 - DNA, 20 bp, Artificial
  CRISPR gRNA sequence
catcttagtaccacttactc

SEQ ID NO: 23905 - DNA, 20 bp, Artificial
  CRISPR gRNA sequence
agtaccacttactcgctaag

SEQ ID NO: 23906 - DNA, 20 bp, Artificial
  CRISPR gRNA sequence
gtaccacttactcgctaagt

SEQ ID NO: 23907 - DNA, 20 bp, Artificial
  CRISPR gRNA sequence
actcgctaagtcactttagg

SEQ ID NO: 23908 - DNA, 20 bp, Artificial
  CRISPR gRNA sequence
ctcgctaagtcactttaggt

SEQ ID NO: 23909 - DNA, 20 bp, Artificial
  CRISPR gRNA sequence
gctaagtcactttaggtaag

SEQ ID NO: 23910 - DNA, 20 bp, Artificial
  CRISPR gRNA sequence
agtcactttaggtaagtcac

SEQ ID NO: 23911 - DNA, 20 bp, Artificial
  CRISPR gRNA sequence
taggtaagtcacaacaaccc

SEQ ID NO: 23912 - DNA, 20 bp, Artificial
  CRISPR gRNA sequence
aggtaagtcacaacaaccca

SEQ ID NO: 23913 - DNA, 20 bp, Artificial
  CRISPR gRNA sequence
ggtaagtcacaacaacccag

SEQ ID NO: 23914 - DNA, 20 bp, Artificial
  CRISPR gRNA sequence
tgccaacaaaatgcagtcga

SEQ ID NO: 23915 - DNA, 20 bp, Artificial
  CRISPR gRNA sequence
tgtgactcagagaggttgag

SEQ ID NO: 23916 - DNA, 20 bp, Artificial
  CRISPR gRNA sequence
tgactcagagaggttgagta

SEQ ID NO: 23917 - DNA, 20 bp, Artificial
  CRISPR gRNA sequence
agagaggttgagtaacattt

SEQ ID NO: 23918 - DNA, 20 bp, Artificial
  CRISPR gRNA sequence
agtaacatttgcaaagtcac

SEQ ID NO: 23919 - DNA, 20 bp, Artificial
  CRISPR gRNA sequence
gcaaagtcacacagcaagtg

SEQ ID NO: 23920 - DNA, 20 bp, Artificial
  CRISPR gRNA sequence
caaagtcacacagcaagtgt

SEQ ID NO: 23921 - DNA, 20 bp, Artificial
  CRISPR gRNA sequence
agatttgaacccagagcctg

SEQ ID NO: 23922 - DNA, 20 bp, Artificial
  CRISPR gRNA sequence
gaacccagagcctgcaccct

SEQ ID NO: 23923 - DNA, 20 bp, Artificial
  CRISPR gRNA sequence
aacccagagcctgcaccctt

SEQ ID NO: 23924 - DNA, 20 bp, Artificial
  CRISPR gRNA sequence
cacccttaaccactatgcta

SEQ ID NO: 23925 - DNA, 20 bp, Artificial
  CRISPR gRNA sequence
aaccactatgctattattat

SEQ ID NO: 23926 - DNA, 20 bp, Artificial
  CRISPR gRNA sequence
accactatgctattattatg

SEQ ID NO: 23927 - DNA, 20 bp, Artificial
  CRISPR gRNA sequence
tgctattattatgttttgtc

SEQ ID NO: 23928 - DNA, 20 bp, Artificial
  CRISPR gRNA sequence
ttattatgttttgtctctct

SEQ ID NO: 23929 - DNA, 20 bp, Artificial
  CRISPR gRNA sequence
ttatgttttgtctctctcct

SEQ ID NO: 23930 - DNA, 20 bp, Artificial
  CRISPR gRNA sequence
tgttttgtctctctcctaaa

SEQ ID NO: 23931 - DNA, 20 bp, Artificial
  CRISPR gRNA sequence
tgtctctctcctaaaatatc

SEQ ID NO: 23932 - DNA, 20 bp, Artificial
  CRISPR gRNA sequence
gtctctctcctaaaatatca

SEQ ID NO: 23933 - DNA, 20 bp, Artificial
  CRISPR gRNA sequence
tctctctcctaaaatatcat

SEQ ID NO: 23934 - DNA, 20 bp, Artificial
  CRISPR gRNA sequence
tctcctaaaatatcatctgg

SEQ ID NO: 23935 - DNA, 20 bp, Artificial
  CRISPR gRNA sequence
tcctaaaatatcatctgggt

SEQ ID NO: 23936 - DNA, 20 bp, Artificial
  CRISPR gRNA sequence
ctaaaatatcatctgggtct

SEQ ID NO: 23937 - DNA, 20 bp, Artificial
  CRISPR gRNA sequence
aaatatcatctgggtctaca

SEQ ID NO: 23938 - DNA, 20 bp, Artificial
  CRISPR gRNA sequence
ggtctacattgcaagcctct

SEQ ID NO: 23939 - DNA, 20 bp, Artificial
  CRISPR gRNA sequence
cattgcaagcctctttggca

SEQ ID NO: 23940 - DNA, 20 bp, Artificial
  CRISPR gRNA sequence
caagcctctttggcagggac

SEQ ID NO: 23941 - DNA, 20 bp, Artificial
  CRISPR gRNA sequence
tttggcagggactgtgtggt

SEQ ID NO: 23942 - DNA, 20 bp, Artificial
  CRISPR gRNA sequence
tggcagggactgtgtggtaa

SEQ ID NO: 23943 - DNA, 20 bp, Artificial
  CRISPR gRNA sequence
ggcagggactgtgtggtaaa

SEQ ID NO: 23944 - DNA, 20 bp, Artificial
  CRISPR gRNA sequence
gcagggactgtgtggtaaac

SEQ ID NO: 23945 - DNA, 20 bp, Artificial
  CRISPR gRNA sequence
tgtggtaaacctctttgggg

SEQ ID NO: 23946 - DNA, 20 bp, Artificial
  CRISPR gRNA sequence
tttggggccagtaaggaact

SEQ ID NO: 23947 - DNA, 20 bp, Artificial
  CRISPR gRNA sequence
tggggccagtaaggaactga

SEQ ID NO: 23948 - DNA, 20 bp, Artificial
  CRISPR gRNA sequence
ggggccagtaaggaactgag

SEQ ID NO: 23949 - DNA, 20 bp, Artificial
  CRISPR gRNA sequence
gggccagtaaggaactgagc

SEQ ID NO: 23950 - DNA, 20 bp, Artificial
  CRISPR gRNA sequence
agctcagtgactttcttacg

SEQ ID NO: 23951 - DNA, 20 bp, Artificial
  CRISPR gRNA sequence
agtgactttcttacggggtg

SEQ ID NO: 23952 - DNA, 20 bp, Artificial
  CRISPR gRNA sequence
tcttacggggtgctcagtga

SEQ ID NO: 23953 - DNA, 20 bp, Artificial
  CRISPR gRNA sequence
cttacggggtgctcagtgaa

SEQ ID NO: 23954 - DNA, 20 bp, Artificial
  CRISPR gRNA sequence
ttacggggtgctcagtgaat

SEQ ID NO: 23955 - DNA, 20 bp, Artificial
  CRISPR gRNA sequence
acggggtgctcagtgaatca

SEQ ID NO: 23956 - DNA, 20 bp, Artificial
  CRISPR gRNA sequence
cggggtgctcagtgaatcat

SEQ ID NO: 23957 - DNA, 20 bp, Artificial
  CRISPR gRNA sequence
agtgaatcattgttttacag

SEQ ID NO: 23958 - DNA, 20 bp, Artificial
  CRISPR gRNA sequence
ttttacagctttagagggga

SEQ ID NO: 23959 - DNA, 20 bp, Artificial
  CRISPR gRNA sequence
tacagctttagaggggaaaa

SEQ ID NO: 23960 - DNA, 20 bp, Artificial
  CRISPR gRNA sequence
acagctttagaggggaaaag

SEQ ID NO: 23961 - DNA, 20 bp, Artificial
  CRISPR gRNA sequence
cagctttagaggggaaaagt

SEQ ID NO: 23962 - DNA, 20 bp, Artificial
  CRISPR gRNA sequence
tagaggggaaaagtgagaga

SEQ ID NO: 23963 - DNA, 20 bp, Artificial
  CRISPR gRNA sequence
agaggggaaaagtgagagat

SEQ ID NO: 23964 - DNA, 20 bp, Artificial
  CRISPR gRNA sequence
gaggggaaaagtgagagatg

SEQ ID NO: 23965 - DNA, 20 bp, Artificial
  CRISPR gRNA sequence
cttagagtttatctggagga

SEQ ID NO: 23966 - DNA, 20 bp, Artificial
  CRISPR gRNA sequence
ttagagtttatctggaggac

SEQ ID NO: 23967 - DNA, 20 bp, Artificial
  CRISPR gRNA sequence
agagtttatctggaggacta

SEQ ID NO: 23968 - DNA, 20 bp, Artificial
  CRISPR gRNA sequence
gagtttatctggaggactac

SEQ ID NO: 23969 - DNA, 20 bp, Artificial
  CRISPR gRNA sequence
atctggaggactacagggtg

SEQ ID NO: 23970 - DNA, 20 bp, Artificial
  CRISPR gRNA sequence
tctggaggactacagggtgc

SEQ ID NO: 23971 - DNA, 20 bp, Artificial
  CRISPR gRNA sequence
gaggactacagggtgcatga

SEQ ID NO: 23972 - DNA, 20 bp, Artificial
  CRISPR gRNA sequence
cagggtgcatgagcaaaagc

SEQ ID NO: 23973 - DNA, 20 bp, Artificial
  CRISPR gRNA sequence
atttgagctactacccccac

SEQ ID NO: 23974 - DNA, 20 bp, Artificial
  CRISPR gRNA sequence
gagctactacccccacaaag

SEQ ID NO: 23975 - DNA, 20 bp, Artificial
  CRISPR gRNA sequence
agctactacccccacaaaga

SEQ ID NO: 23976 - DNA, 20 bp, Artificial
  CRISPR gRNA sequence
ctacccccacaaagaagctg

SEQ ID NO: 23977 - DNA, 20 bp, Artificial
  CRISPR gRNA sequence
cccccacaaagaagctgttt

SEQ ID NO: 23978 - DNA, 20 bp, Artificial
  CRISPR gRNA sequence
tttggggtctggtcatggta

SEQ ID NO: 23979 - DNA, 20 bp, Artificial
  CRISPR gRNA sequence
ggggtctggtcatggtagat

SEQ ID NO: 23980 - DNA, 20 bp, Artificial
  CRISPR gRNA sequence
gggtctggtcatggtagata

SEQ ID NO: 23981 - DNA, 20 bp, Artificial
  CRISPR gRNA sequence
gtcatggtagataggcattc

SEQ ID NO: 23982 - DNA, 20 bp, Artificial
  CRISPR gRNA sequence
ctaggcccctggcttcccaa

SEQ ID NO: 23983 - DNA, 20 bp, Artificial
  CRISPR gRNA sequence
ggcccctggcttcccaacac

SEQ ID NO: 23984 - DNA, 20 bp, Artificial
  CRISPR gRNA sequence
gcttcccaacaccatttggc

SEQ ID NO: 23985 - DNA, 20 bp, Artificial
  CRISPR gRNA sequence
cccaacaccatttggccccc

SEQ ID NO: 23986 - DNA, 20 bp, Artificial
  CRISPR gRNA sequence
ccaacaccatttggcccccg

SEQ ID NO: 23987 - DNA, 20 bp, Artificial
  CRISPR gRNA sequence
ggcccccggaagcagcttgt

SEQ ID NO: 23988 - DNA, 20 bp, Artificial
  CRISPR gRNA sequence
gcccccggaagcagcttgtc

SEQ ID NO: 23989 - DNA, 20 bp, Artificial
  CRISPR gRNA sequence
gtcatgaggttggggagcag

SEQ ID NO: 23990 - DNA, 20 bp, Artificial
  CRISPR gRNA sequence
tcatgaggttggggagcagg

SEQ ID NO: 23991 - DNA, 20 bp, Artificial
  CRISPR gRNA sequence
gggagcaggttggtgttggg

SEQ ID NO: 23992 - DNA, 20 bp, Artificial
  CRISPR gRNA sequence
gtgttggggggggccttggg

SEQ ID NO: 23993 - DNA, 20 bp, Artificial
  CRISPR gRNA sequence
gggggggccttgggggaaag

SEQ ID NO: 23994 - DNA, 20 bp, Artificial
  CRISPR gRNA sequence
gggggaaaggaaaaggagaa

SEQ ID NO: 23995 - DNA, 20 bp, Artificial
  CRISPR gRNA sequence
ggggaaaggaaaaggagaag

SEQ ID NO: 23996 - DNA, 20 bp, Artificial
  CRISPR gRNA sequence
ccaggcaacgaggaatcaga

SEQ ID NO: 23997 - DNA, 20 bp, Artificial
  CRISPR gRNA sequence
aaaaagactcaattgaaggg

SEQ ID NO: 23998 - DNA, 20 bp, Artificial
  CRISPR gRNA sequence
aattgaaggggctccaacac

SEQ ID NO: 23999 - DNA, 20 bp, Artificial
  CRISPR gRNA sequence
aaggggctccaacactcgtt

SEQ ID NO: 24000 - DNA, 20 bp, Artificial
  CRISPR gRNA sequence
caacactcgttgaaacggag

SEQ ID NO: 24001 - DNA, 20 bp, Artificial
  CRISPR gRNA sequence
gttgaaacggaggctcagag

SEQ ID NO: 24002 - DNA, 20 bp, Artificial
  CRISPR gRNA sequence
aaacggaggctcagagggct

SEQ ID NO: 24003 - DNA, 20 bp, Artificial
  CRISPR gRNA sequence
agagggctaaggtaatgtac

SEQ ID NO: 24004 - DNA, 20 bp, Artificial
  CRISPR gRNA sequence
aggtaatgtactcaggatca

SEQ ID NO: 24005 - DNA, 20 bp, Artificial
  CRISPR gRNA sequence
aggatcaaaggcagagcaga

SEQ ID NO: 24006 - DNA, 20 bp, Artificial
  CRISPR gRNA sequence
aaaccatgtctctaggcaca

SEQ ID NO: 24007 - DNA, 20 bp, Artificial
  CRISPR gRNA sequence
taggcacacagttcagaggt

SEQ ID NO: 24008 - DNA, 20 bp, Artificial
  CRISPR gRNA sequence
ggcacacagttcagaggtct

SEQ ID NO: 24009 - DNA, 20 bp, Artificial
  CRISPR gRNA sequence
agaggtcttcccattattcc

SEQ ID NO: 24010 - DNA, 20 bp, Artificial
  CRISPR gRNA sequence
cccattattcctcaggagga

SEQ ID NO: 24011 - DNA, 20 bp, Artificial
  CRISPR gRNA sequence
ccattattcctcaggaggag

SEQ ID NO: 24012 - DNA, 20 bp, Artificial
  CRISPR gRNA sequence
ttcctcaggaggagaagttc

SEQ ID NO: 24013 - DNA, 20 bp, Artificial
  CRISPR gRNA sequence
ctcaggaggagaagttcatg

SEQ ID NO: 24014 - DNA, 20 bp, Artificial
  CRISPR gRNA sequence
aggaggagaagttcatggtc

SEQ ID NO: 24015 - DNA, 20 bp, Artificial
  CRISPR gRNA sequence
atggtcaagagtagggaagt

SEQ ID NO: 24016 - DNA, 20 bp, Artificial
  CRISPR gRNA sequence
cttctcaagctttttttttt

SEQ ID NO: 24017 - DNA, 20 bp, Artificial
  CRISPR gRNA sequence
ctcaagcttttttttttttt

SEQ ID NO: 24018 - DNA, 20 bp, Artificial
  CRISPR gRNA sequence
tcaagctttttttttttttg

SEQ ID NO: 24019 - DNA, 20 bp, Artificial
  CRISPR gRNA sequence
aagctttttttttttttgtc

SEQ ID NO: 24020 - DNA, 20 bp, Artificial
  CRISPR gRNA sequence
tttttttttttgtctgagac

SEQ ID NO: 24021 - DNA, 20 bp, Artificial
  CRISPR gRNA sequence
ttttttttttgtctgagaca

SEQ ID NO: 24022 - DNA, 20 bp, Artificial
  CRISPR gRNA sequence
tttttttttgtctgagacag

SEQ ID NO: 24023 - DNA, 20 bp, Artificial
  CRISPR gRNA sequence
ttttttttgtctgagacaga

SEQ ID NO: 24024 - DNA, 20 bp, Artificial
  CRISPR gRNA sequence
tttttttgtctgagacagag

SEQ ID NO: 24025 - DNA, 20 bp, Artificial
  CRISPR gRNA sequence
ttttttgtctgagacagagt

SEQ ID NO: 24026 - DNA, 20 bp, Artificial
  CRISPR gRNA sequence
tttttgtctgagacagagtc

SEQ ID NO: 24027 - DNA, 20 bp, Artificial
  CRISPR gRNA sequence
ttttgtctgagacagagtct

SEQ ID NO: 24028 - DNA, 20 bp, Artificial
  CRISPR gRNA sequence
tttgtctgagacagagtctt

SEQ ID NO: 24029 - DNA, 20 bp, Artificial
  CRISPR gRNA sequence
ttgtctgagacagagtcttg

SEQ ID NO: 24030 - DNA, 20 bp, Artificial
  CRISPR gRNA sequence
tgtctgagacagagtcttgc

SEQ ID NO: 24031 - DNA, 20 bp, Artificial
  CRISPR gRNA sequence
gtctgagacagagtcttgct

SEQ ID NO: 24032 - DNA, 20 bp, Artificial
  CRISPR gRNA sequence
tctgagacagagtcttgctc

SEQ ID NO: 24033 - DNA, 20 bp, Artificial
  CRISPR gRNA sequence
agacagagtcttgctctgtc

SEQ ID NO: 24034 - DNA, 20 bp, Artificial
  CRISPR gRNA sequence
gctctgtcaccgaggctgga

SEQ ID NO: 24035 - DNA, 20 bp, Artificial
  CRISPR gRNA sequence
ctctgtcaccgaggctggag

SEQ ID NO: 24036 - DNA, 20 bp, Artificial
  CRISPR gRNA sequence
tgtcaccgaggctggagtgc

SEQ ID NO: 24037 - DNA, 20 bp, Artificial
  CRISPR gRNA sequence
tcaccgaggctggagtgcag

SEQ ID NO: 24038 - DNA, 20 bp, Artificial
  CRISPR gRNA sequence
gagtgcagtggcgtgatctc

SEQ ID NO: 24039 - DNA, 20 bp, Artificial
  CRISPR gRNA sequence
ggctcactgcaacctccgcc

SEQ ID NO: 24040 - DNA, 20 bp, Artificial
  CRISPR gRNA sequence
actgcaacctccgcctccca

SEQ ID NO: 24041 - DNA, 20 bp, Artificial
  CRISPR gRNA sequence
caacctccgcctcccaggtt

SEQ ID NO: 24042 - DNA, 20 bp, Artificial
  CRISPR gRNA sequence
cgcctcccaggttcaagcaa

SEQ ID NO: 24043 - DNA, 20 bp, Artificial
  CRISPR gRNA sequence
ccaggttcaagcaattttcc

SEQ ID NO: 24044 - DNA, 20 bp, Artificial
  CRISPR gRNA sequence
aagcaattttcctgcctcag

SEQ ID NO: 24045 - DNA, 20 bp, Artificial
  CRISPR gRNA sequence
tcctgcctcagcctcccaag

SEQ ID NO: 24046 - DNA, 20 bp, Artificial
  CRISPR gRNA sequence
cctgcctcagcctcccaagt

SEQ ID NO: 24047 - DNA, 20 bp, Artificial
  CRISPR gRNA sequence
ctgcctcagcctcccaagta

SEQ ID NO: 24048 - DNA, 20 bp, Artificial
  CRISPR gRNA sequence
cctcagcctcccaagtagct

SEQ ID NO: 24049 - DNA, 20 bp, Artificial
  CRISPR gRNA sequence
agcctcccaagtagctggga

SEQ ID NO: 24050 - DNA, 20 bp, Artificial
  CRISPR gRNA sequence
ccaagtagctgggattatag

SEQ ID NO: 24051 - DNA, 20 bp, Artificial
  CRISPR gRNA sequence
ggattataggcacccaccac

SEQ ID NO: 24052 - DNA, 20 bp, Artificial
  CRISPR gRNA sequence
taggcacccaccaccacgcc

SEQ ID NO: 24053 - DNA, 20 bp, Artificial
  CRISPR gRNA sequence
atttttgtatttttgcagag

SEQ ID NO: 24054 - DNA, 20 bp, Artificial
  CRISPR gRNA sequence
ttgtatttttgcagagacgg

SEQ ID NO: 24055 - DNA, 20 bp, Artificial
  CRISPR gRNA sequence
tgtatttttgcagagacggg

SEQ ID NO: 24056 - DNA, 20 bp, Artificial
  CRISPR gRNA sequence
gtatttttgcagagacgggg

SEQ ID NO: 24057 - DNA, 20 bp, Artificial
  CRISPR gRNA sequence
tatttttgcagagacggggt

SEQ ID NO: 24058 - DNA, 20 bp, Artificial
  CRISPR gRNA sequence
ttgcagagacggggtttcac

SEQ ID NO: 24059 - DNA, 20 bp, Artificial
  CRISPR gRNA sequence
tgcagagacggggtttcacc

SEQ ID NO: 24060 - DNA, 20 bp, Artificial
  CRISPR gRNA sequence
gcagagacggggtttcacca

SEQ ID NO: 24061 - DNA, 20 bp, Artificial
  CRISPR gRNA sequence
cagagacggggtttcaccat

SEQ ID NO: 24062 - DNA, 20 bp, Artificial
  CRISPR gRNA sequence
caccatgctggtcaggctgg

SEQ ID NO: 24063 - DNA, 20 bp, Artificial
  CRISPR gRNA sequence
accatgctggtcaggctggt

SEQ ID NO: 24064 - DNA, 20 bp, Artificial
  CRISPR gRNA sequence
gtcaggctggtcttgaactc

SEQ ID NO: 24065 - DNA, 20 bp, Artificial
  CRISPR gRNA sequence
gtcttgaactcctgacctca

SEQ ID NO: 24066 - DNA, 20 bp, Artificial
  CRISPR gRNA sequence
gaactcctgacctcaagtaa

SEQ ID NO: 24067 - DNA, 20 bp, Artificial
  CRISPR gRNA sequence
aactcctgacctcaagtaat

SEQ ID NO: 24068 - DNA, 20 bp, Artificial
  CRISPR gRNA sequence
ctgacctcaagtaatccgcc

SEQ ID NO: 24069 - DNA, 20 bp, Artificial
  CRISPR gRNA sequence
acctcaagtaatccgccagc

SEQ ID NO: 24070 - DNA, 20 bp, Artificial
  CRISPR gRNA sequence
aagtaatccgccagcctcgg

SEQ ID NO: 24071 - DNA, 20 bp, Artificial
  CRISPR gRNA sequence
ggcctctcaaagtgctagga

SEQ ID NO: 24072 - DNA, 20 bp, Artificial
  CRISPR gRNA sequence
tcaaagtgctaggattatag

SEQ ID NO: 24073 - DNA, 20 bp, Artificial
  CRISPR gRNA sequence
aaagtgctaggattataggc

SEQ ID NO: 24074 - DNA, 20 bp, Artificial
  CRISPR gRNA sequence
ggattataggcgtgagccac

SEQ ID NO: 24075 - DNA, 20 bp, Artificial
  CRISPR gRNA sequence
taggcgtgagccaccacccc

SEQ ID NO: 24076 - DNA, 20 bp, Artificial
  CRISPR gRNA sequence
gcctccttctcatgctcttt

SEQ ID NO: 24077 - DNA, 20 bp, Artificial
  CRISPR gRNA sequence
cttctcatgctctttaatca

SEQ ID NO: 24078 - DNA, 20 bp, Artificial
  CRISPR gRNA sequence
ctcatgctctttaatcacag

SEQ ID NO: 24079 - DNA, 20 bp, Artificial
  CRISPR gRNA sequence
tcatgctctttaatcacagt

SEQ ID NO: 24080 - DNA, 20 bp, Artificial
  CRISPR gRNA sequence
atgctctttaatcacagttc

SEQ ID NO: 24081 - DNA, 20 bp, Artificial
  CRISPR gRNA sequence
tttaatcacagttcagagca

SEQ ID NO: 24082 - DNA, 20 bp, Artificial
  CRISPR gRNA sequence
taatcacagttcagagcagt

SEQ ID NO: 24083 - DNA, 20 bp, Artificial
  CRISPR gRNA sequence
aatcacagttcagagcagtg

SEQ ID NO: 24084 - DNA, 20 bp, Artificial
  CRISPR gRNA sequence
atcacagttcagagcagtgc

SEQ ID NO: 24085 - DNA, 20 bp, Artificial
  CRISPR gRNA sequence
agagcagtgctggaggcttt

SEQ ID NO: 24086 - DNA, 20 bp, Artificial
  CRISPR gRNA sequence
gaggcttttaggggtagcaa

SEQ ID NO: 24087 - DNA, 20 bp, Artificial
  CRISPR gRNA sequence
ttaggggtagcaaaagagcc

SEQ ID NO: 24088 - DNA, 20 bp, Artificial
  CRISPR gRNA sequence
taggggtagcaaaagagcct

SEQ ID NO: 24089 - DNA, 20 bp, Artificial
  CRISPR gRNA sequence
aggggtagcaaaagagcctt

SEQ ID NO: 24090 - DNA, 20 bp, Artificial
  CRISPR gRNA sequence
ggggtagcaaaagagccttc

SEQ ID NO: 24091 - DNA, 20 bp, Artificial
  CRISPR gRNA sequence
cttctccctttcagtgcctc

SEQ ID NO: 24092 - DNA, 20 bp, Artificial
  CRISPR gRNA sequence
ttctccctttcagtgcctcc

SEQ ID NO: 24093 - DNA, 20 bp, Artificial
  CRISPR gRNA sequence
ctccctttcagtgcctcctt

SEQ ID NO: 24094 - DNA, 20 bp, Artificial
  CRISPR gRNA sequence
tccctttcagtgcctcctta

SEQ ID NO: 24095 - DNA, 20 bp, Artificial
  CRISPR gRNA sequence
cctttcagtgcctccttaga

SEQ ID NO: 24096 - DNA, 20 bp, Artificial
  CRISPR gRNA sequence
tcagtgcctccttagaccct

SEQ ID NO: 24097 - DNA, 20 bp, Artificial
  CRISPR gRNA sequence
cagtgcctccttagaccctc

SEQ ID NO: 24098 - DNA, 20 bp, Artificial
  CRISPR gRNA sequence
agtgcctccttagaccctca

SEQ ID NO: 24099 - DNA, 20 bp, Artificial
  CRISPR gRNA sequence
cttagaccctcaaagataga

SEQ ID NO: 24100 - DNA, 20 bp, Artificial
  CRISPR gRNA sequence
agaccctcaaagatagactc

SEQ ID NO: 24101 - DNA, 20 bp, Artificial
  CRISPR gRNA sequence
gaccctcaaagatagactcc

SEQ ID NO: 24102 - DNA, 20 bp, Artificial
  CRISPR gRNA sequence
aaagatagactccccgcctc

SEQ ID NO: 24103 - DNA, 20 bp, Artificial
  CRISPR gRNA sequence
cccgcctctgggaagaaaac

SEQ ID NO: 24104 - DNA, 20 bp, Artificial
  CRISPR gRNA sequence
tgggaagaaaacatctaatg

SEQ ID NO: 24105 - DNA, 20 bp, Artificial
  CRISPR gRNA sequence
ggaagaaaacatctaatgaa

SEQ ID NO: 24106 - DNA, 20 bp, Artificial
  CRISPR gRNA sequence
atgaactggacgtaatctca

SEQ ID NO: 24107 - DNA, 20 bp, Artificial
  CRISPR gRNA sequence
gacgtaatctcagcgcctgc

SEQ ID NO: 24108 - DNA, 20 bp, Artificial
  CRISPR gRNA sequence
agcgcctgcgtctgtaaaat

SEQ ID NO: 24109 - DNA, 20 bp, Artificial
  CRISPR gRNA sequence
cgtctgtaaaatggctataa

SEQ ID NO: 24110 - DNA, 20 bp, Artificial
  CRISPR gRNA sequence
taaaatggctataataacaa

SEQ ID NO: 24111 - DNA, 20 bp, Artificial
  CRISPR gRNA sequence
taataacaacaatctcccag

SEQ ID NO: 24112 - DNA, 20 bp, Artificial
  CRISPR gRNA sequence
ccagagttgccgttaacagt

SEQ ID NO: 24113 - DNA, 20 bp, Artificial
  CRISPR gRNA sequence
ccgttaacagttgaaacaga

SEQ ID NO: 24114 - DNA, 20 bp, Artificial
  CRISPR gRNA sequence
acagttgaaacagaatagta

SEQ ID NO: 24115 - DNA, 20 bp, Artificial
  CRISPR gRNA sequence
aaacagaatagtaaatgcaa

SEQ ID NO: 24116 - DNA, 20 bp, Artificial
  CRISPR gRNA sequence
gcacagccccagacacagag

SEQ ID NO: 24117 - DNA, 20 bp, Artificial
  CRISPR gRNA sequence
ccctggtcactctcacagag

SEQ ID NO: 24118 - DNA, 20 bp, Artificial
  CRISPR gRNA sequence
gtcactctcacagaggtaag

SEQ ID NO: 24119 - DNA, 20 bp, Artificial
  CRISPR gRNA sequence
tcacagaggtaagaagcaca

SEQ ID NO: 24120 - DNA, 20 bp, Artificial
  CRISPR gRNA sequence
acagaggtaagaagcacatt

SEQ ID NO: 24121 - DNA, 20 bp, Artificial
  CRISPR gRNA sequence
ataataaaaatggtcatcac

SEQ ID NO: 24122 - DNA, 20 bp, Artificial
  CRISPR gRNA sequence
tactcaccatgcagaagttg

SEQ ID NO: 24123 - DNA, 20 bp, Artificial
  CRISPR gRNA sequence
accatgcagaagttgtgctg

SEQ ID NO: 24124 - DNA, 20 bp, Artificial
  CRISPR gRNA sequence
tgctgccttaagctactgtt

SEQ ID NO: 24125 - DNA, 20 bp, Artificial
  CRISPR gRNA sequence
ccttaagctactgttcattg

SEQ ID NO: 24126 - DNA, 20 bp, Artificial
  CRISPR gRNA sequence
aagctactgttcattgagca

SEQ ID NO: 24127 - DNA, 20 bp, Artificial
  CRISPR gRNA sequence
agctactgttcattgagcac

SEQ ID NO: 24128 - DNA, 20 bp, Artificial
  CRISPR gRNA sequence
ctgttcattgagcacttact

SEQ ID NO: 24129 - DNA, 20 bp, Artificial
  CRISPR gRNA sequence
ttcattgagcacttactggt

SEQ ID NO: 24130 - DNA, 20 bp, Artificial
  CRISPR gRNA sequence
attgagcacttactggtcgc

SEQ ID NO: 24131 - DNA, 20 bp, Artificial
  CRISPR gRNA sequence
agcacttactggtcgccagt

SEQ ID NO: 24132 - DNA, 20 bp, Artificial
  CRISPR gRNA sequence
actggtcgccagtccccttt

SEQ ID NO: 24133 - DNA, 20 bp, Artificial
  CRISPR gRNA sequence
ctggtcgccagtcccctttc

SEQ ID NO: 24134 - DNA, 20 bp, Artificial
  CRISPR gRNA sequence
gtcgccagtcccctttctaa

SEQ ID NO: 24135 - DNA, 20 bp, Artificial
  CRISPR gRNA sequence
tctaagggctccatgcaact

SEQ ID NO: 24136 - DNA, 20 bp, Artificial
  CRISPR gRNA sequence
ctaagggctccatgcaactt

SEQ ID NO: 24137 - DNA, 20 bp, Artificial
  CRISPR gRNA sequence
taagggctccatgcaactta

SEQ ID NO: 24138 - DNA, 20 bp, Artificial
  CRISPR gRNA sequence
agggctccatgcaacttaac

SEQ ID NO: 24139 - DNA, 20 bp, Artificial
  CRISPR gRNA sequence
catgcaacttaactccccta

SEQ ID NO: 24140 - DNA, 20 bp, Artificial
  CRISPR gRNA sequence
aactcccctaatcctatgag

SEQ ID NO: 24141 - DNA, 20 bp, Artificial
  CRISPR gRNA sequence
actcccctaatcctatgagt

SEQ ID NO: 24142 - DNA, 20 bp, Artificial
  CRISPR gRNA sequence
ccctaatcctatgagttgcc

SEQ ID NO: 24143 - DNA, 20 bp, Artificial
  CRISPR gRNA sequence
atcctatgagttgccaatta

SEQ ID NO: 24144 - DNA, 20 bp, Artificial
  CRISPR gRNA sequence
tgagttgccaattattatcc

SEQ ID NO: 24145 - DNA, 20 bp, Artificial
  CRISPR gRNA sequence
ccaattattatcccccactt

SEQ ID NO: 24146 - DNA, 20 bp, Artificial
  CRISPR gRNA sequence
ttatcccccactttacagat

SEQ ID NO: 24147 - DNA, 20 bp, Artificial
  CRISPR gRNA sequence
tcccccactttacagataag

SEQ ID NO: 24148 - DNA, 20 bp, Artificial
  CRISPR gRNA sequence
tacagataaggaaactgagg

SEQ ID NO: 24149 - DNA, 20 bp, Artificial
  CRISPR gRNA sequence
acagataaggaaactgaggc

SEQ ID NO: 24150 - DNA, 20 bp, Artificial
  CRISPR gRNA sequence
cagataaggaaactgaggct

SEQ ID NO: 24151 - DNA, 20 bp, Artificial
  CRISPR gRNA sequence
aggctccaagtggtttaaaa

SEQ ID NO: 24152 - DNA, 20 bp, Artificial
  CRISPR gRNA sequence
caagtggtttaaaaaatgaa

SEQ ID NO: 24153 - DNA, 20 bp, Artificial
  CRISPR gRNA sequence
aaaaaatgaacttacccaga

SEQ ID NO: 24154 - DNA, 20 bp, Artificial
  CRISPR gRNA sequence
aaaaatgaacttacccagat

SEQ ID NO: 24155 - DNA, 20 bp, Artificial
  CRISPR gRNA sequence
acccagattgtagtgcgttg

SEQ ID NO: 24156 - DNA, 20 bp, Artificial
  CRISPR gRNA sequence
cccagattgtagtgcgttgg

SEQ ID NO: 24157 - DNA, 20 bp, Artificial
  CRISPR gRNA sequence
tagtgcgttggtaggtaggg

SEQ ID NO: 24158 - DNA, 20 bp, Artificial
  CRISPR gRNA sequence
gtaggtagggataacctgaa

SEQ ID NO: 24159 - DNA, 20 bp, Artificial
  CRISPR gRNA sequence
aaagttgggaaatttcaccc

SEQ ID NO: 24160 - DNA, 20 bp, Artificial
  CRISPR gRNA sequence
ggaaatttcaccccaaagct

SEQ ID NO: 24161 - DNA, 20 bp, Artificial
  CRISPR gRNA sequence
caccccaaagctcaccatct

SEQ ID NO: 24162 - DNA, 20 bp, Artificial
  CRISPR gRNA sequence
accccaaagctcaccatctg

SEQ ID NO: 24163 - DNA, 20 bp, Artificial
  CRISPR gRNA sequence
accatctgagctccattcat

SEQ ID NO: 24164 - DNA, 20 bp, Artificial
  CRISPR gRNA sequence
agctccattcatctcccacc

SEQ ID NO: 24165 - DNA, 20 bp, Artificial
  CRISPR gRNA sequence
cattcatctcccaccagctg

SEQ ID NO: 24166 - DNA, 20 bp, Artificial
  CRISPR gRNA sequence
atctcccaccagctgagatg

SEQ ID NO: 24167 - DNA, 20 bp, Artificial
  CRISPR gRNA sequence
ccaccagctgagatggaacg

SEQ ID NO: 24168 - DNA, 20 bp, Artificial
  CRISPR gRNA sequence
agatggaacgttatgctgtt

SEQ ID NO: 24169 - DNA, 20 bp, Artificial
  CRISPR gRNA sequence
tgctgttcccagaagagatg

SEQ ID NO: 24170 - DNA, 20 bp, Artificial
  CRISPR gRNA sequence
ttcccagaagagatgcatgc

SEQ ID NO: 24171 - DNA, 20 bp, Artificial
  CRISPR gRNA sequence
ccagaagagatgcatgcact

SEQ ID NO: 24172 - DNA, 20 bp, Artificial
  CRISPR gRNA sequence
atcttcagatagtttaagtc

SEQ ID NO: 24173 - DNA, 20 bp, Artificial
  CRISPR gRNA sequence
cagatagtttaagtctgagt

SEQ ID NO: 24174 - DNA, 20 bp, Artificial
  CRISPR gRNA sequence
agatagtttaagtctgagtt

SEQ ID NO: 24175 - DNA, 20 bp, Artificial
  CRISPR gRNA sequence
aagtctgagttagaacattg

SEQ ID NO: 24176 - DNA, 20 bp, Artificial
  CRISPR gRNA sequence
agtctgagttagaacattgt

SEQ ID NO: 24177 - DNA, 20 bp, Artificial
  CRISPR gRNA sequence
agttagaacattgtggcgac

SEQ ID NO: 24178 - DNA, 20 bp, Artificial
  CRISPR gRNA sequence
gaacattgtggcgacacctg

SEQ ID NO: 24179 - DNA, 20 bp, Artificial
  CRISPR gRNA sequence
tggcgacacctgatttccct

SEQ ID NO: 24180 - DNA, 20 bp, Artificial
  CRISPR gRNA sequence
atttccctcgggggagagag

SEQ ID NO: 24181 - DNA, 20 bp, Artificial
  CRISPR gRNA sequence
ccctcgggggagagagaggt

SEQ ID NO: 24182 - DNA, 20 bp, Artificial
  CRISPR gRNA sequence
cctcgggggagagagaggtg

SEQ ID NO: 24183 - DNA, 20 bp, Artificial
  CRISPR gRNA sequence
gggggagagagaggtgaatt

SEQ ID NO: 24184 - DNA, 20 bp, Artificial
  CRISPR gRNA sequence
ttatttcagacacctgttta

SEQ ID NO: 24185 - DNA, 20 bp, Artificial
  CRISPR gRNA sequence
tttcagacacctgtttagtg

SEQ ID NO: 24186 - DNA, 20 bp, Artificial
  CRISPR gRNA sequence
cagacacctgtttagtgtct

SEQ ID NO: 24187 - DNA, 20 bp, Artificial
  CRISPR gRNA sequence
agacacctgtttagtgtcta

SEQ ID NO: 24188 - DNA, 20 bp, Artificial
  CRISPR gRNA sequence
tttagtgtctacacttagcc

SEQ ID NO: 24189 - DNA, 20 bp, Artificial
  CRISPR gRNA sequence
agtgtctacacttagccttt

SEQ ID NO: 24190 - DNA, 20 bp, Artificial
  CRISPR gRNA sequence
gtgtctacacttagcctttc

SEQ ID NO: 24191 - DNA, 20 bp, Artificial
  CRISPR gRNA sequence
cacttagcctttcaaatcct

SEQ ID NO: 24192 - DNA, 20 bp, Artificial
  CRISPR gRNA sequence
agcctttcaaatcctgcatg

SEQ ID NO: 24193 - DNA, 20 bp, Artificial
  CRISPR gRNA sequence
gcctttcaaatcctgcatgc

SEQ ID NO: 24194 - DNA, 20 bp, Artificial
  CRISPR gRNA sequence
tcaaatcctgcatgcagtgt

SEQ ID NO: 24195 - DNA, 20 bp, Artificial
  CRISPR gRNA sequence
caaatcctgcatgcagtgtg

SEQ ID NO: 24196 - DNA, 20 bp, Artificial
  CRISPR gRNA sequence
aaatcctgcatgcagtgtga

SEQ ID NO: 24197 - DNA, 20 bp, Artificial
  CRISPR gRNA sequence
catgcagtgtgaagtgggga

SEQ ID NO: 24198 - DNA, 20 bp, Artificial
  CRISPR gRNA sequence
ttgatggcaaaaagatcagg

SEQ ID NO: 24199 - DNA, 20 bp, Artificial
  CRISPR gRNA sequence
tgatggcaaaaagatcagga

SEQ ID NO: 24200 - DNA, 20 bp, Artificial
  CRISPR gRNA sequence
gatggcaaaaagatcaggaa

SEQ ID NO: 24201 - DNA, 20 bp, Artificial
  CRISPR gRNA sequence
atggcaaaaagatcaggaat

SEQ ID NO: 24202 - DNA, 20 bp, Artificial
  CRISPR gRNA sequence
tctcgagttggatgtggaag

SEQ ID NO: 24203 - DNA, 20 bp, Artificial
  CRISPR gRNA sequence
ctcgagttggatgtggaagg

SEQ ID NO: 24204 - DNA, 20 bp, Artificial
  CRISPR gRNA sequence
tcgagttggatgtggaaggt

SEQ ID NO: 24205 - DNA, 20 bp, Artificial
  CRISPR gRNA sequence
gagttggatgtggaaggtgg

SEQ ID NO: 24206 - DNA, 20 bp, Artificial
  CRISPR gRNA sequence
gatgtggaaggtggtggccc

SEQ ID NO: 24207 - DNA, 20 bp, Artificial
  CRISPR gRNA sequence
caaagaggaccttctaaaaa

SEQ ID NO: 24208 - DNA, 20 bp, Artificial
  CRISPR gRNA sequence
aaagaggaccttctaaaaat

SEQ ID NO: 24209 - DNA, 20 bp, Artificial
  CRISPR gRNA sequence
ctaaaaatactgcccattta

SEQ ID NO: 24210 - DNA, 20 bp, Artificial
  CRISPR gRNA sequence
taaaaatactgcccatttac

SEQ ID NO: 24211 - DNA, 20 bp, Artificial
  CRISPR gRNA sequence
aaaatactgcccatttacca

SEQ ID NO: 24212 - DNA, 20 bp, Artificial
  CRISPR gRNA sequence
cccatttaccaaaaagacac

SEQ ID NO: 24213 - DNA, 20 bp, Artificial
  CRISPR gRNA sequence
accaaaaagacacagaccgc

SEQ ID NO: 24214 - DNA, 20 bp, Artificial
  CRISPR gRNA sequence
ccaaaaagacacagaccgcg

SEQ ID NO: 24215 - DNA, 20 bp, Artificial
  CRISPR gRNA sequence
tgccctgcccccacatggct

SEQ ID NO: 24216 - DNA, 20 bp, Artificial
  CRISPR gRNA sequence
ccctgcccccacatggctcc

SEQ ID NO: 24217 - DNA, 20 bp, Artificial
  CRISPR gRNA sequence
cccccacatggctcctcaaa

SEQ ID NO: 24218 - DNA, 20 bp, Artificial
  CRISPR gRNA sequence
ctcaaaaggagaaattgtct

SEQ ID NO: 24219 - DNA, 20 bp, Artificial
  CRISPR gRNA sequence
aaaaggagaaattgtcttgc

SEQ ID NO: 24220 - DNA, 20 bp, Artificial
  CRISPR gRNA sequence
tcttgccacccacgccttcc

SEQ ID NO: 24221 - DNA, 20 bp, Artificial
  CRISPR gRNA sequence
gccacccacgccttccctcg

SEQ ID NO: 24222 - DNA, 20 bp, Artificial
  CRISPR gRNA sequence
ccacccacgccttccctcgc

SEQ ID NO: 24223 - DNA, 20 bp, Artificial
  CRISPR gRNA sequence
ccctcgccggggtgctgggg

SEQ ID NO: 24224 - DNA, 20 bp, Artificial
  CRISPR gRNA sequence
cctcgccggggtgctggggg

SEQ ID NO: 24225 - DNA, 20 bp, Artificial
  CRISPR gRNA sequence
gccggggtgctggggggcca

SEQ ID NO: 24226 - DNA, 20 bp, Artificial
  CRISPR gRNA sequence
gggggccaacagcaattcaa

SEQ ID NO: 24227 - DNA, 20 bp, Artificial
  CRISPR gRNA sequence
aaaaaggctatagagtgggc

SEQ ID NO: 24228 - DNA, 20 bp, Artificial
  CRISPR gRNA sequence
tagagtgggctgagactttg

SEQ ID NO: 24229 - DNA, 20 bp, Artificial
  CRISPR gRNA sequence
agactttggagatgggtagt

SEQ ID NO: 24230 - DNA, 20 bp, Artificial
  CRISPR gRNA sequence
tggagatgggtagtttggtt

SEQ ID NO: 24231 - DNA, 20 bp, Artificial
  CRISPR gRNA sequence
ggagatgggtagtttggttc

SEQ ID NO: 24232 - DNA, 20 bp, Artificial
  CRISPR gRNA sequence
gagatgggtagtttggttca

SEQ ID NO: 24233 - DNA, 20 bp, Artificial
  CRISPR gRNA sequence
ggttcaaatctcagcccact

SEQ ID NO: 24234 - DNA, 20 bp, Artificial
  CRISPR gRNA sequence
gttcaaatctcagcccacta

SEQ ID NO: 24235 - DNA, 20 bp, Artificial
  CRISPR gRNA sequence
aaatctcagcccactaatcc

SEQ ID NO: 24236 - DNA, 20 bp, Artificial
  CRISPR gRNA sequence
agcccactaatccctctgag

SEQ ID NO: 24237 - DNA, 20 bp, Artificial
  CRISPR gRNA sequence
atccctctgagcctgtctct

SEQ ID NO: 24238 - DNA, 20 bp, Artificial
  CRISPR gRNA sequence
tgagcctgtctcttcatctg

SEQ ID NO: 24239 - DNA, 20 bp, Artificial
  CRISPR gRNA sequence
agcctgtctcttcatctgaa

SEQ ID NO: 24240 - DNA, 20 bp, Artificial
  CRISPR gRNA sequence
tctcttcatctgaaaaacag

SEQ ID NO: 24241 - DNA, 20 bp, Artificial
  CRISPR gRNA sequence
ttcatctgaaaaacaggaat

SEQ ID NO: 24242 - DNA, 20 bp, Artificial
  CRISPR gRNA sequence
catctgaaaaacaggaatac

SEQ ID NO: 24243 - DNA, 20 bp, Artificial
  CRISPR gRNA sequence
atctgaaaaacaggaataca

SEQ ID NO: 24244 - DNA, 20 bp, Artificial
  CRISPR gRNA sequence
aaaaacaggaatacaaatag

SEQ ID NO: 24245 - DNA, 20 bp, Artificial
  CRISPR gRNA sequence
atgtgtaagttagaccaaat

SEQ ID NO: 24246 - DNA, 20 bp, Artificial
  CRISPR gRNA sequence
gaccaaatggggtaatgcct

SEQ ID NO: 24247 - DNA, 20 bp, Artificial
  CRISPR gRNA sequence
cgagtcatgtcatttggtac

SEQ ID NO: 24248 - DNA, 20 bp, Artificial
  CRISPR gRNA sequence
ggtacctggcacttgctgga

SEQ ID NO: 24249 - DNA, 20 bp, Artificial
  CRISPR gRNA sequence
gtacctggcacttgctggac

SEQ ID NO: 24250 - DNA, 20 bp, Artificial
  CRISPR gRNA sequence
gcacttgctggacactgtga

SEQ ID NO: 24251 - DNA, 20 bp, Artificial
  CRISPR gRNA sequence
gctggacactgtgaattcta

SEQ ID NO: 24252 - DNA, 20 bp, Artificial
  CRISPR gRNA sequence
ctggacactgtgaattctag

SEQ ID NO: 24253 - DNA, 20 bp, Artificial
  CRISPR gRNA sequence
gacactgtgaattctagttc

SEQ ID NO: 24254 - DNA, 20 bp, Artificial
  CRISPR gRNA sequence
tgaattctagttctatatca

SEQ ID NO: 24255 - DNA, 20 bp, Artificial
  CRISPR gRNA sequence
tagttctatatcattgccac

SEQ ID NO: 24256 - DNA, 20 bp, Artificial
  CRISPR gRNA sequence
gttctatatcattgccacgg

SEQ ID NO: 24257 - DNA, 20 bp, Artificial
  CRISPR gRNA sequence
tatatcattgccacggatga

SEQ ID NO: 24258 - DNA, 20 bp, Artificial
  CRISPR gRNA sequence
tatcattgccacggatgaag

SEQ ID NO: 24259 - DNA, 20 bp, Artificial
  CRISPR gRNA sequence
ccacggatgaagagaggctg

SEQ ID NO: 24260 - DNA, 20 bp, Artificial
  CRISPR gRNA sequence
ccatgcgcagaaacatgctg

SEQ ID NO: 24261 - DNA, 20 bp, Artificial
  CRISPR gRNA sequence
agagctgggagaaggtgagc

SEQ ID NO: 24262 - DNA, 20 bp, Artificial
  CRISPR gRNA sequence
ggagaaggtgagctagaggg

SEQ ID NO: 24263 - DNA, 20 bp, Artificial
  CRISPR gRNA sequence
gagggatacagtccctgccc

SEQ ID NO: 24264 - DNA, 20 bp, Artificial
  CRISPR gRNA sequence
ccctcagggagagctgaagg

SEQ ID NO: 24265 - DNA, 20 bp, Artificial
  CRISPR gRNA sequence
agggagagctgaagggctct

SEQ ID NO: 24266 - DNA, 20 bp, Artificial
  CRISPR gRNA sequence
aagggctctctctcctgcca

SEQ ID NO: 24267 - DNA, 20 bp, Artificial
  CRISPR gRNA sequence
tctctcctgccacgggatga

SEQ ID NO: 24268 - DNA, 20 bp, Artificial
  CRISPR gRNA sequence
tctcctgccacgggatgatc

SEQ ID NO: 24269 - DNA, 20 bp, Artificial
  CRISPR gRNA sequence
tcctgccacgggatgatcag

SEQ ID NO: 24270 - DNA, 20 bp, Artificial
  CRISPR gRNA sequence
ctgccacgggatgatcaggg

SEQ ID NO: 24271 - DNA, 20 bp, Artificial
  CRISPR gRNA sequence
ccacgggatgatcagggcca

SEQ ID NO: 24272 - DNA, 20 bp, Artificial
  CRISPR gRNA sequence
ttccctccatcccgctctgg

SEQ ID NO: 24273 - DNA, 20 bp, Artificial
  CRISPR gRNA sequence
tccctccatcccgctctggc

SEQ ID NO: 24274 - DNA, 20 bp, Artificial
  CRISPR gRNA sequence
ccctccatcccgctctggca

SEQ ID NO: 24275 - DNA, 20 bp, Artificial
  CRISPR gRNA sequence
cctccatcccgctctggcaa

SEQ ID NO: 24276 - DNA, 20 bp, Artificial
  CRISPR gRNA sequence
catcccgctctggcaatgtg

SEQ ID NO: 24277 - DNA, 20 bp, Artificial
  CRISPR gRNA sequence
tggcaatgtggtttggagaa

SEQ ID NO: 24278 - DNA, 20 bp, Artificial
  CRISPR gRNA sequence
gcaatgtggtttggagaaac

SEQ ID NO: 24279 - DNA, 20 bp, Artificial
  CRISPR gRNA sequence
ggagaaacagtccaatgaag

SEQ ID NO: 24280 - DNA, 20 bp, Artificial
  CRISPR gRNA sequence
gagaaacagtccaatgaagg

SEQ ID NO: 24281 - DNA, 20 bp, Artificial
  CRISPR gRNA sequence
tgaagcacttcctaagcatc

SEQ ID NO: 24282 - DNA, 20 bp, Artificial
  CRISPR gRNA sequence
gaagcacttcctaagcatct

SEQ ID NO: 24283 - DNA, 20 bp, Artificial
  CRISPR gRNA sequence
aagcacttcctaagcatcta

SEQ ID NO: 24284 - DNA, 20 bp, Artificial
  CRISPR gRNA sequence
cctaagcatctatagacata

SEQ ID NO: 24285 - DNA, 20 bp, Artificial
  CRISPR gRNA sequence
ctaagcatctatagacatag

SEQ ID NO: 24286 - DNA, 20 bp, Artificial
  CRISPR gRNA sequence
agcatctatagacataggaa

SEQ ID NO: 24287 - DNA, 20 bp, Artificial
  CRISPR gRNA sequence
tagacataggaaacttggct

SEQ ID NO: 24288 - DNA, 20 bp, Artificial
  CRISPR gRNA sequence
ggctctggggatagaggaag

SEQ ID NO: 24289 - DNA, 20 bp, Artificial
  CRISPR gRNA sequence
gctctggggatagaggaagg

SEQ ID NO: 24290 - DNA, 20 bp, Artificial
  CRISPR gRNA sequence
tggggatagaggaaggtccc

SEQ ID NO: 24291 - DNA, 20 bp, Artificial
  CRISPR gRNA sequence
gggatagaggaaggtcccat

SEQ ID NO: 24292 - DNA, 20 bp, Artificial
  CRISPR gRNA sequence
aagtagatcttggtgtgact

SEQ ID NO: 24293 - DNA, 20 bp, Artificial
  CRISPR gRNA sequence
ggtgtgactgggaggcagct

SEQ ID NO: 24294 - DNA, 20 bp, Artificial
  CRISPR gRNA sequence
gtgtgactgggaggcagctg

SEQ ID NO: 24295 - DNA, 20 bp, Artificial
  CRISPR gRNA sequence
ggaggcagctgtggcgttgt

SEQ ID NO: 24296 - DNA, 20 bp, Artificial
  CRISPR gRNA sequence
tggcgttgtggggaaaccta

SEQ ID NO: 24297 - DNA, 20 bp, Artificial
  CRISPR gRNA sequence
tggggaaacctagagtcttg

SEQ ID NO: 24298 - DNA, 20 bp, Artificial
  CRISPR gRNA sequence
gagtcttgggcctgaatttc

SEQ ID NO: 24299 - DNA, 20 bp, Artificial
  CRISPR gRNA sequence
gggcctgaatttcagctttg

SEQ ID NO: 24300 - DNA, 20 bp, Artificial
  CRISPR gRNA sequence
ggcctgaatttcagctttga

SEQ ID NO: 24301 - DNA, 20 bp, Artificial
  CRISPR gRNA sequence
aatttcagctttgacaccct

SEQ ID NO: 24302 - DNA, 20 bp, Artificial
  CRISPR gRNA sequence
cagctttgacaccctctaat

SEQ ID NO: 24303 - DNA, 20 bp, Artificial
  CRISPR gRNA sequence
agctttgacaccctctaatg

SEQ ID NO: 24304 - DNA, 20 bp, Artificial
  CRISPR gRNA sequence
tgacaccctctaatgtaatg

SEQ ID NO: 24305 - DNA, 20 bp, Artificial
  CRISPR gRNA sequence
gacaccctctaatgtaatgg

SEQ ID NO: 24306 - DNA, 20 bp, Artificial
  CRISPR gRNA sequence
acaccctctaatgtaatggg

SEQ ID NO: 24307 - DNA, 20 bp, Artificial
  CRISPR gRNA sequence
taatgtaatgggcttccttt

SEQ ID NO: 24308 - DNA, 20 bp, Artificial
  CRISPR gRNA sequence
atgtaatgggcttcctttga

SEQ ID NO: 24309 - DNA, 20 bp, Artificial
  CRISPR gRNA sequence
cctttgactgtaggcttccc

SEQ ID NO: 24310 - DNA, 20 bp, Artificial
  CRISPR gRNA sequence
ctttgactgtaggcttccca

SEQ ID NO: 24311 - DNA, 20 bp, Artificial
  CRISPR gRNA sequence
tgactgtaggcttcccacat

SEQ ID NO: 24312 - DNA, 20 bp, Artificial
  CRISPR gRNA sequence
gactgtaggcttcccacata

SEQ ID NO: 24313 - DNA, 20 bp, Artificial
  CRISPR gRNA sequence
actgtaggcttcccacatag

SEQ ID NO: 24314 - DNA, 20 bp, Artificial
  CRISPR gRNA sequence
taggcttcccacatagctgg

SEQ ID NO: 24315 - DNA, 20 bp, Artificial
  CRISPR gRNA sequence
cccacatagctggcacccca

SEQ ID NO: 24316 - DNA, 20 bp, Artificial
  CRISPR gRNA sequence
ccacatagctggcaccccac

SEQ ID NO: 24317 - DNA, 20 bp, Artificial
  CRISPR gRNA sequence
gcaccccacacagaactccc

SEQ ID NO: 24318 - DNA, 20 bp, Artificial
  CRISPR gRNA sequence
ccttggccttctgatgatcc

SEQ ID NO: 24319 - DNA, 20 bp, Artificial
  CRISPR gRNA sequence
ggccttctgatgatcctgca

SEQ ID NO: 24320 - DNA, 20 bp, Artificial
  CRISPR gRNA sequence
gccttctgatgatcctgcag

SEQ ID NO: 24321 - DNA, 20 bp, Artificial
  CRISPR gRNA sequence
ctgatgatcctgcaggacaa

SEQ ID NO: 24322 - DNA, 20 bp, Artificial
  CRISPR gRNA sequence
tgatgatcctgcaggacaat

SEQ ID NO: 24323 - DNA, 20 bp, Artificial
  CRISPR gRNA sequence
atgatcctgcaggacaatct

SEQ ID NO: 24324 - DNA, 20 bp, Artificial
  CRISPR gRNA sequence
caggacaatcttttttgttt

SEQ ID NO: 24325 - DNA, 20 bp, Artificial
  CRISPR gRNA sequence
ttttgttttttgttttttgt

SEQ ID NO: 24326 - DNA, 20 bp, Artificial
  CRISPR gRNA sequence
tttgttttttgttttttgtt

SEQ ID NO: 24327 - DNA, 20 bp, Artificial
  CRISPR gRNA sequence
ttgttttttgttttttgttt

SEQ ID NO: 24328 - DNA, 20 bp, Artificial
  CRISPR gRNA sequence
tgttttttgttttttgtttt

SEQ ID NO: 24329 - DNA, 20 bp, Artificial
  CRISPR gRNA sequence
gttttttgttttttgttttt

SEQ ID NO: 24330 - DNA, 20 bp, Artificial
  CRISPR gRNA sequence
ttttttgttttttgtttttt

SEQ ID NO: 24331 - DNA, 20 bp, Artificial
  CRISPR gRNA sequence
tttgttttttgttttttttt

SEQ ID NO: 24332 - DNA, 20 bp, Artificial
  CRISPR gRNA sequence
ttgttttttgtttttttttt

SEQ ID NO: 24333 - DNA, 20 bp, Artificial
  CRISPR gRNA sequence
tgttttttgttttttttttg

SEQ ID NO: 24334 - DNA, 20 bp, Artificial
  CRISPR gRNA sequence
gttttttgttttttttttga

SEQ ID NO: 24335 - DNA, 20 bp, Artificial
  CRISPR gRNA sequence
ttttttgttttttttttgag

SEQ ID NO: 24336 - DNA, 20 bp, Artificial
  CRISPR gRNA sequence
tttgttttttttttgagatg

SEQ ID NO: 24337 - DNA, 20 bp, Artificial
  CRISPR gRNA sequence
ttgttttttttttgagatgg

SEQ ID NO: 24338 - DNA, 20 bp, Artificial
  CRISPR gRNA sequence
tgttttttttttgagatggt

SEQ ID NO: 24339 - DNA, 20 bp, Artificial
  CRISPR gRNA sequence
gttttttttttgagatggta

SEQ ID NO: 24340 - DNA, 20 bp, Artificial
  CRISPR gRNA sequence
ttttttttttgagatggtat

SEQ ID NO: 24341 - DNA, 20 bp, Artificial
  CRISPR gRNA sequence
tttttttgagatggtatctc

SEQ ID NO: 24342 - DNA, 20 bp, Artificial
  CRISPR gRNA sequence
ttttttgagatggtatctca

SEQ ID NO: 24343 - DNA, 20 bp, Artificial
  CRISPR gRNA sequence
tttttgagatggtatctcac

SEQ ID NO: 24344 - DNA, 20 bp, Artificial
  CRISPR gRNA sequence
ttttgagatggtatctcact

SEQ ID NO: 24345 - DNA, 20 bp, Artificial
  CRISPR gRNA sequence
tttgagatggtatctcactt

SEQ ID NO: 24346 - DNA, 20 bp, Artificial
  CRISPR gRNA sequence
ttgagatggtatctcacttt

SEQ ID NO: 24347 - DNA, 20 bp, Artificial
  CRISPR gRNA sequence
tgagatggtatctcactttg

SEQ ID NO: 24348 - DNA, 20 bp, Artificial
  CRISPR gRNA sequence
gagatggtatctcactttgt

SEQ ID NO: 24349 - DNA, 20 bp, Artificial
  CRISPR gRNA sequence
agatggtatctcactttgtc

SEQ ID NO: 24350 - DNA, 20 bp, Artificial
  CRISPR gRNA sequence
actttgtcgcccaggctgga

SEQ ID NO: 24351 - DNA, 20 bp, Artificial
  CRISPR gRNA sequence
tgtcgcccaggctggagtgc

SEQ ID NO: 24352 - DNA, 20 bp, Artificial
  CRISPR gRNA sequence
gtcgcccaggctggagtgca

SEQ ID NO: 24353 - DNA, 20 bp, Artificial
  CRISPR gRNA sequence
tcgcccaggctggagtgcag

SEQ ID NO: 24354 - DNA, 20 bp, Artificial
  CRISPR gRNA sequence
gagtgcagtggcgcagtctt

SEQ ID NO: 24355 - DNA, 20 bp, Artificial
  CRISPR gRNA sequence
ggttcactgcagcctctgcc

SEQ ID NO: 24356 - DNA, 20 bp, Artificial
  CRISPR gRNA sequence
gttcactgcagcctctgcct

SEQ ID NO: 24357 - DNA, 20 bp, Artificial
  CRISPR gRNA sequence
actgcagcctctgcctccca

SEQ ID NO: 24358 - DNA, 20 bp, Artificial
  CRISPR gRNA sequence
cagcctctgcctcccaggtt

SEQ ID NO: 24359 - DNA, 20 bp, Artificial
  CRISPR gRNA sequence
tgcctcccaggttcaagcga

SEQ ID NO: 24360 - DNA, 20 bp, Artificial
  CRISPR gRNA sequence
cctcccaggttcaagcgatt

SEQ ID NO: 24361 - DNA, 20 bp, Artificial
  CRISPR gRNA sequence
ccaggttcaagcgattctcc

SEQ ID NO: 24362 - DNA, 20 bp, Artificial
  CRISPR gRNA sequence
aagcgattctcctgcctcag

SEQ ID NO: 24363 - DNA, 20 bp, Artificial
  CRISPR gRNA sequence
tcctgcctcagcctcccaag

SEQ ID NO: 24364 - DNA, 20 bp, Artificial
  CRISPR gRNA sequence
ctgcctcagcctcccaagta

SEQ ID NO: 24365 - DNA, 20 bp, Artificial
  CRISPR gRNA sequence
cctcagcctcccaagtagct

SEQ ID NO: 24366 - DNA, 20 bp, Artificial
  CRISPR gRNA sequence
agcctcccaagtagctggga

SEQ ID NO: 24367 - DNA, 20 bp, Artificial
  CRISPR gRNA sequence
ccaagtagctgggattacag

SEQ ID NO: 24368 - DNA, 20 bp, Artificial
  CRISPR gRNA sequence
ggattacagaagcacgccac

SEQ ID NO: 24369 - DNA, 20 bp, Artificial
  CRISPR gRNA sequence
cagaagcacgccaccatgcc

SEQ ID NO: 24370 - DNA, 20 bp, Artificial
  CRISPR gRNA sequence
gctaattttgtatttttagt

SEQ ID NO: 24371 - DNA, 20 bp, Artificial
  CRISPR gRNA sequence
attttgtatttttagtagag

SEQ ID NO: 24372 - DNA, 20 bp, Artificial
  CRISPR gRNA sequence
tgtatttttagtagagacgg

SEQ ID NO: 24373 - DNA, 20 bp, Artificial
  CRISPR gRNA sequence
gtatttttagtagagacggg

SEQ ID NO: 24374 - DNA, 20 bp, Artificial
  CRISPR gRNA sequence
tatttttagtagagacggga

SEQ ID NO: 24375 - DNA, 20 bp, Artificial
  CRISPR gRNA sequence
ttagtagagacgggatttca

SEQ ID NO: 24376 - DNA, 20 bp, Artificial
  CRISPR gRNA sequence
tagtagagacgggatttcac

SEQ ID NO: 24377 - DNA, 20 bp, Artificial
  CRISPR gRNA sequence
agtagagacgggatttcacc

SEQ ID NO: 24378 - DNA, 20 bp, Artificial
  CRISPR gRNA sequence
gtagagacgggatttcacca

SEQ ID NO: 24379 - DNA, 20 bp, Artificial
  CRISPR gRNA sequence
caccatgttgcccgggctgg

SEQ ID NO: 24380 - DNA, 20 bp, Artificial
  CRISPR gRNA sequence
accatgttgcccgggctggt

SEQ ID NO: 24381 - DNA, 20 bp, Artificial
  CRISPR gRNA sequence
cccgggctggtctcaaactc

SEQ ID NO: 24382 - DNA, 20 bp, Artificial
  CRISPR gRNA sequence
gtctcaaactcctgacctca

SEQ ID NO: 24383 - DNA, 20 bp, Artificial
  CRISPR gRNA sequence
aaactcctgacctcaagtga

SEQ ID NO: 24384 - DNA, 20 bp, Artificial
  CRISPR gRNA sequence
ctgacctcaagtgatctgcc

SEQ ID NO: 24385 - DNA, 20 bp, Artificial
  CRISPR gRNA sequence
acctcaagtgatctgcctgc

SEQ ID NO: 24386 - DNA, 20 bp, Artificial
  CRISPR gRNA sequence
aagtgatctgcctgcctcgg

SEQ ID NO: 24387 - DNA, 20 bp, Artificial
  CRISPR gRNA sequence
cctgcctcggcctcccacag

SEQ ID NO: 24388 - DNA, 20 bp, Artificial
  CRISPR gRNA sequence
cctcggcctcccacagtggt

SEQ ID NO: 24389 - DNA, 20 bp, Artificial
  CRISPR gRNA sequence
ggcctcccacagtggtgggc

SEQ ID NO: 24390 - DNA, 20 bp, Artificial
  CRISPR gRNA sequence
ccacagtggtgggctgcaag

SEQ ID NO: 24391 - DNA, 20 bp, Artificial
  CRISPR gRNA sequence
caaggcaatcttcattctcc

SEQ ID NO: 24392 - DNA, 20 bp, Artificial
  CRISPR gRNA sequence
cattctccagaactaatatt

SEQ ID NO: 24393 - DNA, 20 bp, Artificial
  CRISPR gRNA sequence
attctccagaactaatattg

SEQ ID NO: 24394 - DNA, 20 bp, Artificial
  CRISPR gRNA sequence
tccagaactaatattgggaa

SEQ ID NO: 24395 - DNA, 20 bp, Artificial
  CRISPR gRNA sequence
cagaactaatattgggaaaa

SEQ ID NO: 24396 - DNA, 20 bp, Artificial
  CRISPR gRNA sequence
atattgggaaaactgatgtt

SEQ ID NO: 24397 - DNA, 20 bp, Artificial
  CRISPR gRNA sequence
ggaaaactgatgttcagaga

SEQ ID NO: 24398 - DNA, 20 bp, Artificial
  CRISPR gRNA sequence
atgttcagagaggtcaagtg

SEQ ID NO: 24399 - DNA, 20 bp, Artificial
  CRISPR gRNA sequence
agagaggtcaagtgacttgg

SEQ ID NO: 24400 - DNA, 20 bp, Artificial
  CRISPR gRNA sequence
ggctaaggcatcacagccag

SEQ ID NO: 24401 - DNA, 20 bp, Artificial
  CRISPR gRNA sequence
gctaaggcatcacagccaga

SEQ ID NO: 24402 - DNA, 20 bp, Artificial
  CRISPR gRNA sequence
aggcatcacagccagaattc

SEQ ID NO: 24403 - DNA, 20 bp, Artificial
  CRISPR gRNA sequence
agatgcaagctcctaaacca

SEQ ID NO: 24404 - DNA, 20 bp, Artificial
  CRISPR gRNA sequence
ctaaaccacatgaccttgga

SEQ ID NO: 24405 - DNA, 20 bp, Artificial
  CRISPR gRNA sequence
aaccacatgaccttggacaa

SEQ ID NO: 24406 - DNA, 20 bp, Artificial
  CRISPR gRNA sequence
ggacaagccatttcactgag

SEQ ID NO: 24407 - DNA, 20 bp, Artificial
  CRISPR gRNA sequence
gacaagccatttcactgagg

SEQ ID NO: 24408 - DNA, 20 bp, Artificial
  CRISPR gRNA sequence
cactgaggcgtgtgaacctc

SEQ ID NO: 24409 - DNA, 20 bp, Artificial
  CRISPR gRNA sequence
actgaggcgtgtgaacctcc

SEQ ID NO: 24410 - DNA, 20 bp, Artificial
  CRISPR gRNA sequence
aggcgtgtgaacctcctcta

SEQ ID NO: 24411 - DNA, 20 bp, Artificial
  CRISPR gRNA sequence
ctctaagctcaaatgggcat

SEQ ID NO: 24412 - DNA, 20 bp, Artificial
  CRISPR gRNA sequence
taagctcaaatgggcataac

SEQ ID NO: 24413 - DNA, 20 bp, Artificial
  CRISPR gRNA sequence
agctcaaatgggcataacac

SEQ ID NO: 24414 - DNA, 20 bp, Artificial
  CRISPR gRNA sequence
aaatgggcataacactctac

SEQ ID NO: 24415 - DNA, 20 bp, Artificial
  CRISPR gRNA sequence
taccctgccttttccccaga

SEQ ID NO: 24416 - DNA, 20 bp, Artificial
  CRISPR gRNA sequence
ccctgccttttccccagagc

SEQ ID NO: 24417 - DNA, 20 bp, Artificial
  CRISPR gRNA sequence
ccttttccccagagcttttt

SEQ ID NO: 24418 - DNA, 20 bp, Artificial
  CRISPR gRNA sequence
ttccccagagctttttggga

SEQ ID NO: 24419 - DNA, 20 bp, Artificial
  CRISPR gRNA sequence
tccccagagctttttgggaa

SEQ ID NO: 24420 - DNA, 20 bp, Artificial
  CRISPR gRNA sequence
ccccagagctttttgggaac

SEQ ID NO: 24421 - DNA, 20 bp, Artificial
  CRISPR gRNA sequence
cccagagctttttgggaact

SEQ ID NO: 24422 - DNA, 20 bp, Artificial
  CRISPR gRNA sequence
tttgggaactcagatggtgt

SEQ ID NO: 24423 - DNA, 20 bp, Artificial
  CRISPR gRNA sequence
ttgggaactcagatggtgtg

SEQ ID NO: 24424 - DNA, 20 bp, Artificial
  CRISPR gRNA sequence
tgggaactcagatggtgtgg

SEQ ID NO: 24425 - DNA, 20 bp, Artificial
  CRISPR gRNA sequence
gggaactcagatggtgtgga

SEQ ID NO: 24426 - DNA, 20 bp, Artificial
  CRISPR gRNA sequence
ggaactcagatggtgtggag

SEQ ID NO: 24427 - DNA, 20 bp, Artificial
  CRISPR gRNA sequence
agatggtgtggaggatggag

SEQ ID NO: 24428 - DNA, 20 bp, Artificial
  CRISPR gRNA sequence
tgagctgcaaatccttgatc

SEQ ID NO: 24429 - DNA, 20 bp, Artificial
  CRISPR gRNA sequence
caaatccttgatcacccaag

SEQ ID NO: 24430 - DNA, 20 bp, Artificial
  CRISPR gRNA sequence
gatcacccaagaggaagtgc

SEQ ID NO: 24431 - DNA, 20 bp, Artificial
  CRISPR gRNA sequence
atcacccaagaggaagtgct

SEQ ID NO: 24432 - DNA, 20 bp, Artificial
  CRISPR gRNA sequence
aaggtgcaggcttcagtctt

SEQ ID NO: 24433 - DNA, 20 bp, Artificial
  CRISPR gRNA sequence
aggtgcaggcttcagtctta

SEQ ID NO: 24434 - DNA, 20 bp, Artificial
  CRISPR gRNA sequence
cagtcttagggaagcaggaa

SEQ ID NO: 24435 - DNA, 20 bp, Artificial
  CRISPR gRNA sequence
agtcttagggaagcaggaag

SEQ ID NO: 24436 - DNA, 20 bp, Artificial
  CRISPR gRNA sequence
agggaagcaggaagtggggc

SEQ ID NO: 24437 - DNA, 20 bp, Artificial
  CRISPR gRNA sequence
gggaagcaggaagtggggcg

SEQ ID NO: 24438 - DNA, 20 bp, Artificial
  CRISPR gRNA sequence
aaatgtgtattgggggcttc

SEQ ID NO: 24439 - DNA, 20 bp, Artificial
  CRISPR gRNA sequence
ggggcttctgggagggggtt

SEQ ID NO: 24440 - DNA, 20 bp, Artificial
  CRISPR gRNA sequence
ctgggagggggtttcttctt

SEQ ID NO: 24441 - DNA, 20 bp, Artificial
  CRISPR gRNA sequence
tgggagggggtttcttcttg

SEQ ID NO: 24442 - DNA, 20 bp, Artificial
  CRISPR gRNA sequence
ggagggggtttcttcttgtc

SEQ ID NO: 24443 - DNA, 20 bp, Artificial
  CRISPR gRNA sequence
cttcttgtccaggttgagcc

SEQ ID NO: 24444 - DNA, 20 bp, Artificial
  CRISPR gRNA sequence
ttcttgtccaggttgagcca

SEQ ID NO: 24445 - DNA, 20 bp, Artificial
  CRISPR gRNA sequence
cttgtccaggttgagccaat

SEQ ID NO: 24446 - DNA, 20 bp, Artificial
  CRISPR gRNA sequence
ttgtccaggttgagccaatg

SEQ ID NO: 24447 - DNA, 20 bp, Artificial
  CRISPR gRNA sequence
gtccaggttgagccaatgac

SEQ ID NO: 24448 - DNA, 20 bp, Artificial
  CRISPR gRNA sequence
tccaggttgagccaatgacg

SEQ ID NO: 24449 - DNA, 20 bp, Artificial
  CRISPR gRNA sequence
agccaatgacgcagatctta

SEQ ID NO: 24450 - DNA, 20 bp, Artificial
  CRISPR gRNA sequence
aggccctctggtgacttttt

SEQ ID NO: 24451 - DNA, 20 bp, Artificial
  CRISPR gRNA sequence
ggccctctggtgactttttg

SEQ ID NO: 24452 - DNA, 20 bp, Artificial
  CRISPR gRNA sequence
tggtgactttttgcccaggc

SEQ ID NO: 24453 - DNA, 20 bp, Artificial
  CRISPR gRNA sequence
gtgactttttgcccaggcaa

SEQ ID NO: 24454 - DNA, 20 bp, Artificial
  CRISPR gRNA sequence
tttgcccaggcaacttctca

SEQ ID NO: 24455 - DNA, 20 bp, Artificial
  CRISPR gRNA sequence
ttgcccaggcaacttctcag

SEQ ID NO: 24456 - DNA, 20 bp, Artificial
  CRISPR gRNA sequence
tgcccaggcaacttctcagt

SEQ ID NO: 24457 - DNA, 20 bp, Artificial
  CRISPR gRNA sequence
gcccaggcaacttctcagtg

SEQ ID NO: 24458 - DNA, 20 bp, Artificial
  CRISPR gRNA sequence
cccaggcaacttctcagtgg

SEQ ID NO: 24459 - DNA, 20 bp, Artificial
  CRISPR gRNA sequence
ctcagtggtggtgatgggga

SEQ ID NO: 24460 - DNA, 20 bp, Artificial
  CRISPR gRNA sequence
tcagtggtggtgatggggag

SEQ ID NO: 24461 - DNA, 20 bp, Artificial
  CRISPR gRNA sequence
agtggtggtgatggggagcg

SEQ ID NO: 24462 - DNA, 20 bp, Artificial
  CRISPR gRNA sequence
ccctgctggctgtgggggcc

SEQ ID NO: 24463 - DNA, 20 bp, Artificial
  CRISPR gRNA sequence
ctggctgtgggggccttttt

SEQ ID NO: 24464 - DNA, 20 bp, Artificial
  CRISPR gRNA sequence
gctgtgggggcctttttttt

SEQ ID NO: 24465 - DNA, 20 bp, Artificial
  CRISPR gRNA sequence
tgggggcctttttttttttt

SEQ ID NO: 24466 - DNA, 20 bp, Artificial
  CRISPR gRNA sequence
ttttttttttctgagacaca

SEQ ID NO: 24467 - DNA, 20 bp, Artificial
  CRISPR gRNA sequence
tttttttttctgagacacag

SEQ ID NO: 24468 - DNA, 20 bp, Artificial
  CRISPR gRNA sequence
ttttttttctgagacacagt

SEQ ID NO: 24469 - DNA, 20 bp, Artificial
  CRISPR gRNA sequence
tttttttctgagacacagtc

SEQ ID NO: 24470 - DNA, 20 bp, Artificial
  CRISPR gRNA sequence
ttttttctgagacacagtct

SEQ ID NO: 24471 - DNA, 20 bp, Artificial
  CRISPR gRNA sequence
tttttctgagacacagtctg

SEQ ID NO: 24472 - DNA, 20 bp, Artificial
  CRISPR gRNA sequence
ttttctgagacacagtctgg

SEQ ID NO: 24473 - DNA, 20 bp, Artificial
  CRISPR gRNA sequence
tttctgagacacagtctggc

SEQ ID NO: 24474 - DNA, 20 bp, Artificial
  CRISPR gRNA sequence
ttctgagacacagtctggct

SEQ ID NO: 24475 - DNA, 20 bp, Artificial
  CRISPR gRNA sequence
tctgagacacagtctggctc

SEQ ID NO: 24476 - DNA, 20 bp, Artificial
  CRISPR gRNA sequence
ctgagacacagtctggctct

SEQ ID NO: 24477 - DNA, 20 bp, Artificial
  CRISPR gRNA sequence
tgagacacagtctggctcta

SEQ ID NO: 24478 - DNA, 20 bp, Artificial
  CRISPR gRNA sequence
agacacagtctggctctatc

SEQ ID NO: 24479 - DNA, 20 bp, Artificial
  CRISPR gRNA sequence
gctctatcacccaggctgga

SEQ ID NO: 24480 - DNA, 20 bp, Artificial
  CRISPR gRNA sequence
tatcacccaggctggagtgc

SEQ ID NO: 24481 - DNA, 20 bp, Artificial
  CRISPR gRNA sequence
tcacccaggctggagtgcag

SEQ ID NO: 24482 - DNA, 20 bp, Artificial
  CRISPR gRNA sequence
gagtgcagtggtgcaatctc

SEQ ID NO: 24483 - DNA, 20 bp, Artificial
  CRISPR gRNA sequence
agttcactgcagccttgaca

SEQ ID NO: 24484 - DNA, 20 bp, Artificial
  CRISPR gRNA sequence
actgcagccttgacacctcc

SEQ ID NO: 24485 - DNA, 20 bp, Artificial
  CRISPR gRNA sequence
cagccttgacacctccccag

SEQ ID NO: 24486 - DNA, 20 bp, Artificial
  CRISPR gRNA sequence
gacacctccccaggctcaag

SEQ ID NO: 24487 - DNA, 20 bp, Artificial
  CRISPR gRNA sequence
acacctccccaggctcaagc

SEQ ID NO: 24488 - DNA, 20 bp, Artificial
  CRISPR gRNA sequence
cccaggctcaagctatcctc

SEQ ID NO: 24489 - DNA, 20 bp, Artificial
  CRISPR gRNA sequence
aagctatcctcccacctcag

SEQ ID NO: 24490 - DNA, 20 bp, Artificial
  CRISPR gRNA sequence
tcctcccacctcagcctcct

SEQ ID NO: 24491 - DNA, 20 bp, Artificial
  CRISPR gRNA sequence
ccacctcagcctcctgagta

SEQ ID NO: 24492 - DNA, 20 bp, Artificial
  CRISPR gRNA sequence
agcctcctgagtagctggtt

SEQ ID NO: 24493 - DNA, 20 bp, Artificial
  CRISPR gRNA sequence
ctgagtagctggttctacag

SEQ ID NO: 24494 - DNA, 20 bp, Artificial
  CRISPR gRNA sequence
agtagctggttctacagatg

SEQ ID NO: 24495 - DNA, 20 bp, Artificial
  CRISPR gRNA sequence
gttctacagatgcacatcac

SEQ ID NO: 24496 - DNA, 20 bp, Artificial
  CRISPR gRNA sequence
tacagatgcacatcaccacg

SEQ ID NO: 24497 - DNA, 20 bp, Artificial
  CRISPR gRNA sequence
cagatgcacatcaccacgcc

SEQ ID NO: 24498 - DNA, 20 bp, Artificial
  CRISPR gRNA sequence
agttttgtgttatttgtaga

SEQ ID NO: 24499 - DNA, 20 bp, Artificial
  CRISPR gRNA sequence
tgtgttatttgtagagatag

SEQ ID NO: 24500 - DNA, 20 bp, Artificial
  CRISPR gRNA sequence
gtgttatttgtagagatagg

SEQ ID NO: 24501 - DNA, 20 bp, Artificial
  CRISPR gRNA sequence
tgttatttgtagagataggg

SEQ ID NO: 24502 - DNA, 20 bp, Artificial
  CRISPR gRNA sequence
tttgtagagatagggcttca

SEQ ID NO: 24503 - DNA, 20 bp, Artificial
  CRISPR gRNA sequence
gtagagatagggcttcacca

SEQ ID NO: 24504 - DNA, 20 bp, Artificial
  CRISPR gRNA sequence
tagagatagggcttcaccat

SEQ ID NO: 24505 - DNA, 20 bp, Artificial
  CRISPR gRNA sequence
caccatgttgcccaggctgg

SEQ ID NO: 24506 - DNA, 20 bp, Artificial
  CRISPR gRNA sequence
accatgttgcccaggctggt

SEQ ID NO: 24507 - DNA, 20 bp, Artificial
  CRISPR gRNA sequence
cccaggctggtctcaaactc

SEQ ID NO: 24508 - DNA, 20 bp, Artificial
  CRISPR gRNA sequence
gtctcaaactcctggactga

SEQ ID NO: 24509 - DNA, 20 bp, Artificial
  CRISPR gRNA sequence
aaactcctggactgaggtga

SEQ ID NO: 24510 - DNA, 20 bp, Artificial
  CRISPR gRNA sequence
ctggactgaggtgatactcc

SEQ ID NO: 24511 - DNA, 20 bp, Artificial
  CRISPR gRNA sequence
gactgaggtgatactcctgc

SEQ ID NO: 24512 - DNA, 20 bp, Artificial
  CRISPR gRNA sequence
aggtgatactcctgccttgg

SEQ ID NO: 24513 - DNA, 20 bp, Artificial
  CRISPR gRNA sequence
ctgccttggactcccaaagt

SEQ ID NO: 24514 - DNA, 20 bp, Artificial
  CRISPR gRNA sequence
ccttggactcccaaagtgct

SEQ ID NO: 24515 - DNA, 20 bp, Artificial
  CRISPR gRNA sequence
ggactcccaaagtgctggaa

SEQ ID NO: 24516 - DNA, 20 bp, Artificial
  CRISPR gRNA sequence
gactcccaaagtgctggaat

SEQ ID NO: 24517 - DNA, 20 bp, Artificial
  CRISPR gRNA sequence
ccaaagtgctggaatttcta

SEQ ID NO: 24518 - DNA, 20 bp, Artificial
  CRISPR gRNA sequence
gaatttctacagatgtgagc

SEQ ID NO: 24519 - DNA, 20 bp, Artificial
  CRISPR gRNA sequence
ctacagatgtgagccaccat

SEQ ID NO: 24520 - DNA, 20 bp, Artificial
  CRISPR gRNA sequence
tacagatgtgagccaccatg

SEQ ID NO: 24521 - DNA, 20 bp, Artificial
  CRISPR gRNA sequence
cagatgtgagccaccatgcc

SEQ ID NO: 24522 - DNA, 20 bp, Artificial
  CRISPR gRNA sequence
tggggcccttcttgttccta

SEQ ID NO: 24523 - DNA, 20 bp, Artificial
  CRISPR gRNA sequence
cttgttcctatgaagtctgc

SEQ ID NO: 24524 - DNA, 20 bp, Artificial
  CRISPR gRNA sequence
ttgttcctatgaagtctgca

SEQ ID NO: 24525 - DNA, 20 bp, Artificial
  CRISPR gRNA sequence
gttcctatgaagtctgcagg

SEQ ID NO: 24526 - DNA, 20 bp, Artificial
  CRISPR gRNA sequence
ttcctatgaagtctgcaggg

SEQ ID NO: 24527 - DNA, 20 bp, Artificial
  CRISPR gRNA sequence
ctatgaagtctgcagggtcc

SEQ ID NO: 24528 - DNA, 20 bp, Artificial
  CRISPR gRNA sequence
tgaagtctgcagggtcccct

SEQ ID NO: 24529 - DNA, 20 bp, Artificial
  CRISPR gRNA sequence
cagggtccccttatgcaaaa

SEQ ID NO: 24530 - DNA, 20 bp, Artificial
  CRISPR gRNA sequence
atgcaaaagaacagaaagct

SEQ ID NO: 24531 - DNA, 20 bp, Artificial
  CRISPR gRNA sequence
tgcaaaagaacagaaagctc

SEQ ID NO: 24532 - DNA, 20 bp, Artificial
  CRISPR gRNA sequence
ggcttcacaaagtttgacct

SEQ ID NO: 24533 - DNA, 20 bp, Artificial
  CRISPR gRNA sequence
cacaaagtttgacctcggaa

SEQ ID NO: 24534 - DNA, 20 bp, Artificial
  CRISPR gRNA sequence
acaaagtttgacctcggaag

SEQ ID NO: 24535 - DNA, 20 bp, Artificial
  CRISPR gRNA sequence
gacctcggaagaaatggaag

SEQ ID NO: 24536 - DNA, 20 bp, Artificial
  CRISPR gRNA sequence
acctcggaagaaatggaagg

SEQ ID NO: 24537 - DNA, 20 bp, Artificial
  CRISPR gRNA sequence
ggaagaaatggaagggaaag

SEQ ID NO: 24538 - DNA, 20 bp, Artificial
  CRISPR gRNA sequence
tgtcactctcacaaacgtaa

SEQ ID NO: 24539 - DNA, 20 bp, Artificial
  CRISPR gRNA sequence
gtcactctcacaaacgtaag

SEQ ID NO: 24540 - DNA, 20 bp, Artificial
  CRISPR gRNA sequence
tcactctcacaaacgtaaga

SEQ ID NO: 24541 - DNA, 20 bp, Artificial
  CRISPR gRNA sequence
tcacaaacgtaagaagcaaa

SEQ ID NO: 24542 - DNA, 20 bp, Artificial
  CRISPR gRNA sequence
acaaacgtaagaagcaaact

SEQ ID NO: 24543 - DNA, 20 bp, Artificial
  CRISPR gRNA sequence
ataatgatggccatcacaca

SEQ ID NO: 24544 - DNA, 20 bp, Artificial
  CRISPR gRNA sequence
tactcaccatgtagaagctg

SEQ ID NO: 24545 - DNA, 20 bp, Artificial
  CRISPR gRNA sequence
accatgtagaagctgtgctg

SEQ ID NO: 24546 - DNA, 20 bp, Artificial
  CRISPR gRNA sequence
tgctgccttaaacttctgtt

SEQ ID NO: 24547 - DNA, 20 bp, Artificial
  CRISPR gRNA sequence
ccttaaacttctgttcattc

SEQ ID NO: 24548 - DNA, 20 bp, Artificial
  CRISPR gRNA sequence
aaacttctgttcattcagca

SEQ ID NO: 24549 - DNA, 20 bp, Artificial
  CRISPR gRNA sequence
aacttctgttcattcagcac

SEQ ID NO: 24550 - DNA, 20 bp, Artificial
  CRISPR gRNA sequence
ctgttcattcagcacttact

SEQ ID NO: 24551 - DNA, 20 bp, Artificial
  CRISPR gRNA sequence
tgttcattcagcacttactg

SEQ ID NO: 24552 - DNA, 20 bp, Artificial
  CRISPR gRNA sequence
ttcattcagcacttactgat

SEQ ID NO: 24553 - DNA, 20 bp, Artificial
  CRISPR gRNA sequence
attcagcacttactgattgc

SEQ ID NO: 24554 - DNA, 20 bp, Artificial
  CRISPR gRNA sequence
agcacttactgattgccagt

SEQ ID NO: 24555 - DNA, 20 bp, Artificial
  CRISPR gRNA sequence
actgattgccagtcccattg

SEQ ID NO: 24556 - DNA, 20 bp, Artificial
  CRISPR gRNA sequence
ctgattgccagtcccattgc

SEQ ID NO: 24557 - DNA, 20 bp, Artificial
  CRISPR gRNA sequence
attgccagtcccattgctaa

SEQ ID NO: 24558 - DNA, 20 bp, Artificial
  CRISPR gRNA sequence
ccagtcccattgctaagggc

SEQ ID NO: 24559 - DNA, 20 bp, Artificial
  CRISPR gRNA sequence
ctaagggctccgcgtgactt

SEQ ID NO: 24560 - DNA, 20 bp, Artificial
  CRISPR gRNA sequence
agggctccgcgtgacttaac

SEQ ID NO: 24561 - DNA, 20 bp, Artificial
  CRISPR gRNA sequence
cgcgtgacttaactccccta

SEQ ID NO: 24562 - DNA, 20 bp, Artificial
  CRISPR gRNA sequence
aactcccctaatccttgtga

SEQ ID NO: 24563 - DNA, 20 bp, Artificial
  CRISPR gRNA sequence
actcccctaatccttgtgag

SEQ ID NO: 24564 - DNA, 20 bp, Artificial
  CRISPR gRNA sequence
ccctaatccttgtgagttgc

SEQ ID NO: 24565 - DNA, 20 bp, Artificial
  CRISPR gRNA sequence
atccttgtgagttgccaatt

SEQ ID NO: 24566 - DNA, 20 bp, Artificial
  CRISPR gRNA sequence
gtgagttgccaattattatt

SEQ ID NO: 24567 - DNA, 20 bp, Artificial
  CRISPR gRNA sequence
tgagttgccaattattattc

SEQ ID NO: 24568 - DNA, 20 bp, Artificial
  CRISPR gRNA sequence
ccaattattattcgcatttt

SEQ ID NO: 24569 - DNA, 20 bp, Artificial
  CRISPR gRNA sequence
ttattcgcattttatagata

SEQ ID NO: 24570 - DNA, 20 bp, Artificial
  CRISPR gRNA sequence
ttcgcattttatagatatgg

SEQ ID NO: 24571 - DNA, 20 bp, Artificial
  CRISPR gRNA sequence
gcattttatagatatggaaa

SEQ ID NO: 24572 - DNA, 20 bp, Artificial
  CRISPR gRNA sequence
tatagatatggaaactgagg

SEQ ID NO: 24573 - DNA, 20 bp, Artificial
  CRISPR gRNA sequence
atagatatggaaactgaggc

SEQ ID NO: 24574 - DNA, 20 bp, Artificial
  CRISPR gRNA sequence
tagatatggaaactgaggct

SEQ ID NO: 24575 - DNA, 20 bp, Artificial
  CRISPR gRNA sequence
aggctccaagtggtttaaaa

SEQ ID NO: 24576 - DNA, 20 bp, Artificial
  CRISPR gRNA sequence
caagtggtttaaaaaatgaa

SEQ ID NO: 24577 - DNA, 20 bp, Artificial
  CRISPR gRNA sequence
aaaaaatgaacttgcccagg

SEQ ID NO: 24578 - DNA, 20 bp, Artificial
  CRISPR gRNA sequence
aaaaatgaacttgcccaggt

SEQ ID NO: 24579 - DNA, 20 bp, Artificial
  CRISPR gRNA sequence
gcccaggttacagtgtgttg

SEQ ID NO: 24580 - DNA, 20 bp, Artificial
  CRISPR gRNA sequence
cccaggttacagtgtgttgg

SEQ ID NO: 24581 - DNA, 20 bp, Artificial
  CRISPR gRNA sequence
cagtgtgttggtaggtaggg

SEQ ID NO: 24582 - DNA, 20 bp, Artificial
  CRISPR gRNA sequence
gtaggtaggggtagtctcaa

SEQ ID NO: 24583 - DNA, 20 bp, Artificial
  CRISPR gRNA sequence
aaagttggtaaattttacgc

SEQ ID NO: 24584 - DNA, 20 bp, Artificial
  CRISPR gRNA sequence
gtaaattttacgccaaagct

SEQ ID NO: 24585 - DNA, 20 bp, Artificial
  CRISPR gRNA sequence
tacgccaaagctcacgatac

SEQ ID NO: 24586 - DNA, 20 bp, Artificial
  CRISPR gRNA sequence
acgccaaagctcacgatact

SEQ ID NO: 24587 - DNA, 20 bp, Artificial
  CRISPR gRNA sequence
cgccaaagctcacgatactt

SEQ ID NO: 24588 - DNA, 20 bp, Artificial
  CRISPR gRNA sequence
acgatacttgccttctttcc

SEQ ID NO: 24589 - DNA, 20 bp, Artificial
  CRISPR gRNA sequence
gccttctttcccttctcaat

SEQ ID NO: 24590 - DNA, 20 bp, Artificial
  CRISPR gRNA sequence
ccttctttcccttctcaatt

SEQ ID NO: 24591 - DNA, 20 bp, Artificial
  CRISPR gRNA sequence
ctttcccttctcaatttatt

SEQ ID NO: 24592 - DNA, 20 bp, Artificial
  CRISPR gRNA sequence
tttcccttctcaatttattt

SEQ ID NO: 24593 - DNA, 20 bp, Artificial
  CRISPR gRNA sequence
tcccttctcaatttatttct

SEQ ID NO: 24594 - DNA, 20 bp, Artificial
  CRISPR gRNA sequence
cccttctcaatttatttctc

SEQ ID NO: 24595 - DNA, 20 bp, Artificial
  CRISPR gRNA sequence
ccttctcaatttatttctct

SEQ ID NO: 24596 - DNA, 20 bp, Artificial
  CRISPR gRNA sequence
ctcaatttatttctctgact

SEQ ID NO: 24597 - DNA, 20 bp, Artificial
  CRISPR gRNA sequence
tcaatttatttctctgactg

SEQ ID NO: 24598 - DNA, 20 bp, Artificial
  CRISPR gRNA sequence
aatttatttctctgactgtg

SEQ ID NO: 24599 - DNA, 20 bp, Artificial
  CRISPR gRNA sequence
atttctctgactgtgtgctt

SEQ ID NO: 24600 - DNA, 20 bp, Artificial
  CRISPR gRNA sequence
tttctctgactgtgtgctta

SEQ ID NO: 24601 - DNA, 20 bp, Artificial
  CRISPR gRNA sequence
ctctgactgtgtgcttaacc

SEQ ID NO: 24602 - DNA, 20 bp, Artificial
  CRISPR gRNA sequence
tctgactgtgtgcttaacca

SEQ ID NO: 24603 - DNA, 20 bp, Artificial
  CRISPR gRNA sequence
tgactgtgtgcttaaccaca

SEQ ID NO: 24604 - DNA, 20 bp, Artificial
  CRISPR gRNA sequence
actgtgtgcttaaccacaca

SEQ ID NO: 24605 - DNA, 20 bp, Artificial
  CRISPR gRNA sequence
tgtgcttaaccacacagcag

SEQ ID NO: 24606 - DNA, 20 bp, Artificial
  CRISPR gRNA sequence
aaccacacagcagtgtcatc

SEQ ID NO: 24607 - DNA, 20 bp, Artificial
  CRISPR gRNA sequence
accacacagcagtgtcatcc

SEQ ID NO: 24608 - DNA, 20 bp, Artificial
  CRISPR gRNA sequence
gaagcagagctcatcaataa

SEQ ID NO: 24609 - DNA, 20 bp, Artificial
  CRISPR gRNA sequence
aagcagagctcatcaataag

SEQ ID NO: 24610 - DNA, 20 bp, Artificial
  CRISPR gRNA sequence
atcaataagtgggggtgggc

SEQ ID NO: 24611 - DNA, 20 bp, Artificial
  CRISPR gRNA sequence
aatgtctccaggctcctccc

SEQ ID NO: 24612 - DNA, 20 bp, Artificial
  CRISPR gRNA sequence
caggctcctccctgcggtcc

SEQ ID NO: 24613 - DNA, 20 bp, Artificial
  CRISPR gRNA sequence
ctccctgcggtccctcccac

SEQ ID NO: 24614 - DNA, 20 bp, Artificial
  CRISPR gRNA sequence
cctgcggtccctcccaccat

SEQ ID NO: 24615 - DNA, 20 bp, Artificial
  CRISPR gRNA sequence
cggtccctcccaccatcccc

SEQ ID NO: 24616 - DNA, 20 bp, Artificial
  CRISPR gRNA sequence
ccaccatcccccatctgtga

SEQ ID NO: 24617 - DNA, 20 bp, Artificial
  CRISPR gRNA sequence
tgataccacctgtgtctcta

SEQ ID NO: 24618 - DNA, 20 bp, Artificial
  CRISPR gRNA sequence
tgtctctatgcttgagccca

SEQ ID NO: 24619 - DNA, 20 bp, Artificial
  CRISPR gRNA sequence
tatgcttgagcccagacagg

SEQ ID NO: 24620 - DNA, 20 bp, Artificial
  CRISPR gRNA sequence
tgcttgagcccagacaggac

SEQ ID NO: 24621 - DNA, 20 bp, Artificial
  CRISPR gRNA sequence
gagcccagacaggacaaggg

SEQ ID NO: 24622 - DNA, 20 bp, Artificial
  CRISPR gRNA sequence
agcccagacaggacaagggt

SEQ ID NO: 24623 - DNA, 20 bp, Artificial
  CRISPR gRNA sequence
cattgggaacattttgactg

SEQ ID NO: 24624 - DNA, 20 bp, Artificial
  CRISPR gRNA sequence
attgggaacattttgactgg

SEQ ID NO: 24625 - DNA, 20 bp, Artificial
  CRISPR gRNA sequence
ggaacattttgactgggggg

SEQ ID NO: 24626 - DNA, 20 bp, Artificial
  CRISPR gRNA sequence
tgactggggggaaagagcac

SEQ ID NO: 24627 - DNA, 20 bp, Artificial
  CRISPR gRNA sequence
gactggggggaaagagcacc

SEQ ID NO: 24628 - DNA, 20 bp, Artificial
  CRISPR gRNA sequence
actggggggaaagagcacca

SEQ ID NO: 24629 - DNA, 20 bp, Artificial
  CRISPR gRNA sequence
gggggaaagagcaccagcct

SEQ ID NO: 24630 - DNA, 20 bp, Artificial
  CRISPR gRNA sequence
ggagtcttggcagggggagt

SEQ ID NO: 24631 - DNA, 20 bp, Artificial
  CRISPR gRNA sequence
ggcagggggagtgggggaga

SEQ ID NO: 24632 - DNA, 20 bp, Artificial
  CRISPR gRNA sequence
gcagggggagtgggggagaa

SEQ ID NO: 24633 - DNA, 20 bp, Artificial
  CRISPR gRNA sequence
tgaggtcttgtgcaagtcac

SEQ ID NO: 24634 - DNA, 20 bp, Artificial
  CRISPR gRNA sequence
gtgcaagtcacgtccttccc

SEQ ID NO: 24635 - DNA, 20 bp, Artificial
  CRISPR gRNA sequence
tgcaagtcacgtccttcccg

SEQ ID NO: 24636 - DNA, 20 bp, Artificial
  CRISPR gRNA sequence
cccggggtctcagtcttgtc

SEQ ID NO: 24637 - DNA, 20 bp, Artificial
  CRISPR gRNA sequence
ccggggtctcagtcttgtca

SEQ ID NO: 24638 - DNA, 20 bp, Artificial
  CRISPR gRNA sequence
agtcttgtcatctgcagagt

SEQ ID NO: 24639 - DNA, 20 bp, Artificial
  CRISPR gRNA sequence
gtcatctgcagagtgaagga

SEQ ID NO: 24640 - DNA, 20 bp, Artificial
  CRISPR gRNA sequence
tcatctgcagagtgaaggaa

SEQ ID NO: 24641 - DNA, 20 bp, Artificial
  CRISPR gRNA sequence
cagagtgaaggaaagaggtc

SEQ ID NO: 24642 - DNA, 20 bp, Artificial
  CRISPR gRNA sequence
gaaggtccctggcagaccca

SEQ ID NO: 24643 - DNA, 20 bp, Artificial
  CRISPR gRNA sequence
aaggtccctggcagacccaa

SEQ ID NO: 24644 - DNA, 20 bp, Artificial
  CRISPR gRNA sequence
gcagacccaatgccctgtga

SEQ ID NO: 24645 - DNA, 20 bp, Artificial
  CRISPR gRNA sequence
tgagaaaactgagtttgggt

SEQ ID NO: 24646 - DNA, 20 bp, Artificial
  CRISPR gRNA sequence
agtttgggtaacttattatt

SEQ ID NO: 24647 - DNA, 20 bp, Artificial
  CRISPR gRNA sequence
gggtaacttattattttata

SEQ ID NO: 24648 - DNA, 20 bp, Artificial
  CRISPR gRNA sequence
ggtaacttattattttatag

SEQ ID NO: 24649 - DNA, 20 bp, Artificial
  CRISPR gRNA sequence
attattttatagatatggaa

SEQ ID NO: 24650 - DNA, 20 bp, Artificial
  CRISPR gRNA sequence
ttattttatagatatggaat

SEQ ID NO: 24651 - DNA, 20 bp, Artificial
  CRISPR gRNA sequence
ttttatagatatggaattat

SEQ ID NO: 24652 - DNA, 20 bp, Artificial
  CRISPR gRNA sequence
tatagatatggaattatctt

SEQ ID NO: 24653 - DNA, 20 bp, Artificial
  CRISPR gRNA sequence
atagatatggaattatctta

SEQ ID NO: 24654 - DNA, 20 bp, Artificial
  CRISPR gRNA sequence
tagatatggaattatcttat

SEQ ID NO: 24655 - DNA, 20 bp, Artificial
  CRISPR gRNA sequence
tcttatagaaatgttataga

SEQ ID NO: 24656 - DNA, 20 bp, Artificial
  CRISPR gRNA sequence
atagaaatgttatagatatg

SEQ ID NO: 24657 - DNA, 20 bp, Artificial
  CRISPR gRNA sequence
tagaaatgttatagatatgg

SEQ ID NO: 24658 - DNA, 20 bp, Artificial
  CRISPR gRNA sequence
tagatatggaatcattttat

SEQ ID NO: 24659 - DNA, 20 bp, Artificial
  CRISPR gRNA sequence
tatagatatggcccaaagtc

SEQ ID NO: 24660 - DNA, 20 bp, Artificial
  CRISPR gRNA sequence
atagatatggcccaaagtcc

SEQ ID NO: 24661 - DNA, 20 bp, Artificial
  CRISPR gRNA sequence
tagatatggcccaaagtcca

SEQ ID NO: 24662 - DNA, 20 bp, Artificial
  CRISPR gRNA sequence
attcacggagttgctaggat

SEQ ID NO: 24663 - DNA, 20 bp, Artificial
  CRISPR gRNA sequence
acggagttgctaggatcagt

SEQ ID NO: 24664 - DNA, 20 bp, Artificial
  CRISPR gRNA sequence
ctaggatcagtctggagctc

SEQ ID NO: 24665 - DNA, 20 bp, Artificial
  CRISPR gRNA sequence
ggatcagtctggagctcttg

SEQ ID NO: 24666 - DNA, 20 bp, Artificial
  CRISPR gRNA sequence
gagctcttgtcacgagatca

SEQ ID NO: 24667 - DNA, 20 bp, Artificial
  CRISPR gRNA sequence
ttgtcacgagatcacactgc

SEQ ID NO: 24668 - DNA, 20 bp, Artificial
  CRISPR gRNA sequence
gtcacgagatcacactgcct

SEQ ID NO: 24669 - DNA, 20 bp, Artificial
  CRISPR gRNA sequence
tcacgagatcacactgcctc

SEQ ID NO: 24670 - DNA, 20 bp, Artificial
  CRISPR gRNA sequence
cctcaaagaggaggcagatt

SEQ ID NO: 24671 - DNA, 20 bp, Artificial
  CRISPR gRNA sequence
aaagaggaggcagattgctg

SEQ ID NO: 24672 - DNA, 20 bp, Artificial
  CRISPR gRNA sequence
ctgcaatgtaggttcttaat

SEQ ID NO: 24673 - DNA, 20 bp, Artificial
  CRISPR gRNA sequence
caatgtaggttcttaataaa

SEQ ID NO: 24674 - DNA, 20 bp, Artificial
  CRISPR gRNA sequence
ttaataaagagcatgggtgg

SEQ ID NO: 24675 - DNA, 20 bp, Artificial
  CRISPR gRNA sequence
aataaagagcatgggtggaa

SEQ ID NO: 24676 - DNA, 20 bp, Artificial
  CRISPR gRNA sequence
ataaagagcatgggtggaat

SEQ ID NO: 24677 - DNA, 20 bp, Artificial
  CRISPR gRNA sequence
gggcaaaggtgtcttttctc

SEQ ID NO: 24678 - DNA, 20 bp, Artificial
  CRISPR gRNA sequence
ttctcactgctctgagagaa

SEQ ID NO: 24679 - DNA, 20 bp, Artificial
  CRISPR gRNA sequence
tctcactgctctgagagaac

SEQ ID NO: 24680 - DNA, 20 bp, Artificial
  CRISPR gRNA sequence
ctcactgctctgagagaaca

SEQ ID NO: 24681 - DNA, 20 bp, Artificial
  CRISPR gRNA sequence
tcactgctctgagagaacag

SEQ ID NO: 24682 - DNA, 20 bp, Artificial
  CRISPR gRNA sequence
actgctctgagagaacagat

SEQ ID NO: 24683 - DNA, 20 bp, Artificial
  CRISPR gRNA sequence
ctctgagagaacagattttg

SEQ ID NO: 24684 - DNA, 20 bp, Artificial
  CRISPR gRNA sequence
tgagagaacagattttgtgc

SEQ ID NO: 24685 - DNA, 20 bp, Artificial
  CRISPR gRNA sequence
agagaacagattttgtgcct

SEQ ID NO: 24686 - DNA, 20 bp, Artificial
  CRISPR gRNA sequence
tgtgcctgtgtccctgacca

SEQ ID NO: 24687 - DNA, 20 bp, Artificial
  CRISPR gRNA sequence
gtgcctgtgtccctgaccaa

SEQ ID NO: 24688 - DNA, 20 bp, Artificial
  CRISPR gRNA sequence
tgcctgtgtccctgaccaag

SEQ ID NO: 24689 - DNA, 20 bp, Artificial
  CRISPR gRNA sequence
tgtccctgaccaaggggctg

SEQ ID NO: 24690 - DNA, 20 bp, Artificial
  CRISPR gRNA sequence
accaaggggctgggagaggt

SEQ ID NO: 24691 - DNA, 20 bp, Artificial
  CRISPR gRNA sequence
ggagaggtggagcatctcac

SEQ ID NO: 24692 - DNA, 20 bp, Artificial
  CRISPR gRNA sequence
acccccaaccatctcccagc

SEQ ID NO: 24693 - DNA, 20 bp, Artificial
  CRISPR gRNA sequence
ccagctttggccctgctcca

SEQ ID NO: 24694 - DNA, 20 bp, Artificial
  CRISPR gRNA sequence
tggccctgctccaggaaaag

SEQ ID NO: 24695 - DNA, 20 bp, Artificial
  CRISPR gRNA sequence
ggccctgctccaggaaaagg

SEQ ID NO: 24696 - DNA, 20 bp, Artificial
  CRISPR gRNA sequence
gccctgctccaggaaaaggg

SEQ ID NO: 24697 - DNA, 20 bp, Artificial
  CRISPR gRNA sequence
ctccaggaaaagggcggtgg

SEQ ID NO: 24698 - DNA, 20 bp, Artificial
  CRISPR gRNA sequence
caggaaaagggcggtggccc

SEQ ID NO: 24699 - DNA, 20 bp, Artificial
  CRISPR gRNA sequence
tcagttctgcttcctctagt

SEQ ID NO: 24700 - DNA, 20 bp, Artificial
  CRISPR gRNA sequence
cagttctgcttcctctagtc

SEQ ID NO: 24701 - DNA, 20 bp, Artificial
  CRISPR gRNA sequence
agttctgcttcctctagtca

SEQ ID NO: 24702 - DNA, 20 bp, Artificial
  CRISPR gRNA sequence
tgcttcctctagtcatggtt

SEQ ID NO: 24703 - DNA, 20 bp, Artificial
  CRISPR gRNA sequence
cttcctctagtcatggttgg

SEQ ID NO: 24704 - DNA, 20 bp, Artificial
  CRISPR gRNA sequence
cctctagtcatggttggctg

SEQ ID NO: 24705 - DNA, 20 bp, Artificial
  CRISPR gRNA sequence
ctctagtcatggttggctgg

SEQ ID NO: 24706 - DNA, 20 bp, Artificial
  CRISPR gRNA sequence
tagtcatggttggctgggat

SEQ ID NO: 24707 - DNA, 20 bp, Artificial
  CRISPR gRNA sequence
gtcatggttggctgggatct

SEQ ID NO: 24708 - DNA, 20 bp, Artificial
  CRISPR gRNA sequence
gctgggatctcgctgcaagc

SEQ ID NO: 24709 - DNA, 20 bp, Artificial
  CRISPR gRNA sequence
ggatctcgctgcaagccggt

SEQ ID NO: 24710 - DNA, 20 bp, Artificial
  CRISPR gRNA sequence
gctgcaagccggttatgttt

SEQ ID NO: 24711 - DNA, 20 bp, Artificial
  CRISPR gRNA sequence
caagccggttatgtttgggt

SEQ ID NO: 24712 - DNA, 20 bp, Artificial
  CRISPR gRNA sequence
tgtttgggttcctgcagccc

SEQ ID NO: 24713 - DNA, 20 bp, Artificial
  CRISPR gRNA sequence
gggttcctgcagcccccgct

SEQ ID NO: 24714 - DNA, 20 bp, Artificial
  CRISPR gRNA sequence
ggttcctgcagcccccgctc

SEQ ID NO: 24715 - DNA, 20 bp, Artificial
  CRISPR gRNA sequence
ctgcagcccccgctcaaccg

SEQ ID NO: 24716 - DNA, 20 bp, Artificial
  CRISPR gRNA sequence
cagcccccgctcaaccgtca

SEQ ID NO: 24717 - DNA, 20 bp, Artificial
  CRISPR gRNA sequence
aaccgtcatgaacaagtggg

SEQ ID NO: 24718 - DNA, 20 bp, Artificial
  CRISPR gRNA sequence
ggactggaaagatcattctc

SEQ ID NO: 24719 - DNA, 20 bp, Artificial
  CRISPR gRNA sequence
gactggaaagatcattctct

SEQ ID NO: 24720 - DNA, 20 bp, Artificial
  CRISPR gRNA sequence
gaaagatcattctctgtgac

SEQ ID NO: 24721 - DNA, 20 bp, Artificial
  CRISPR gRNA sequence
tctgtgacatccgggggtct

SEQ ID NO: 24722 - DNA, 20 bp, Artificial
  CRISPR gRNA sequence
tgtgacatccgggggtctgt

SEQ ID NO: 24723 - DNA, 20 bp, Artificial
  CRISPR gRNA sequence
tgacatccgggggtctgtgc

SEQ ID NO: 24724 - DNA, 20 bp, Artificial
  CRISPR gRNA sequence
tgctgagcctctccccaggc

SEQ ID NO: 24725 - DNA, 20 bp, Artificial
  CRISPR gRNA sequence
agcctctccccaggcagtga

SEQ ID NO: 24726 - DNA, 20 bp, Artificial
  CRISPR gRNA sequence
tccccaggcagtgaaagctg

SEQ ID NO: 24727 - DNA, 20 bp, Artificial
  CRISPR gRNA sequence
cccaggcagtgaaagctgtg

SEQ ID NO: 24728 - DNA, 20 bp, Artificial
  CRISPR gRNA sequence
tggatgcgtgaaagaaaatg

SEQ ID NO: 24729 - DNA, 20 bp, Artificial
  CRISPR gRNA sequence
tgggccgggtgtggtggctc

SEQ ID NO: 24730 - DNA, 20 bp, Artificial
  CRISPR gRNA sequence
ggccgggtgtggtggctcac

SEQ ID NO: 24731 - DNA, 20 bp, Artificial
  CRISPR gRNA sequence
acacctgtaatcccagcact

SEQ ID NO: 24732 - DNA, 20 bp, Artificial
  CRISPR gRNA sequence
taatcccagcactttgggag

SEQ ID NO: 24733 - DNA, 20 bp, Artificial
  CRISPR gRNA sequence
tgggaggccaaggcgggtgg

SEQ ID NO: 24734 - DNA, 20 bp, Artificial
  CRISPR gRNA sequence
gggaggccaaggcgggtgga

SEQ ID NO: 24735 - DNA, 20 bp, Artificial
  CRISPR gRNA sequence
ggaggccaaggcgggtggat

SEQ ID NO: 24736 - DNA, 20 bp, Artificial
  CRISPR gRNA sequence
aggtcgggagttcgaaacca

SEQ ID NO: 24737 - DNA, 20 bp, Artificial
  CRISPR gRNA sequence
gaaaccagcctgaccaacat

SEQ ID NO: 24738 - DNA, 20 bp, Artificial
  CRISPR gRNA sequence
accaacatggtgaaacccca

SEQ ID NO: 24739 - DNA, 20 bp, Artificial
  CRISPR gRNA sequence
tactaaaaataaaaaaatta

SEQ ID NO: 24740 - DNA, 20 bp, Artificial
  CRISPR gRNA sequence
actaaaaataaaaaaattag

SEQ ID NO: 24741 - DNA, 20 bp, Artificial
  CRISPR gRNA sequence
ctaaaaataaaaaaattagc

SEQ ID NO: 24742 - DNA, 20 bp, Artificial
  CRISPR gRNA sequence
aaaataaaaaaattagccag

SEQ ID NO: 24743 - DNA, 20 bp, Artificial
  CRISPR gRNA sequence
gccaggcatggtggcgggtg

SEQ ID NO: 24744 - DNA, 20 bp, Artificial
  CRISPR gRNA sequence
taatgccagctacttgggag

SEQ ID NO: 24745 - DNA, 20 bp, Artificial
  CRISPR gRNA sequence
cttgggaggttgaagcagga

SEQ ID NO: 24746 - DNA, 20 bp, Artificial
  CRISPR gRNA sequence
gggaggttgaagcaggagaa

SEQ ID NO: 24747 - DNA, 20 bp, Artificial
  CRISPR gRNA sequence
ggaggttgaagcaggagaat

SEQ ID NO: 24748 - DNA, 20 bp, Artificial
  CRISPR gRNA sequence
aagcaggagaattgcttgaa

SEQ ID NO: 24749 - DNA, 20 bp, Artificial
  CRISPR gRNA sequence
cttgaatccgggaggcagag

SEQ ID NO: 24750 - DNA, 20 bp, Artificial
  CRISPR gRNA sequence
gaatccgggaggcagaggtt

SEQ ID NO: 24751 - DNA, 20 bp, Artificial
  CRISPR gRNA sequence
aatccgggaggcagaggttg

SEQ ID NO: 24752 - DNA, 20 bp, Artificial
  CRISPR gRNA sequence
cagtgagccaagattgcacc

SEQ ID NO: 24753 - DNA, 20 bp, Artificial
  CRISPR gRNA sequence
caccactgcactccagcctg

SEQ ID NO: 24754 - DNA, 20 bp, Artificial
  CRISPR gRNA sequence
cactccagcctgggcgacag

SEQ ID NO: 24755 - DNA, 20 bp, Artificial
  CRISPR gRNA sequence
cagcctgggcgacagagtga

SEQ ID NO: 24756 - DNA, 20 bp, Artificial
  CRISPR gRNA sequence
ggcgacagagtgagactctg

SEQ ID NO: 24757 - DNA, 20 bp, Artificial
  CRISPR gRNA sequence
tgtctcaaaaaaaaaaagaa

SEQ ID NO: 24758 - DNA, 20 bp, Artificial
  CRISPR gRNA sequence
tctcaaaaaaaaaaagaaaa

SEQ ID NO: 24759 - DNA, 20 bp, Artificial
  CRISPR gRNA sequence
aaaaaaaaaaagaaaaagaa

SEQ ID NO: 24760 - DNA, 20 bp, Artificial
  CRISPR gRNA sequence
aggaatggggtggcaagttg

SEQ ID NO: 24761 - DNA, 20 bp, Artificial
  CRISPR gRNA sequence
agtgtgtgttttctcatgag

SEQ ID NO: 24762 - DNA, 20 bp, Artificial
  CRISPR gRNA sequence
tctcatgagcttactcttca

SEQ ID NO: 24763 - DNA, 20 bp, Artificial
  CRISPR gRNA sequence
ctcatgagcttactcttcaa

SEQ ID NO: 24764 - DNA, 20 bp, Artificial
  CRISPR gRNA sequence
tcatgagcttactcttcaat

SEQ ID NO: 24765 - DNA, 20 bp, Artificial
  CRISPR gRNA sequence
atgagcttactcttcaatgt

SEQ ID NO: 24766 - DNA, 20 bp, Artificial
  CRISPR gRNA sequence
actcttcaatgtattctctt

SEQ ID NO: 24767 - DNA, 20 bp, Artificial
  CRISPR gRNA sequence
ctcttcaatgtattctcttc

SEQ ID NO: 24768 - DNA, 20 bp, Artificial
  CRISPR gRNA sequence
ttcaatgtattctcttctgg

SEQ ID NO: 24769 - DNA, 20 bp, Artificial
  CRISPR gRNA sequence
caatgtattctcttctgggc

SEQ ID NO: 24770 - DNA, 20 bp, Artificial
  CRISPR gRNA sequence
aatgtattctcttctgggcc

SEQ ID NO: 24771 - DNA, 20 bp, Artificial
  CRISPR gRNA sequence
tcttctgggcccagaacagg

SEQ ID NO: 24772 - DNA, 20 bp, Artificial
  CRISPR gRNA sequence
ttctgggcccagaacagggc

SEQ ID NO: 24773 - DNA, 20 bp, Artificial
  CRISPR gRNA sequence
ctgggcccagaacagggcag

SEQ ID NO: 24774 - DNA, 20 bp, Artificial
  CRISPR gRNA sequence
tgggcccagaacagggcagt

SEQ ID NO: 24775 - DNA, 20 bp, Artificial
  CRISPR gRNA sequence
ggcccagaacagggcagtag

SEQ ID NO: 24776 - DNA, 20 bp, Artificial
  CRISPR gRNA sequence
cctctggtcttccagcttca

SEQ ID NO: 24777 - DNA, 20 bp, Artificial
  CRISPR gRNA sequence
tggtcttccagcttcagggc

SEQ ID NO: 24778 - DNA, 20 bp, Artificial
  CRISPR gRNA sequence
gtcttccagcttcagggcca

SEQ ID NO: 24779 - DNA, 20 bp, Artificial
  CRISPR gRNA sequence
ccagcttcagggccagctct

SEQ ID NO: 24780 - DNA, 20 bp, Artificial
  CRISPR gRNA sequence
cagcttcagggccagctctc

SEQ ID NO: 24781 - DNA, 20 bp, Artificial
  CRISPR gRNA sequence
cagggccagctctcctctta

SEQ ID NO: 24782 - DNA, 20 bp, Artificial
  CRISPR gRNA sequence
agggccagctctcctcttac

SEQ ID NO: 24783 - DNA, 20 bp, Artificial
  CRISPR gRNA sequence
tcctcttacctcctccagga

SEQ ID NO: 24784 - DNA, 20 bp, Artificial
  CRISPR gRNA sequence
ctcttacctcctccaggaag

SEQ ID NO: 24785 - DNA, 20 bp, Artificial
  CRISPR gRNA sequence
ttacctcctccaggaagctc

SEQ ID NO: 24786 - DNA, 20 bp, Artificial
  CRISPR gRNA sequence
acctcctccaggaagctccc

SEQ ID NO: 24787 - DNA, 20 bp, Artificial
  CRISPR gRNA sequence
cctcctccaggaagctccct

SEQ ID NO: 24788 - DNA, 20 bp, Artificial
  CRISPR gRNA sequence
ctccaggaagctccctctgt

SEQ ID NO: 24789 - DNA, 20 bp, Artificial
  CRISPR gRNA sequence
caggaagctccctctgtttc

SEQ ID NO: 24790 - DNA, 20 bp, Artificial
  CRISPR gRNA sequence
cctctgtttctttccagcct

SEQ ID NO: 24791 - DNA, 20 bp, Artificial
  CRISPR gRNA sequence
tgtttctttccagccttcat

SEQ ID NO: 24792 - DNA, 20 bp, Artificial
  CRISPR gRNA sequence
tttctttccagccttcatct

SEQ ID NO: 24793 - DNA, 20 bp, Artificial
  CRISPR gRNA sequence
ctttccagccttcatctgca

SEQ ID NO: 24794 - DNA, 20 bp, Artificial
  CRISPR gRNA sequence
tttccagccttcatctgcat

SEQ ID NO: 24795 - DNA, 20 bp, Artificial
  CRISPR gRNA sequence
tccagccttcatctgcatgt

SEQ ID NO: 24796 - DNA, 20 bp, Artificial
  CRISPR gRNA sequence
ccagccttcatctgcatgtc

SEQ ID NO: 24797 - DNA, 20 bp, Artificial
  CRISPR gRNA sequence
cagccttcatctgcatgtca

SEQ ID NO: 24798 - DNA, 20 bp, Artificial
  CRISPR gRNA sequence
catctgcatgtcatgtgtgg

SEQ ID NO: 24799 - DNA, 20 bp, Artificial
  CRISPR gRNA sequence
atctgcatgtcatgtgtggt

SEQ ID NO: 24800 - DNA, 20 bp, Artificial
  CRISPR gRNA sequence
catgtcatgtgtggtgggtt

SEQ ID NO: 24801 - DNA, 20 bp, Artificial
  CRISPR gRNA sequence
aaaggtggccccccaaaaga

SEQ ID NO: 24802 - DNA, 20 bp, Artificial
  CRISPR gRNA sequence
gaacctgtcagtgtgacttt

SEQ ID NO: 24803 - DNA, 20 bp, Artificial
  CRISPR gRNA sequence
tcagtgtgactttatttggg

SEQ ID NO: 24804 - DNA, 20 bp, Artificial
  CRISPR gRNA sequence
tatttgggaaaagggtcttt

SEQ ID NO: 24805 - DNA, 20 bp, Artificial
  CRISPR gRNA sequence
atttgggaaaagggtctttg

SEQ ID NO: 24806 - DNA, 20 bp, Artificial
  CRISPR gRNA sequence
tttgggaaaagggtctttgc

SEQ ID NO: 24807 - DNA, 20 bp, Artificial
  CRISPR gRNA sequence
gggaaaagggtctttgcaga

SEQ ID NO: 24808 - DNA, 20 bp, Artificial
  CRISPR gRNA sequence
ggaaaagggtctttgcagat

SEQ ID NO: 24809 - DNA, 20 bp, Artificial
  CRISPR gRNA sequence
tgcagatagaattaagttaa

SEQ ID NO: 24810 - DNA, 20 bp, Artificial
  CRISPR gRNA sequence
gcagatagaattaagttaag

SEQ ID NO: 24811 - DNA, 20 bp, Artificial
  CRISPR gRNA sequence
cagatagaattaagttaagg

SEQ ID NO: 24812 - DNA, 20 bp, Artificial
  CRISPR gRNA sequence
agttaaggggctgggtgcag

SEQ ID NO: 24813 - DNA, 20 bp, Artificial
  CRISPR gRNA sequence
aggggctgggtgcagtggct

SEQ ID NO: 24814 - DNA, 20 bp, Artificial
  CRISPR gRNA sequence
ggtgcagtggctcatgcctg

SEQ ID NO: 24815 - DNA, 20 bp, Artificial
  CRISPR gRNA sequence
atgcctgtaatcccagcact

SEQ ID NO: 24816 - DNA, 20 bp, Artificial
  CRISPR gRNA sequence
taatcccagcactttgggaa

SEQ ID NO: 24817 - DNA, 20 bp, Artificial
  CRISPR gRNA sequence
tgggaagctgagattggagg

SEQ ID NO: 24818 - DNA, 20 bp, Artificial
  CRISPR gRNA sequence
gggaagctgagattggagga

SEQ ID NO: 24819 - DNA, 20 bp, Artificial
  CRISPR gRNA sequence
ggaagctgagattggaggat

SEQ ID NO: 24820 - DNA, 20 bp, Artificial
  CRISPR gRNA sequence
agattggaggatcacctgag

SEQ ID NO: 24821 - DNA, 20 bp, Artificial
  CRISPR gRNA sequence
gaggatcacctgaggtcagg

SEQ ID NO: 24822 - DNA, 20 bp, Artificial
  CRISPR gRNA sequence
aggtcaggagttcaagacca

SEQ ID NO: 24823 - DNA, 20 bp, Artificial
  CRISPR gRNA sequence
aagaccagcgtggccaacat

SEQ ID NO: 24824 - DNA, 20 bp, Artificial
  CRISPR gRNA sequence
ctactaaaaatacaaaaatt

SEQ ID NO: 24825 - DNA, 20 bp, Artificial
  CRISPR gRNA sequence
tactaaaaatacaaaaatta

SEQ ID NO: 24826 - DNA, 20 bp, Artificial
  CRISPR gRNA sequence
ctaaaaatacaaaaattagc

SEQ ID NO: 24827 - DNA, 20 bp, Artificial
  CRISPR gRNA sequence
aaaatacaaaaattagctgg

SEQ ID NO: 24828 - DNA, 20 bp, Artificial
  CRISPR gRNA sequence
gctggtcatggtggtgagca

SEQ ID NO: 24829 - DNA, 20 bp, Artificial
  CRISPR gRNA sequence
gtcatggtggtgagcacctg

SEQ ID NO: 24830 - DNA, 20 bp, Artificial
  CRISPR gRNA sequence
taatcccagctactcaggag

SEQ ID NO: 24831 - DNA, 20 bp, Artificial
  CRISPR gRNA sequence
ctcaggagactggggcagga

SEQ ID NO: 24832 - DNA, 20 bp, Artificial
  CRISPR gRNA sequence
aggagactggggcaggagaa

SEQ ID NO: 24833 - DNA, 20 bp, Artificial
  CRISPR gRNA sequence
gggcaggagaatcgcttgaa

SEQ ID NO: 24834 - DNA, 20 bp, Artificial
  CRISPR gRNA sequence
gaactgggaggtggaggttg

SEQ ID NO: 24835 - DNA, 20 bp, Artificial
  CRISPR gRNA sequence
aactgggaggtggaggttgc

SEQ ID NO: 24836 - DNA, 20 bp, Artificial
  CRISPR gRNA sequence
ggaggtggaggttgcagtga

SEQ ID NO: 24837 - DNA, 20 bp, Artificial
  CRISPR gRNA sequence
cagtgagccgatacagcgcc

SEQ ID NO: 24838 - DNA, 20 bp, Artificial
  CRISPR gRNA sequence
cattccagcctgggcaacag

SEQ ID NO: 24839 - DNA, 20 bp, Artificial
  CRISPR gRNA sequence
cagcctgggcaacagagcaa

SEQ ID NO: 24840 - DNA, 20 bp, Artificial
  CRISPR gRNA sequence
ggcaacagagcaagcctctg

SEQ ID NO: 24841 - DNA, 20 bp, Artificial
  CRISPR gRNA sequence
tgtctcaaaagaaggcaaaa

SEQ ID NO: 24842 - DNA, 20 bp, Artificial
  CRISPR gRNA sequence
tctcaaaagaaggcaaaaaa

SEQ ID NO: 24843 - DNA, 20 bp, Artificial
  CRISPR gRNA sequence
aaaagaaggcaaaaaaagaa

SEQ ID NO: 24844 - DNA, 20 bp, Artificial
  CRISPR gRNA sequence
aagatcttgaaatgacatca

SEQ ID NO: 24845 - DNA, 20 bp, Artificial
  CRISPR gRNA sequence
gaaatgacatcatcctggat

SEQ ID NO: 24846 - DNA, 20 bp, Artificial
  CRISPR gRNA sequence
aaatgacatcatcctggatt

SEQ ID NO: 24847 - DNA, 20 bp, Artificial
  CRISPR gRNA sequence
gattatctaggtgggtccta

SEQ ID NO: 24848 - DNA, 20 bp, Artificial
  CRISPR gRNA sequence
tctaggtgggtcctaaatcc

SEQ ID NO: 24849 - DNA, 20 bp, Artificial
  CRISPR gRNA sequence
ggtgggtcctaaatccaatg

SEQ ID NO: 24850 - DNA, 20 bp, Artificial
  CRISPR gRNA sequence
aatccaatgacaagtgtctt

SEQ ID NO: 24851 - DNA, 20 bp, Artificial
  CRISPR gRNA sequence
tataagagaaagagacttgc

SEQ ID NO: 24852 - DNA, 20 bp, Artificial
  CRISPR gRNA sequence
ataagagaaagagacttgct

SEQ ID NO: 24853 - DNA, 20 bp, Artificial
  CRISPR gRNA sequence
taagagaaagagacttgcta

SEQ ID NO: 24854 - DNA, 20 bp, Artificial
  CRISPR gRNA sequence
gctacatgaggagtaggtga

SEQ ID NO: 24855 - DNA, 20 bp, Artificial
  CRISPR gRNA sequence
ctacatgaggagtaggtgat

SEQ ID NO: 24856 - DNA, 20 bp, Artificial
  CRISPR gRNA sequence
catgaggagtaggtgatgtg

SEQ ID NO: 24857 - DNA, 20 bp, Artificial
  CRISPR gRNA sequence
aagctgagtttagagtgatg

SEQ ID NO: 24858 - DNA, 20 bp, Artificial
  CRISPR gRNA sequence
agtttagagtgatgcagcca

SEQ ID NO: 24859 - DNA, 20 bp, Artificial
  CRISPR gRNA sequence
agagtgatgcagccacaaga

SEQ ID NO: 24860 - DNA, 20 bp, Artificial
  CRISPR gRNA sequence
gagtgatgcagccacaagac

SEQ ID NO: 24861 - DNA, 20 bp, Artificial
  CRISPR gRNA sequence
ccagcagctagaggaggcaa

SEQ ID NO: 24862 - DNA, 20 bp, Artificial
  CRISPR gRNA sequence
gaggaggcaaggaagcattc

SEQ ID NO: 24863 - DNA, 20 bp, Artificial
  CRISPR gRNA sequence
tcccctcgagcctccagagg

SEQ ID NO: 24864 - DNA, 20 bp, Artificial
  CRISPR gRNA sequence
ccctcgagcctccagaggca

SEQ ID NO: 24865 - DNA, 20 bp, Artificial
  CRISPR gRNA sequence
gagcctccagaggcagcgtg

SEQ ID NO: 24866 - DNA, 20 bp, Artificial
  CRISPR gRNA sequence
cagaggcagcgtggccctgc

SEQ ID NO: 24867 - DNA, 20 bp, Artificial
  CRISPR gRNA sequence
ctgacaccttggcttcaact

SEQ ID NO: 24868 - DNA, 20 bp, Artificial
  CRISPR gRNA sequence
acaccttggcttcaacttct

SEQ ID NO: 24869 - DNA, 20 bp, Artificial
  CRISPR gRNA sequence
ggcttcaacttctggcctcc

SEQ ID NO: 24870 - DNA, 20 bp, Artificial
  CRISPR gRNA sequence
gcttcaacttctggcctcca

SEQ ID NO: 24871 - DNA, 20 bp, Artificial
  CRISPR gRNA sequence
caacttctggcctccagaac

SEQ ID NO: 24872 - DNA, 20 bp, Artificial
  CRISPR gRNA sequence
aacttctggcctccagaacc

SEQ ID NO: 24873 - DNA, 20 bp, Artificial
  CRISPR gRNA sequence
ctggcctccagaaccatgag

SEQ ID NO: 24874 - DNA, 20 bp, Artificial
  CRISPR gRNA sequence
tggcctccagaaccatgaga

SEQ ID NO: 24875 - DNA, 20 bp, Artificial
  CRISPR gRNA sequence
gcctccagaaccatgagaga

SEQ ID NO: 24876 - DNA, 20 bp, Artificial
  CRISPR gRNA sequence
cagaaccatgagagaataaa

SEQ ID NO: 24877 - DNA, 20 bp, Artificial
  CRISPR gRNA sequence
ttgttctgagctacctggat

SEQ ID NO: 24878 - DNA, 20 bp, Artificial
  CRISPR gRNA sequence
ttctgagctacctggatgct

SEQ ID NO: 24879 - DNA, 20 bp, Artificial
  CRISPR gRNA sequence
tgagctacctggatgctggt

SEQ ID NO: 24880 - DNA, 20 bp, Artificial
  CRISPR gRNA sequence
agctacctggatgctggtac

SEQ ID NO: 24881 - DNA, 20 bp, Artificial
  CRISPR gRNA sequence
cctggatgctggtaccttgt

SEQ ID NO: 24882 - DNA, 20 bp, Artificial
  CRISPR gRNA sequence
gatgctggtaccttgtttca

SEQ ID NO: 24883 - DNA, 20 bp, Artificial
  CRISPR gRNA sequence
gtaccttgtttcagcagccc

SEQ ID NO: 24884 - DNA, 20 bp, Artificial
  CRISPR gRNA sequence
gtttcagcagccctgggaaa

SEQ ID NO: 24885 - DNA, 20 bp, Artificial
  CRISPR gRNA sequence
tttcagcagccctgggaaat

SEQ ID NO: 24886 - DNA, 20 bp, Artificial
  CRISPR gRNA sequence
cagcagccctgggaaatgaa

SEQ ID NO: 24887 - DNA, 20 bp, Artificial
  CRISPR gRNA sequence
agcagccctgggaaatgaat

SEQ ID NO: 24888 - DNA, 20 bp, Artificial
  CRISPR gRNA sequence
ggaaatgaatataccatgga

SEQ ID NO: 24889 - DNA, 20 bp, Artificial
  CRISPR gRNA sequence
aaccacggatcctggcagga

SEQ ID NO: 24890 - DNA, 20 bp, Artificial
  CRISPR gRNA sequence
gcaggagccttagagccaca

SEQ ID NO: 24891 - DNA, 20 bp, Artificial
  CRISPR gRNA sequence
agagccacacagatgagcct

SEQ ID NO: 24892 - DNA, 20 bp, Artificial
  CRISPR gRNA sequence
gagccacacagatgagcctt

SEQ ID NO: 24893 - DNA, 20 bp, Artificial
  CRISPR gRNA sequence
cagcttggctttccccagca

SEQ ID NO: 24894 - DNA, 20 bp, Artificial
  CRISPR gRNA sequence
agcttggctttccccagcaa

SEQ ID NO: 24895 - DNA, 20 bp, Artificial
  CRISPR gRNA sequence
ggctttccccagcaagagct

SEQ ID NO: 24896 - DNA, 20 bp, Artificial
  CRISPR gRNA sequence
gctttccccagcaagagcta

SEQ ID NO: 24897 - DNA, 20 bp, Artificial
  CRISPR gRNA sequence
tccccagcaagagctacatg

SEQ ID NO: 24898 - DNA, 20 bp, Artificial
  CRISPR gRNA sequence
ccccagcaagagctacatga

SEQ ID NO: 24899 - DNA, 20 bp, Artificial
  CRISPR gRNA sequence
cccagcaagagctacatgat

SEQ ID NO: 24900 - DNA, 20 bp, Artificial
  CRISPR gRNA sequence
catgatcttgaggaagctgc

SEQ ID NO: 24901 - DNA, 20 bp, Artificial
  CRISPR gRNA sequence
gaggaagctgcttgtcttct

SEQ ID NO: 24902 - DNA, 20 bp, Artificial
  CRISPR gRNA sequence
aggaagctgcttgtcttctc

SEQ ID NO: 24903 - DNA, 20 bp, Artificial
  CRISPR gRNA sequence
cttgtcttctctgggtctca

SEQ ID NO: 24904 - DNA, 20 bp, Artificial
  CRISPR gRNA sequence
gtcttctctgggtctcaagt

SEQ ID NO: 24905 - DNA, 20 bp, Artificial
  CRISPR gRNA sequence
tcttctctgggtctcaagtt

SEQ ID NO: 24906 - DNA, 20 bp, Artificial
  CRISPR gRNA sequence
ctctgggtctcaagttcttc

SEQ ID NO: 24907 - DNA, 20 bp, Artificial
  CRISPR gRNA sequence
tctgggtctcaagttcttca

SEQ ID NO: 24908 - DNA, 20 bp, Artificial
  CRISPR gRNA sequence
tgggtctcaagttcttcatc

SEQ ID NO: 24909 - DNA, 20 bp, Artificial
  CRISPR gRNA sequence
ggtctcaagttcttcatctg

SEQ ID NO: 24910 - DNA, 20 bp, Artificial
  CRISPR gRNA sequence
aagttcttcatctgccaatg

SEQ ID NO: 24911 - DNA, 20 bp, Artificial
  CRISPR gRNA sequence
ttcatctgccaatggagaca

SEQ ID NO: 24912 - DNA, 20 bp, Artificial
  CRISPR gRNA sequence
catctgccaatggagacaat

SEQ ID NO: 24913 - DNA, 20 bp, Artificial
  CRISPR gRNA sequence
atctgccaatggagacaata

SEQ ID NO: 24914 - DNA, 20 bp, Artificial
  CRISPR gRNA sequence
ccaatggagacaataatgct

SEQ ID NO: 24915 - DNA, 20 bp, Artificial
  CRISPR gRNA sequence
acttcctaggttttaacagc

SEQ ID NO: 24916 - DNA, 20 bp, Artificial
  CRISPR gRNA sequence
cttcctaggttttaacagct

SEQ ID NO: 24917 - DNA, 20 bp, Artificial
  CRISPR gRNA sequence
cctaggttttaacagcttta

SEQ ID NO: 24918 - DNA, 20 bp, Artificial
  CRISPR gRNA sequence
ctaggttttaacagctttat

SEQ ID NO: 24919 - DNA, 20 bp, Artificial
  CRISPR gRNA sequence
ggttttaacagctttattga

SEQ ID NO: 24920 - DNA, 20 bp, Artificial
  CRISPR gRNA sequence
taacagctttattgagatgt

SEQ ID NO: 24921 - DNA, 20 bp, Artificial
  CRISPR gRNA sequence
aacagctttattgagatgta

SEQ ID NO: 24922 - DNA, 20 bp, Artificial
  CRISPR gRNA sequence
acagctttattgagatgtaa

SEQ ID NO: 24923 - DNA, 20 bp, Artificial
  CRISPR gRNA sequence
tattgagatgtaattcacat

SEQ ID NO: 24924 - DNA, 20 bp, Artificial
  CRISPR gRNA sequence
attgagatgtaattcacata

SEQ ID NO: 24925 - DNA, 20 bp, Artificial
  CRISPR gRNA sequence
ttgagatgtaattcacatat

SEQ ID NO: 24926 - DNA, 20 bp, Artificial
  CRISPR gRNA sequence
agatgtaattcacatataca

SEQ ID NO: 24927 - DNA, 20 bp, Artificial
  CRISPR gRNA sequence
acatatacaatttgcccact

SEQ ID NO: 24928 - DNA, 20 bp, Artificial
  CRISPR gRNA sequence
gcccacttaaaaagtacagt

SEQ ID NO: 24929 - DNA, 20 bp, Artificial
  CRISPR gRNA sequence
cccacttaaaaagtacagtt

SEQ ID NO: 24930 - DNA, 20 bp, Artificial
  CRISPR gRNA sequence
aaaaagtacagttcatgcct

SEQ ID NO: 24931 - DNA, 20 bp, Artificial
  CRISPR gRNA sequence
aaaagtacagttcatgcctg

SEQ ID NO: 24932 - DNA, 20 bp, Artificial
  CRISPR gRNA sequence
atgcctgtaatcccaacact

SEQ ID NO: 24933 - DNA, 20 bp, Artificial
  CRISPR gRNA sequence
taatcccaacactttgggag

SEQ ID NO: 24934 - DNA, 20 bp, Artificial
  CRISPR gRNA sequence
tgggaggccgaggagacagg

SEQ ID NO: 24935 - DNA, 20 bp, Artificial
  CRISPR gRNA sequence
gggaggccgaggagacaggc

SEQ ID NO: 24936 - DNA, 20 bp, Artificial
  CRISPR gRNA sequence
ggaggccgaggagacaggcg

SEQ ID NO: 24937 - DNA, 20 bp, Artificial
  CRISPR gRNA sequence
gaggtcaggagtttgagaac

SEQ ID NO: 24938 - DNA, 20 bp, Artificial
  CRISPR gRNA sequence
aggtcaggagtttgagaaca

SEQ ID NO: 24939 - DNA, 20 bp, Artificial
  CRISPR gRNA sequence
gagaacagcctggccaaaat

SEQ ID NO: 24940 - DNA, 20 bp, Artificial
  CRISPR gRNA sequence
agaacagcctggccaaaatg

SEQ ID NO: 24941 - DNA, 20 bp, Artificial
  CRISPR gRNA sequence
gccaaaatggtgaaacactg

SEQ ID NO: 24942 - DNA, 20 bp, Artificial
  CRISPR gRNA sequence
tctctactaaaaatgcaaaa

SEQ ID NO: 24943 - DNA, 20 bp, Artificial
  CRISPR gRNA sequence
tactaaaaatgcaaaaatta

SEQ ID NO: 24944 - DNA, 20 bp, Artificial
  CRISPR gRNA sequence
ctaaaaatgcaaaaattagc

SEQ ID NO: 24945 - DNA, 20 bp, Artificial
  CRISPR gRNA sequence
aaaatgcaaaaattagccgg

SEQ ID NO: 24946 - DNA, 20 bp, Artificial
  CRISPR gRNA sequence
gccgggtgtggtggtgggtg

SEQ ID NO: 24947 - DNA, 20 bp, Artificial
  CRISPR gRNA sequence
taatcccagctgctcaggag

SEQ ID NO: 24948 - DNA, 20 bp, Artificial
  CRISPR gRNA sequence
ctcaggaggctgaggcagaa

SEQ ID NO: 24949 - DNA, 20 bp, Artificial
  CRISPR gRNA sequence
aggaggctgaggcagaagaa

SEQ ID NO: 24950 - DNA, 20 bp, Artificial
  CRISPR gRNA sequence
aggcagaagaatggcttgaa

SEQ ID NO: 24951 - DNA, 20 bp, Artificial
  CRISPR gRNA sequence
gaacctgggaggcagacgtt

SEQ ID NO: 24952 - DNA, 20 bp, Artificial
  CRISPR gRNA sequence
aacctgggaggcagacgttg

SEQ ID NO: 24953 - DNA, 20 bp, Artificial
  CRISPR gRNA sequence
ggaggcagacgttgcagtga

SEQ ID NO: 24954 - DNA, 20 bp, Artificial
  CRISPR gRNA sequence
cagtgagccaagattgcacc

SEQ ID NO: 24955 - DNA, 20 bp, Artificial
  CRISPR gRNA sequence
cacccctgcactccagcctg

SEQ ID NO: 24956 - DNA, 20 bp, Artificial
  CRISPR gRNA sequence
cactccagcctgggtgacag

SEQ ID NO: 24957 - DNA, 20 bp, Artificial
  CRISPR gRNA sequence
cagcctgggtgacagagact

SEQ ID NO: 24958 - DNA, 20 bp, Artificial
  CRISPR gRNA sequence
ggtgacagagactccgtctt

SEQ ID NO: 24959 - DNA, 20 bp, Artificial
  CRISPR gRNA sequence
cgtcttaaaaaaaaaaaaaa

SEQ ID NO: 24960 - DNA, 20 bp, Artificial
  CRISPR gRNA sequence
aaaaaaaaaaaaaaaaaaaa

SEQ ID NO: 24961 - DNA, 20 bp, Artificial
  CRISPR gRNA sequence
aaaaaaaaaaaaaaaaaaaa

SEQ ID NO: 24962 - DNA, 20 bp, Artificial
  CRISPR gRNA sequence
agtgttcttttgggaatact

SEQ ID NO: 24963 - DNA, 20 bp, Artificial
  CRISPR gRNA sequence
ttttgggaatactcagagag

SEQ ID NO: 24964 - DNA, 20 bp, Artificial
  CRISPR gRNA sequence
ttgggaatactcagagagtt

SEQ ID NO: 24965 - DNA, 20 bp, Artificial
  CRISPR gRNA sequence
tgggaatactcagagagttg

SEQ ID NO: 24966 - DNA, 20 bp, Artificial
  CRISPR gRNA sequence
gggaatactcagagagttgt

SEQ ID NO: 24967 - DNA, 20 bp, Artificial
  CRISPR gRNA sequence
ggaatactcagagagttgtg

SEQ ID NO: 24968 - DNA, 20 bp, Artificial
  CRISPR gRNA sequence
agagagttgtgtgaccatct

SEQ ID NO: 24969 - DNA, 20 bp, Artificial
  CRISPR gRNA sequence
tgtgaccatctcccatcccc

SEQ ID NO: 24970 - DNA, 20 bp, Artificial
  CRISPR gRNA sequence
ccatccccacagtcaatttt

SEQ ID NO: 24971 - DNA, 20 bp, Artificial
  CRISPR gRNA sequence
tagcacatttcatcaccccc

SEQ ID NO: 24972 - DNA, 20 bp, Artificial
  CRISPR gRNA sequence
agcacatttcatcaccccct

SEQ ID NO: 24973 - DNA, 20 bp, Artificial
  CRISPR gRNA sequence
gcacatttcatcacccccta

SEQ ID NO: 24974 - DNA, 20 bp, Artificial
  CRISPR gRNA sequence
catcaccccctaaagaaact

SEQ ID NO: 24975 - DNA, 20 bp, Artificial
  CRISPR gRNA sequence
atcaccccctaaagaaactc

SEQ ID NO: 24976 - DNA, 20 bp, Artificial
  CRISPR gRNA sequence
aagaaactccagacccatca

SEQ ID NO: 24977 - DNA, 20 bp, Artificial
  CRISPR gRNA sequence
cagacccatcagcagttgtt

SEQ ID NO: 24978 - DNA, 20 bp, Artificial
  CRISPR gRNA sequence
ttccccatttccttccaaaa

SEQ ID NO: 24979 - DNA, 20 bp, Artificial
  CRISPR gRNA sequence
cccatttccttccaaaatcc

SEQ ID NO: 24980 - DNA, 20 bp, Artificial
  CRISPR gRNA sequence
ccttccaaaatccctctctg

SEQ ID NO: 24981 - DNA, 20 bp, Artificial
  CRISPR gRNA sequence
cttccaaaatccctctctgc

SEQ ID NO: 24982 - DNA, 20 bp, Artificial
  CRISPR gRNA sequence
ccaaaatccctctctgccaa

SEQ ID NO: 24983 - DNA, 20 bp, Artificial
  CRISPR gRNA sequence
caaaatccctctctgccaag

SEQ ID NO: 24984 - DNA, 20 bp, Artificial
  CRISPR gRNA sequence
tctgccaagccctaggcaac

SEQ ID NO: 24985 - DNA, 20 bp, Artificial
  CRISPR gRNA sequence
tgccaagccctaggcaacca

SEQ ID NO: 24986 - DNA, 20 bp, Artificial
  CRISPR gRNA sequence
ccaagccctaggcaaccact

SEQ ID NO: 24987 - DNA, 20 bp, Artificial
  CRISPR gRNA sequence
ggcaaccactaatatgcttt

SEQ ID NO: 24988 - DNA, 20 bp, Artificial
  CRISPR gRNA sequence
atatgctttctttcttaaaa

SEQ ID NO: 24989 - DNA, 20 bp, Artificial
  CRISPR gRNA sequence
tctttcttaaaaaaaaatta

SEQ ID NO: 24990 - DNA, 20 bp, Artificial
  CRISPR gRNA sequence
ctttcttaaaaaaaaattaa

SEQ ID NO: 24991 - DNA, 20 bp, Artificial
  CRISPR gRNA sequence
tttcttaaaaaaaaattaat

SEQ ID NO: 24992 - DNA, 20 bp, Artificial
  CRISPR gRNA sequence
tcttaaaaaaaaattaatag

SEQ ID NO: 24993 - DNA, 20 bp, Artificial
  CRISPR gRNA sequence
cttaaaaaaaaattaataga

SEQ ID NO: 24994 - DNA, 20 bp, Artificial
  CRISPR gRNA sequence
ttaaaaaaaaattaatagag

SEQ ID NO: 24995 - DNA, 20 bp, Artificial
  CRISPR gRNA sequence
aaaaaaaaattaatagagat

SEQ ID NO: 24996 - DNA, 20 bp, Artificial
  CRISPR gRNA sequence
aaaaaaaattaatagagata

SEQ ID NO: 24997 - DNA, 20 bp, Artificial
  CRISPR gRNA sequence
atagagataggcttttgcta

SEQ ID NO: 24998 - DNA, 20 bp, Artificial
  CRISPR gRNA sequence
ttgctatgttgcccaggctg

SEQ ID NO: 24999 - DNA, 20 bp, Artificial
  CRISPR gRNA sequence
tgctatgttgcccaggctgg

SEQ ID NO: 25000 - DNA, 20 bp, Artificial
  CRISPR gRNA sequence
gctatgttgcccaggctggt

SEQ ID NO: 25001 - DNA, 20 bp, Artificial
  CRISPR gRNA sequence
ctatgttgcccaggctggtc

SEQ ID NO: 25002 - DNA, 20 bp, Artificial
  CRISPR gRNA sequence
tgttgcccaggctggtcttg

SEQ ID NO: 25003 - DNA, 20 bp, Artificial
  CRISPR gRNA sequence
cccaggctggtcttgaacac

SEQ ID NO: 25004 - DNA, 20 bp, Artificial
  CRISPR gRNA sequence
gtcttgaacacctgggctca

SEQ ID NO: 25005 - DNA, 20 bp, Artificial
  CRISPR gRNA sequence
gaacacctgggctcaagcga

SEQ ID NO: 25006 - DNA, 20 bp, Artificial
  CRISPR gRNA sequence
aacacctgggctcaagcgat

SEQ ID NO: 25007 - DNA, 20 bp, Artificial
  CRISPR gRNA sequence
ggctcaagcgattctcctgt

SEQ ID NO: 25008 - DNA, 20 bp, Artificial
  CRISPR gRNA sequence
aagcgattctcctgtctcag

SEQ ID NO: 25009 - DNA, 20 bp, Artificial
  CRISPR gRNA sequence
tcctgtctcagcctcccaaa

SEQ ID NO: 25010 - DNA, 20 bp, Artificial
  CRISPR gRNA sequence
ctgtctcagcctcccaaagt

SEQ ID NO: 25011 - DNA, 20 bp, Artificial
  CRISPR gRNA sequence
tctcagcctcccaaagtgct

SEQ ID NO: 25012 - DNA, 20 bp, Artificial
  CRISPR gRNA sequence
agcctcccaaagtgctggga

SEQ ID NO: 25013 - DNA, 20 bp, Artificial
  CRISPR gRNA sequence
ccaaagtgctgggatttcag

SEQ ID NO: 25014 - DNA, 20 bp, Artificial
  CRISPR gRNA sequence
ggatttcaggcatgagccac

SEQ ID NO: 25015 - DNA, 20 bp, Artificial
  CRISPR gRNA sequence
caggcatgagccaccacgcc

SEQ ID NO: 25016 - DNA, 20 bp, Artificial
  CRISPR gRNA sequence
aggcatgagccaccacgccc

SEQ ID NO: 25017 - DNA, 20 bp, Artificial
  CRISPR gRNA sequence
ctactttatgtctccatgga

SEQ ID NO: 25018 - DNA, 20 bp, Artificial
  CRISPR gRNA sequence
ctttatgtctccatggattt

SEQ ID NO: 25019 - DNA, 20 bp, Artificial
  CRISPR gRNA sequence
tatgtctccatggatttgcc

SEQ ID NO: 25020 - DNA, 20 bp, Artificial
  CRISPR gRNA sequence
atgtctccatggatttgcct

SEQ ID NO: 25021 - DNA, 20 bp, Artificial
  CRISPR gRNA sequence
tgtctccatggatttgcctg

SEQ ID NO: 25022 - DNA, 20 bp, Artificial
  CRISPR gRNA sequence
catggatttgcctgttttgg

SEQ ID NO: 25023 - DNA, 20 bp, Artificial
  CRISPR gRNA sequence
gcctgttttggtcatttcaa

SEQ ID NO: 25024 - DNA, 20 bp, Artificial
  CRISPR gRNA sequence
cctgttttggtcatttcaaa

SEQ ID NO: 25025 - DNA, 20 bp, Artificial
  CRISPR gRNA sequence
ttttggtcatttcaaataaa

SEQ ID NO: 25026 - DNA, 20 bp, Artificial
  CRISPR gRNA sequence
tggtcatttcaaataaatag

SEQ ID NO: 25027 - DNA, 20 bp, Artificial
  CRISPR gRNA sequence
ggtcatttcaaataaataga

SEQ ID NO: 25028 - DNA, 20 bp, Artificial
  CRISPR gRNA sequence
gtcatttcaaataaatagaa

SEQ ID NO: 25029 - DNA, 20 bp, Artificial
  CRISPR gRNA sequence
caaataaatagaatcataca

SEQ ID NO: 25030 - DNA, 20 bp, Artificial
  CRISPR gRNA sequence
aaataaatagaatcatacaa

SEQ ID NO: 25031 - DNA, 20 bp, Artificial
  CRISPR gRNA sequence
tgtgtccggcttcttcactt

SEQ ID NO: 25032 - DNA, 20 bp, Artificial
  CRISPR gRNA sequence
gtgtccggcttcttcactta

SEQ ID NO: 25033 - DNA, 20 bp, Artificial
  CRISPR gRNA sequence
tgtccggcttcttcacttag

SEQ ID NO: 25034 - DNA, 20 bp, Artificial
  CRISPR gRNA sequence
cttcacttagcatttttttt

SEQ ID NO: 25035 - DNA, 20 bp, Artificial
  CRISPR gRNA sequence
ttcacttagcatttttttta

SEQ ID NO: 25036 - DNA, 20 bp, Artificial
  CRISPR gRNA sequence
cacttagcattttttttaag

SEQ ID NO: 25037 - DNA, 20 bp, Artificial
  CRISPR gRNA sequence
acttagcattttttttaagg

SEQ ID NO: 25038 - DNA, 20 bp, Artificial
  CRISPR gRNA sequence
agcattttttttaaggttca

SEQ ID NO: 25039 - DNA, 20 bp, Artificial
  CRISPR gRNA sequence
gcattttttttaaggttcat

SEQ ID NO: 25040 - DNA, 20 bp, Artificial
  CRISPR gRNA sequence
tttttaaggttcatccatgt

SEQ ID NO: 25041 - DNA, 20 bp, Artificial
  CRISPR gRNA sequence
ttttaaggttcatccatgtt

SEQ ID NO: 25042 - DNA, 20 bp, Artificial
  CRISPR gRNA sequence
tttaaggttcatccatgttc

SEQ ID NO: 25043 - DNA, 20 bp, Artificial
  CRISPR gRNA sequence
ttaaggttcatccatgttcc

SEQ ID NO: 25044 - DNA, 20 bp, Artificial
  CRISPR gRNA sequence
taaggttcatccatgttcca

SEQ ID NO: 25045 - DNA, 20 bp, Artificial
  CRISPR gRNA sequence
aaggttcatccatgttccag

SEQ ID NO: 25046 - DNA, 20 bp, Artificial
  CRISPR gRNA sequence
aggttcatccatgttccagc

SEQ ID NO: 25047 - DNA, 20 bp, Artificial
  CRISPR gRNA sequence
atccatgttccagcatgtat

SEQ ID NO: 25048 - DNA, 20 bp, Artificial
  CRISPR gRNA sequence
cagcatgtatcagtgctttc

SEQ ID NO: 25049 - DNA, 20 bp, Artificial
  CRISPR gRNA sequence
tctccctttaatggtggaat

SEQ ID NO: 25050 - DNA, 20 bp, Artificial
  CRISPR gRNA sequence
ctccctttaatggtggaata

SEQ ID NO: 25051 - DNA, 20 bp, Artificial
  CRISPR gRNA sequence
tccctttaatggtggaatac

SEQ ID NO: 25052 - DNA, 20 bp, Artificial
  CRISPR gRNA sequence
cctttaatggtggaatactt

SEQ ID NO: 25053 - DNA, 20 bp, Artificial
  CRISPR gRNA sequence
taatggtggaatactttatt

SEQ ID NO: 25054 - DNA, 20 bp, Artificial
  CRISPR gRNA sequence
aatggtggaatactttattg

SEQ ID NO: 25055 - DNA, 20 bp, Artificial
  CRISPR gRNA sequence
atggtggaatactttattgt

SEQ ID NO: 25056 - DNA, 20 bp, Artificial
  CRISPR gRNA sequence
tattgtatagataagcaaca

SEQ ID NO: 25057 - DNA, 20 bp, Artificial
  CRISPR gRNA sequence
attgtatagataagcaacat

SEQ ID NO: 25058 - DNA, 20 bp, Artificial
  CRISPR gRNA sequence
ttgtatagataagcaacatt

SEQ ID NO: 25059 - DNA, 20 bp, Artificial
  CRISPR gRNA sequence
tatagataagcaacattttg

SEQ ID NO: 25060 - DNA, 20 bp, Artificial
  CRISPR gRNA sequence
tgtttatccatttatttttt

SEQ ID NO: 25061 - DNA, 20 bp, Artificial
  CRISPR gRNA sequence
gtttatccatttattttttg

SEQ ID NO: 25062 - DNA, 20 bp, Artificial
  CRISPR gRNA sequence
tttatccatttattttttgg

SEQ ID NO: 25063 - DNA, 20 bp, Artificial
  CRISPR gRNA sequence
atccatttattttttggtgg

SEQ ID NO: 25064 - DNA, 20 bp, Artificial
  CRISPR gRNA sequence
tccatttattttttggtgga

SEQ ID NO: 25065 - DNA, 20 bp, Artificial
  CRISPR gRNA sequence
attttttggtggatatttgg

SEQ ID NO: 25066 - DNA, 20 bp, Artificial
  CRISPR gRNA sequence
ttttttggtggatatttggg

SEQ ID NO: 25067 - DNA, 20 bp, Artificial
  CRISPR gRNA sequence
tttggtggatatttgggctg

SEQ ID NO: 25068 - DNA, 20 bp, Artificial
  CRISPR gRNA sequence
ttggtggatatttgggctgt

SEQ ID NO: 25069 - DNA, 20 bp, Artificial
  CRISPR gRNA sequence
tggtggatatttgggctgtt

SEQ ID NO: 25070 - DNA, 20 bp, Artificial
  CRISPR gRNA sequence
ggtggatatttgggctgttt

SEQ ID NO: 25071 - DNA, 20 bp, Artificial
  CRISPR gRNA sequence
gtggatatttgggctgtttt

SEQ ID NO: 25072 - DNA, 20 bp, Artificial
  CRISPR gRNA sequence
gggctgtttttatattttgg

SEQ ID NO: 25073 - DNA, 20 bp, Artificial
  CRISPR gRNA sequence
ggctgtttttatattttggc

SEQ ID NO: 25074 - DNA, 20 bp, Artificial
  CRISPR gRNA sequence
tttttatattttggctattt

SEQ ID NO: 25075 - DNA, 20 bp, Artificial
  CRISPR gRNA sequence
ttatattttggctattttga

SEQ ID NO: 25076 - DNA, 20 bp, Artificial
  CRISPR gRNA sequence
tatattttggctattttgaa

SEQ ID NO: 25077 - DNA, 20 bp, Artificial
  CRISPR gRNA sequence
atattttggctattttgaat

SEQ ID NO: 25078 - DNA, 20 bp, Artificial
  CRISPR gRNA sequence
tattttggctattttgaatt

SEQ ID NO: 25079 - DNA, 20 bp, Artificial
  CRISPR gRNA sequence
tggctattttgaattatcct

SEQ ID NO: 25080 - DNA, 20 bp, Artificial
  CRISPR gRNA sequence
ggctattttgaattatcctt

SEQ ID NO: 25081 - DNA, 20 bp, Artificial
  CRISPR gRNA sequence
gctattttgaattatccttc

SEQ ID NO: 25082 - DNA, 20 bp, Artificial
  CRISPR gRNA sequence
ttttgaattatccttctgtg

SEQ ID NO: 25083 - DNA, 20 bp, Artificial
  CRISPR gRNA sequence
tgaattatccttctgtgaac

SEQ ID NO: 25084 - DNA, 20 bp, Artificial
  CRISPR gRNA sequence
gaattatccttctgtgaaca

SEQ ID NO: 25085 - DNA, 20 bp, Artificial
  CRISPR gRNA sequence
aattatccttctgtgaacat

SEQ ID NO: 25086 - DNA, 20 bp, Artificial
  CRISPR gRNA sequence
tccttctgtgaacattcgtg

SEQ ID NO: 25087 - DNA, 20 bp, Artificial
  CRISPR gRNA sequence
ctgtgaacattcgtgtatag

SEQ ID NO: 25088 - DNA, 20 bp, Artificial
  CRISPR gRNA sequence
tgtgaacattcgtgtatagg

SEQ ID NO: 25089 - DNA, 20 bp, Artificial
  CRISPR gRNA sequence
tgaacattcgtgtataggtt

SEQ ID NO: 25090 - DNA, 20 bp, Artificial
  CRISPR gRNA sequence
gtgtataggtttttgtgtgg

SEQ ID NO: 25091 - DNA, 20 bp, Artificial
  CRISPR gRNA sequence
ttgtgtggatatatctggtt

SEQ ID NO: 25092 - DNA, 20 bp, Artificial
  CRISPR gRNA sequence
tgtgtggatatatctggttt

SEQ ID NO: 25093 - DNA, 20 bp, Artificial
  CRISPR gRNA sequence
gtgtggatatatctggtttt

SEQ ID NO: 25094 - DNA, 20 bp, Artificial
  CRISPR gRNA sequence
tgtggatatatctggttttt

SEQ ID NO: 25095 - DNA, 20 bp, Artificial
  CRISPR gRNA sequence
gtttttcttgttttcttttg

SEQ ID NO: 25096 - DNA, 20 bp, Artificial
  CRISPR gRNA sequence
ttcttgttttcttttgtttt

SEQ ID NO: 25097 - DNA, 20 bp, Artificial
  CRISPR gRNA sequence
tcttgttttcttttgtttta

SEQ ID NO: 25098 - DNA, 20 bp, Artificial
  CRISPR gRNA sequence
cttgttttcttttgttttat

SEQ ID NO: 25099 - DNA, 20 bp, Artificial
  CRISPR gRNA sequence
ttgttttcttttgttttatt

SEQ ID NO: 25100 - DNA, 20 bp, Artificial
  CRISPR gRNA sequence
gttttcttttgttttattaa

SEQ ID NO: 25101 - DNA, 20 bp, Artificial
  CRISPR gRNA sequence
ttttcttttgttttattaat

SEQ ID NO: 25102 - DNA, 20 bp, Artificial
  CRISPR gRNA sequence
tcttttgttttattaataca

SEQ ID NO: 25103 - DNA, 20 bp, Artificial
  CRISPR gRNA sequence
cttttgttttattaatacat

SEQ ID NO: 25104 - DNA, 20 bp, Artificial
  CRISPR gRNA sequence
ttttgttttattaatacata

SEQ ID NO: 25105 - DNA, 20 bp, Artificial
  CRISPR gRNA sequence
ttgttttattaatacataat

SEQ ID NO: 25106 - DNA, 20 bp, Artificial
  CRISPR gRNA sequence
tgttttattaatacataata

SEQ ID NO: 25107 - DNA, 20 bp, Artificial
  CRISPR gRNA sequence
gttttattaatacataatat

SEQ ID NO: 25108 - DNA, 20 bp, Artificial
  CRISPR gRNA sequence
ttttattaatacataatatg

SEQ ID NO: 25109 - DNA, 20 bp, Artificial
  CRISPR gRNA sequence
tattaatacataatatgata

SEQ ID NO: 25110 - DNA, 20 bp, Artificial
  CRISPR gRNA sequence
attaatacataatatgatac

SEQ ID NO: 25111 - DNA, 20 bp, Artificial
  CRISPR gRNA sequence
ttaatacataatatgataca

SEQ ID NO: 25112 - DNA, 20 bp, Artificial
  CRISPR gRNA sequence
atacataatatgatacatat

SEQ ID NO: 25113 - DNA, 20 bp, Artificial
  CRISPR gRNA sequence
atggggtatatgtgaatatt

SEQ ID NO: 25114 - DNA, 20 bp, Artificial
  CRISPR gRNA sequence
tggggtatatgtgaatattt

SEQ ID NO: 25115 - DNA, 20 bp, Artificial
  CRISPR gRNA sequence
attacatgcatagaaggtat

SEQ ID NO: 25116 - DNA, 20 bp, Artificial
  CRISPR gRNA sequence
ttacatgcatagaaggtata

SEQ ID NO: 25117 - DNA, 20 bp, Artificial
  CRISPR gRNA sequence
catgcatagaaggtataatg

SEQ ID NO: 25118 - DNA, 20 bp, Artificial
  CRISPR gRNA sequence
gaggtatccacatttgggat

SEQ ID NO: 25119 - DNA, 20 bp, Artificial
  CRISPR gRNA sequence
aggtatccacatttgggatt

SEQ ID NO: 25120 - DNA, 20 bp, Artificial
  CRISPR gRNA sequence
gggattgtttaaagattaaa

SEQ ID NO: 25121 - DNA, 20 bp, Artificial
  CRISPR gRNA sequence
ggattgtttaaagattaaat

SEQ ID NO: 25122 - DNA, 20 bp, Artificial
  CRISPR gRNA sequence
tttaaagattaaatgaaata

SEQ ID NO: 25123 - DNA, 20 bp, Artificial
  CRISPR gRNA sequence
aaagattaaatgaaatagtg

SEQ ID NO: 25124 - DNA, 20 bp, Artificial
  CRISPR gRNA sequence
aagattaaatgaaatagtgt

SEQ ID NO: 25125 - DNA, 20 bp, Artificial
  CRISPR gRNA sequence
aatgaaatagtgttaaaagt

SEQ ID NO: 25126 - DNA, 20 bp, Artificial
  CRISPR gRNA sequence
aaagtatttaatatgccctt

SEQ ID NO: 25127 - DNA, 20 bp, Artificial
  CRISPR gRNA sequence
aatatgcccttcaacaaatg

SEQ ID NO: 25128 - DNA, 20 bp, Artificial
  CRISPR gRNA sequence
atatgcccttcaacaaatga

SEQ ID NO: 25129 - DNA, 20 bp, Artificial
  CRISPR gRNA sequence
caacaaatgatgaggaaatc

SEQ ID NO: 25130 - DNA, 20 bp, Artificial
  CRISPR gRNA sequence
aacaaatgatgaggaaatct

SEQ ID NO: 25131 - DNA, 20 bp, Artificial
  CRISPR gRNA sequence
agaatctgctcagactcctt

SEQ ID NO: 25132 - DNA, 20 bp, Artificial
  CRISPR gRNA sequence
gaatctgctcagactccttc

SEQ ID NO: 25133 - DNA, 20 bp, Artificial
  CRISPR gRNA sequence
ctcagactccttcagtttac

SEQ ID NO: 25134 - DNA, 20 bp, Artificial
  CRISPR gRNA sequence
agactccttcagtttacata

SEQ ID NO: 25135 - DNA, 20 bp, Artificial
  CRISPR gRNA sequence
cttcagtttacatattagga

SEQ ID NO: 25136 - DNA, 20 bp, Artificial
  CRISPR gRNA sequence
cagtttacatattaggaaac

SEQ ID NO: 25137 - DNA, 20 bp, Artificial
  CRISPR gRNA sequence
agtttacatattaggaaact

SEQ ID NO: 25138 - DNA, 20 bp, Artificial
  CRISPR gRNA sequence
acatattaggaaactgaggc

SEQ ID NO: 25139 - DNA, 20 bp, Artificial
  CRISPR gRNA sequence
catattaggaaactgaggca

SEQ ID NO: 25140 - DNA, 20 bp, Artificial
  CRISPR gRNA sequence
ggaaactgaggcacagaaag

SEQ ID NO: 25141 - DNA, 20 bp, Artificial
  CRISPR gRNA sequence
aggcacagaaaggagcagag

SEQ ID NO: 25142 - DNA, 20 bp, Artificial
  CRISPR gRNA sequence
gctcaagtccacccaaagca

SEQ ID NO: 25143 - DNA, 20 bp, Artificial
  CRISPR gRNA sequence
ctcaagtccacccaaagcag

SEQ ID NO: 25144 - DNA, 20 bp, Artificial
  CRISPR gRNA sequence
aagtccacccaaagcagtag

SEQ ID NO: 25145 - DNA, 20 bp, Artificial
  CRISPR gRNA sequence
tggttaaatgcaggacttca

SEQ ID NO: 25146 - DNA, 20 bp, Artificial
  CRISPR gRNA sequence
aatgcaggacttcagtcaga

SEQ ID NO: 25147 - DNA, 20 bp, Artificial
  CRISPR gRNA sequence
cagtcagactgtctgggttc

SEQ ID NO: 25148 - DNA, 20 bp, Artificial
  CRISPR gRNA sequence
agtcagactgtctgggttca

SEQ ID NO: 25149 - DNA, 20 bp, Artificial
  CRISPR gRNA sequence
tctgggttcaaatcctggtt

SEQ ID NO: 25150 - DNA, 20 bp, Artificial
  CRISPR gRNA sequence
ggttcaaatcctggttccac

SEQ ID NO: 25151 - DNA, 20 bp, Artificial
  CRISPR gRNA sequence
aaatcctggttccacttgga

SEQ ID NO: 25152 - DNA, 20 bp, Artificial
  CRISPR gRNA sequence
gttccacttggacatgggtt

SEQ ID NO: 25153 - DNA, 20 bp, Artificial
  CRISPR gRNA sequence
cacttggacatgggtttcct

SEQ ID NO: 25154 - DNA, 20 bp, Artificial
  CRISPR gRNA sequence
ggacatgggtttccttacat

SEQ ID NO: 25155 - DNA, 20 bp, Artificial
  CRISPR gRNA sequence
gacatgggtttccttacata

SEQ ID NO: 25156 - DNA, 20 bp, Artificial
  CRISPR gRNA sequence
ccttacataaatcacttcac

SEQ ID NO: 25157 - DNA, 20 bp, Artificial
  CRISPR gRNA sequence
cttacataaatcacttcacc

SEQ ID NO: 25158 - DNA, 20 bp, Artificial
  CRISPR gRNA sequence
acataaatcacttcacctct

SEQ ID NO: 25159 - DNA, 20 bp, Artificial
  CRISPR gRNA sequence
cataaatcacttcacctctc

SEQ ID NO: 25160 - DNA, 20 bp, Artificial
  CRISPR gRNA sequence
cacctctctgagcctcagtt

SEQ ID NO: 25161 - DNA, 20 bp, Artificial
  CRISPR gRNA sequence
acctctctgagcctcagttt

SEQ ID NO: 25162 - DNA, 20 bp, Artificial
  CRISPR gRNA sequence
tctgagcctcagttttctca

SEQ ID NO: 25163 - DNA, 20 bp, Artificial
  CRISPR gRNA sequence
tgagcctcagttttctcata

SEQ ID NO: 25164 - DNA, 20 bp, Artificial
  CRISPR gRNA sequence
agcctcagttttctcatatg

SEQ ID NO: 25165 - DNA, 20 bp, Artificial
  CRISPR gRNA sequence
agttttctcatatgcaaagt

SEQ ID NO: 25166 - DNA, 20 bp, Artificial
  CRISPR gRNA sequence
tctcatatgcaaagtgagga

SEQ ID NO: 25167 - DNA, 20 bp, Artificial
  CRISPR gRNA sequence
ctcatatgcaaagtgaggat

SEQ ID NO: 25168 - DNA, 20 bp, Artificial
  CRISPR gRNA sequence
tcatatgcaaagtgaggata

SEQ ID NO: 25169 - DNA, 20 bp, Artificial
  CRISPR gRNA sequence
atatgcaaagtgaggataat

SEQ ID NO: 25170 - DNA, 20 bp, Artificial
  CRISPR gRNA sequence
ccttacatggttactgatat

SEQ ID NO: 25171 - DNA, 20 bp, Artificial
  CRISPR gRNA sequence
cttacatggttactgatatg

SEQ ID NO: 25172 - DNA, 20 bp, Artificial
  CRISPR gRNA sequence
acatggttactgatatgagt

SEQ ID NO: 25173 - DNA, 20 bp, Artificial
  CRISPR gRNA sequence
catggttactgatatgagta

SEQ ID NO: 25174 - DNA, 20 bp, Artificial
  CRISPR gRNA sequence
ctgatatgagtattaaatgt

SEQ ID NO: 25175 - DNA, 20 bp, Artificial
  CRISPR gRNA sequence
atatgagtattaaatgtgcc

SEQ ID NO: 25176 - DNA, 20 bp, Artificial
  CRISPR gRNA sequence
aatgtgccagctcatgtgcc

SEQ ID NO: 25177 - DNA, 20 bp, Artificial
  CRISPR gRNA sequence
atgtgcctggcgtataggag

SEQ ID NO: 25178 - DNA, 20 bp, Artificial
  CRISPR gRNA sequence
gcgtataggaggtgctttat

SEQ ID NO: 25179 - DNA, 20 bp, Artificial
  CRISPR gRNA sequence
tataaaccttagctgttacc

SEQ ID NO: 25180 - DNA, 20 bp, Artificial
  CRISPR gRNA sequence
ataaaccttagctgttacca

SEQ ID NO: 25181 - DNA, 20 bp, Artificial
  CRISPR gRNA sequence
taaaccttagctgttaccac

SEQ ID NO: 25182 - DNA, 20 bp, Artificial
  CRISPR gRNA sequence
agctgttaccactcatggca

SEQ ID NO: 25183 - DNA, 20 bp, Artificial
  CRISPR gRNA sequence
gctgttaccactcatggcat

SEQ ID NO: 25184 - DNA, 20 bp, Artificial
  CRISPR gRNA sequence
ttaccactcatggcattgcc

SEQ ID NO: 25185 - DNA, 20 bp, Artificial
  CRISPR gRNA sequence
ccactcatggcattgccaaa

SEQ ID NO: 25186 - DNA, 20 bp, Artificial
  CRISPR gRNA sequence
atggcattgccaaatgtggg

SEQ ID NO: 25187 - DNA, 20 bp, Artificial
  CRISPR gRNA sequence
ccaaatgtgggacgggtctc

SEQ ID NO: 25188 - DNA, 20 bp, Artificial
  CRISPR gRNA sequence
ctgactctctggtgtgagat

SEQ ID NO: 25189 - DNA, 20 bp, Artificial
  CRISPR gRNA sequence
actctctggtgtgagattga

SEQ ID NO: 25190 - DNA, 20 bp, Artificial
  CRISPR gRNA sequence
tctggtgtgagattgatgga

SEQ ID NO: 25191 - DNA, 20 bp, Artificial
  CRISPR gRNA sequence
tggtgtgagattgatggaat

SEQ ID NO: 25192 - DNA, 20 bp, Artificial
  CRISPR gRNA sequence
gtgtgagattgatggaatcc

SEQ ID NO: 25193 - DNA, 20 bp, Artificial
  CRISPR gRNA sequence
atggaatccacactttccag

SEQ ID NO: 25194 - DNA, 20 bp, Artificial
  CRISPR gRNA sequence
tccagttcccttttctacct

SEQ ID NO: 25195 - DNA, 20 bp, Artificial
  CRISPR gRNA sequence
ccagttcccttttctacctc

SEQ ID NO: 25196 - DNA, 20 bp, Artificial
  CRISPR gRNA sequence
cagttcccttttctacctcc

SEQ ID NO: 25197 - DNA, 20 bp, Artificial
  CRISPR gRNA sequence
ccttttctacctcctgggta

SEQ ID NO: 25198 - DNA, 20 bp, Artificial
  CRISPR gRNA sequence
ttctacctcctgggtatctt

SEQ ID NO: 25199 - DNA, 20 bp, Artificial
  CRISPR gRNA sequence
tctacctcctgggtatcttc

SEQ ID NO: 25200 - DNA, 20 bp, Artificial
  CRISPR gRNA sequence
ctacctcctgggtatcttct

SEQ ID NO: 25201 - DNA, 20 bp, Artificial
  CRISPR gRNA sequence
tacctcctgggtatcttctc

SEQ ID NO: 25202 - DNA, 20 bp, Artificial
  CRISPR gRNA sequence
cctcctgggtatcttctcat

SEQ ID NO: 25203 - DNA, 20 bp, Artificial
  CRISPR gRNA sequence
ctgggtatcttctcatatgg

SEQ ID NO: 25204 - DNA, 20 bp, Artificial
  CRISPR gRNA sequence
ggtatcttctcatatggttg

SEQ ID NO: 25205 - DNA, 20 bp, Artificial
  CRISPR gRNA sequence
ctcatatggttgtaagttcc

SEQ ID NO: 25206 - DNA, 20 bp, Artificial
  CRISPR gRNA sequence
tcatatggttgtaagttcct

SEQ ID NO: 25207 - DNA, 20 bp, Artificial
  CRISPR gRNA sequence
atatggttgtaagttccttg

SEQ ID NO: 25208 - DNA, 20 bp, Artificial
  CRISPR gRNA sequence
taagttccttggaggaaggg

SEQ ID NO: 25209 - DNA, 20 bp, Artificial
  CRISPR gRNA sequence
cttggaggaagggaatgtgg

SEQ ID NO: 25210 - DNA, 20 bp, Artificial
  CRISPR gRNA sequence
ggaggaagggaatgtggctt

SEQ ID NO: 25211 - DNA, 20 bp, Artificial
  CRISPR gRNA sequence
gaggaagggaatgtggcttg

SEQ ID NO: 25212 - DNA, 20 bp, Artificial
  CRISPR gRNA sequence
gctctctccaccacgctgag

SEQ ID NO: 25213 - DNA, 20 bp, Artificial
  CRISPR gRNA sequence
ctctctccaccacgctgagc

SEQ ID NO: 25214 - DNA, 20 bp, Artificial
  CRISPR gRNA sequence
tctccaccacgctgagcata

SEQ ID NO: 25215 - DNA, 20 bp, Artificial
  CRISPR gRNA sequence
tccaccacgctgagcatata

SEQ ID NO: 25216 - DNA, 20 bp, Artificial
  CRISPR gRNA sequence
caccacgctgagcatataag

SEQ ID NO: 25217 - DNA, 20 bp, Artificial
  CRISPR gRNA sequence
agcatataagaggtgctgaa

SEQ ID NO: 25218 - DNA, 20 bp, Artificial
  CRISPR gRNA sequence
aatgagcgcttttattcact

SEQ ID NO: 25219 - DNA, 20 bp, Artificial
  CRISPR gRNA sequence
ttattcactcctctcatccc

SEQ ID NO: 25220 - DNA, 20 bp, Artificial
  CRISPR gRNA sequence
tattcactcctctcatcccc

SEQ ID NO: 25221 - DNA, 20 bp, Artificial
  CRISPR gRNA sequence
attcactcctctcatcccca

SEQ ID NO: 25222 - DNA, 20 bp, Artificial
  CRISPR gRNA sequence
ttcactcctctcatccccag

SEQ ID NO: 25223 - DNA, 20 bp, Artificial
  CRISPR gRNA sequence
actcctctcatccccagccc

SEQ ID NO: 25224 - DNA, 20 bp, Artificial
  CRISPR gRNA sequence
ctctcatccccagccctcac

SEQ ID NO: 25225 - DNA, 20 bp, Artificial
  CRISPR gRNA sequence
tcatccccagccctcaccag

SEQ ID NO: 25226 - DNA, 20 bp, Artificial
  CRISPR gRNA sequence
atccccagccctcaccagct

SEQ ID NO: 25227 - DNA, 20 bp, Artificial
  CRISPR gRNA sequence
accagctgggagttgttgta

SEQ ID NO: 25228 - DNA, 20 bp, Artificial
  CRISPR gRNA sequence
ggagttgttgtaggtgtcaa

SEQ ID NO: 25229 - DNA, 20 bp, Artificial
  CRISPR gRNA sequence
ttgtaggtgtcaattttctg

SEQ ID NO: 25230 - DNA, 20 bp, Artificial
  CRISPR gRNA sequence
taggtgtcaattttctgcct

SEQ ID NO: 25231 - DNA, 20 bp, Artificial
  CRISPR gRNA sequence
tctgcctctttccaacaccc

SEQ ID NO: 25232 - DNA, 20 bp, Artificial
  CRISPR gRNA sequence
ctgcctctttccaacaccct

SEQ ID NO: 25233 - DNA, 20 bp, Artificial
  CRISPR gRNA sequence
tgcctctttccaacaccctg

SEQ ID NO: 25234 - DNA, 20 bp, Artificial
  CRISPR gRNA sequence
cctctttccaacaccctgtg

SEQ ID NO: 25235 - DNA, 20 bp, Artificial
  CRISPR gRNA sequence
tttccaacaccctgtgaggt

SEQ ID NO: 25236 - DNA, 20 bp, Artificial
  CRISPR gRNA sequence
tccaacaccctgtgaggtga

SEQ ID NO: 25237 - DNA, 20 bp, Artificial
  CRISPR gRNA sequence
ccaacaccctgtgaggtgac

SEQ ID NO: 25238 - DNA, 20 bp, Artificial
  CRISPR gRNA sequence
caacaccctgtgaggtgact

SEQ ID NO: 25239 - DNA, 20 bp, Artificial
  CRISPR gRNA sequence
tgaggtgactgagcattgtc

SEQ ID NO: 25240 - DNA, 20 bp, Artificial
  CRISPR gRNA sequence
agcattgtcttccctcccag

SEQ ID NO: 25241 - DNA, 20 bp, Artificial
  CRISPR gRNA sequence
tcttccctcccaggcagctc

SEQ ID NO: 25242 - DNA, 20 bp, Artificial
  CRISPR gRNA sequence
ccctcccaggcagctcacag

SEQ ID NO: 25243 - DNA, 20 bp, Artificial
  CRISPR gRNA sequence
cctcccaggcagctcacagt

SEQ ID NO: 25244 - DNA, 20 bp, Artificial
  CRISPR gRNA sequence
ccaggcagctcacagtgtgc

SEQ ID NO: 25245 - DNA, 20 bp, Artificial
  CRISPR gRNA sequence
acagtgtgccaccatggagt

SEQ ID NO: 25246 - DNA, 20 bp, Artificial
  CRISPR gRNA sequence
gggcccctagaaggtggcta

SEQ ID NO: 25247 - DNA, 20 bp, Artificial
  CRISPR gRNA sequence
gaaggtggctacctggagct

SEQ ID NO: 25248 - DNA, 20 bp, Artificial
  CRISPR gRNA sequence
cctggagcttcttaacagcg

SEQ ID NO: 25249 - DNA, 20 bp, Artificial
  CRISPR gRNA sequence
gagcttcttaacagcgatgc

SEQ ID NO: 25250 - DNA, 20 bp, Artificial
  CRISPR gRNA sequence
cttaacagcgatgctgaccc

SEQ ID NO: 25251 - DNA, 20 bp, Artificial
  CRISPR gRNA sequence
ttaacagcgatgctgacccc

SEQ ID NO: 25252 - DNA, 20 bp, Artificial
  CRISPR gRNA sequence
aacagcgatgctgaccccct

SEQ ID NO: 25253 - DNA, 20 bp, Artificial
  CRISPR gRNA sequence
acagcgatgctgaccccctg

SEQ ID NO: 25254 - DNA, 20 bp, Artificial
  CRISPR gRNA sequence
accccctgtgcctctaccac

SEQ ID NO: 25255 - DNA, 20 bp, Artificial
  CRISPR gRNA sequence
tgcctctaccacttctatga

SEQ ID NO: 25256 - DNA, 20 bp, Artificial
  CRISPR gRNA sequence
taccacttctatgaccagat

SEQ ID NO: 25257 - DNA, 20 bp, Artificial
  CRISPR gRNA sequence
ccacttctatgaccagatgg

SEQ ID NO: 25258 - DNA, 20 bp, Artificial
  CRISPR gRNA sequence
ctatgaccagatggacctgg

SEQ ID NO: 25259 - DNA, 20 bp, Artificial
  CRISPR gRNA sequence
tatgaccagatggacctggc

SEQ ID NO: 25260 - DNA, 20 bp, Artificial
  CRISPR gRNA sequence
tgaccagatggacctggctg

SEQ ID NO: 25261 - DNA, 20 bp, Artificial
  CRISPR gRNA sequence
gctggagaagaagagattga

SEQ ID NO: 25262 - DNA, 20 bp, Artificial
  CRISPR gRNA sequence
gagaagaagagattgagctc

SEQ ID NO: 25263 - DNA, 20 bp, Artificial
  CRISPR gRNA sequence
agctctactcaggtgggccc

SEQ ID NO: 25264 - DNA, 20 bp, Artificial
  CRISPR gRNA sequence
tactcaggtgggccctcctc

SEQ ID NO: 25265 - DNA, 20 bp, Artificial
  CRISPR gRNA sequence
ctcaggtgggccctcctccc

SEQ ID NO: 25266 - DNA, 20 bp, Artificial
  CRISPR gRNA sequence
aggtgggccctcctccctct

SEQ ID NO: 25267 - DNA, 20 bp, Artificial
  CRISPR gRNA sequence
ctccctctggtctcttccgg

SEQ ID NO: 25268 - DNA, 20 bp, Artificial
  CRISPR gRNA sequence
cctctggtctcttccggtat

SEQ ID NO: 25269 - DNA, 20 bp, Artificial
  CRISPR gRNA sequence
tggtctcttccggtatcccc

SEQ ID NO: 25270 - DNA, 20 bp, Artificial
  CRISPR gRNA sequence
gtctcttccggtatccccca

SEQ ID NO: 25271 - DNA, 20 bp, Artificial
  CRISPR gRNA sequence
ttccggtatcccccacccct

SEQ ID NO: 25272 - DNA, 20 bp, Artificial
  CRISPR gRNA sequence
ccggtatcccccacccctca

SEQ ID NO: 25273 - DNA, 20 bp, Artificial
  CRISPR gRNA sequence
cggtatcccccacccctcag

SEQ ID NO: 25274 - DNA, 20 bp, Artificial
  CRISPR gRNA sequence
agcttgctgtagagacggca

SEQ ID NO: 25275 - DNA, 20 bp, Artificial
  CRISPR gRNA sequence
gctgtagagacggcaatcag

SEQ ID NO: 25276 - DNA, 20 bp, Artificial
  CRISPR gRNA sequence
ctgtagagacggcaatcagg

SEQ ID NO: 25277 - DNA, 20 bp, Artificial
  CRISPR gRNA sequence
tagagacggcaatcagggga

SEQ ID NO: 25278 - DNA, 20 bp, Artificial
  CRISPR gRNA sequence
tggtccctgccctcccgtca

SEQ ID NO: 25279 - DNA, 20 bp, Artificial
  CRISPR gRNA sequence
gtccctgccctcccgtcagc

SEQ ID NO: 25280 - DNA, 20 bp, Artificial
  CRISPR gRNA sequence
ccctcccgtcagcaccacgg

SEQ ID NO: 25281 - DNA, 20 bp, Artificial
  CRISPR gRNA sequence
ccgtcagcaccacggacagc

SEQ ID NO: 25282 - DNA, 20 bp, Artificial
  CRISPR gRNA sequence
ccacgtctgtgggacgctct

SEQ ID NO: 25283 - DNA, 20 bp, Artificial
  CRISPR gRNA sequence
tgggacgctctctgcagatg

SEQ ID NO: 25284 - DNA, 20 bp, Artificial
  CRISPR gRNA sequence
tctgcagatggggatgatct

SEQ ID NO: 25285 - DNA, 20 bp, Artificial
  CRISPR gRNA sequence
tgcagatggggatgatctcc

SEQ ID NO: 25286 - DNA, 20 bp, Artificial
  CRISPR gRNA sequence
cagatggggatgatctccca

SEQ ID NO: 25287 - DNA, 20 bp, Artificial
  CRISPR gRNA sequence
ccagccctgccccgcctctc

SEQ ID NO: 25288 - DNA, 20 bp, Artificial
  CRISPR gRNA sequence
ccccgcctctccctcgttcc

SEQ ID NO: 25289 - DNA, 20 bp, Artificial
  CRISPR gRNA sequence
tccctcgttccccaccagcc

SEQ ID NO: 25290 - DNA, 20 bp, Artificial
  CRISPR gRNA sequence
cctcgttccccaccagccct

SEQ ID NO: 25291 - DNA, 20 bp, Artificial
  CRISPR gRNA sequence
gttccccaccagccctcttt

SEQ ID NO: 25292 - DNA, 20 bp, Artificial
  CRISPR gRNA sequence
cccaccagccctctttccag

SEQ ID NO: 25293 - DNA, 20 bp, Artificial
  CRISPR gRNA sequence
tttccagaaatttccttctt

SEQ ID NO: 25294 - DNA, 20 bp, Artificial
  CRISPR gRNA sequence
tccagaaatttccttcttca

SEQ ID NO: 25295 - DNA, 20 bp, Artificial
  CRISPR gRNA sequence
ccagaaatttccttcttcat

SEQ ID NO: 25296 - DNA, 20 bp, Artificial
  CRISPR gRNA sequence
cagaaatttccttcttcatc

SEQ ID NO: 25297 - DNA, 20 bp, Artificial
  CRISPR gRNA sequence
ccttcttcatccaagggact

SEQ ID NO: 25298 - DNA, 20 bp, Artificial
  CRISPR gRNA sequence
cttcttcatccaagggactt

SEQ ID NO: 25299 - DNA, 20 bp, Artificial
  CRISPR gRNA sequence
cttcatccaagggacttttc

SEQ ID NO: 25300 - DNA, 20 bp, Artificial
  CRISPR gRNA sequence
ttcatccaagggacttttcc

SEQ ID NO: 25301 - DNA, 20 bp, Artificial
  CRISPR gRNA sequence
catccaagggacttttcctc

SEQ ID NO: 25302 - DNA, 20 bp, Artificial
  CRISPR gRNA sequence
atccaagggacttttcctcc

SEQ ID NO: 25303 - DNA, 20 bp, Artificial
  CRISPR gRNA sequence
ttcctcccagaacccgacac

SEQ ID NO: 25304 - DNA, 20 bp, Artificial
  CRISPR gRNA sequence
tcctcccagaacccgacaca

SEQ ID NO: 25305 - DNA, 20 bp, Artificial
  CRISPR gRNA sequence
cctcccagaacccgacacag

SEQ ID NO: 25306 - DNA, 20 bp, Artificial
  CRISPR gRNA sequence
ctcccagaacccgacacaga

SEQ ID NO: 25307 - DNA, 20 bp, Artificial
  CRISPR gRNA sequence
ccagaacccgacacagacac

SEQ ID NO: 25308 - DNA, 20 bp, Artificial
  CRISPR gRNA sequence
cgaccagttcagcaggctgt

SEQ ID NO: 25309 - DNA, 20 bp, Artificial
  CRISPR gRNA sequence
agcaggctgttgtgtgacat

SEQ ID NO: 25310 - DNA, 20 bp, Artificial
  CRISPR gRNA sequence
ttgtgtgacatggaaggtga

SEQ ID NO: 25311 - DNA, 20 bp, Artificial
  CRISPR gRNA sequence
tgtgacatggaaggtgatga

SEQ ID NO: 25312 - DNA, 20 bp, Artificial
  CRISPR gRNA sequence
atgccaatatcggtgaggaa

SEQ ID NO: 25313 - DNA, 20 bp, Artificial
  CRISPR gRNA sequence
tgccaatatcggtgaggaag

SEQ ID NO: 25314 - DNA, 20 bp, Artificial
  CRISPR gRNA sequence
agcccagaaaaggacaatca

SEQ ID NO: 25315 - DNA, 20 bp, Artificial
  CRISPR gRNA sequence
tttgctgccacttgtcaata

SEQ ID NO: 25316 - DNA, 20 bp, Artificial
  CRISPR gRNA sequence
tgctgccacttgtcaatatc

SEQ ID NO: 25317 - DNA, 20 bp, Artificial
  CRISPR gRNA sequence
gctgccacttgtcaatatca

SEQ ID NO: 25318 - DNA, 20 bp, Artificial
  CRISPR gRNA sequence
ctgccacttgtcaatatcac

SEQ ID NO: 25319 - DNA, 20 bp, Artificial
  CRISPR gRNA sequence
ccacttgtcaatatcaccca

SEQ ID NO: 25320 - DNA, 20 bp, Artificial
  CRISPR gRNA sequence
gtcaatatcacccattcatc

SEQ ID NO: 25321 - DNA, 20 bp, Artificial
  CRISPR gRNA sequence
tcaatatcacccattcatca

SEQ ID NO: 25322 - DNA, 20 bp, Artificial
  CRISPR gRNA sequence
atcatgagccacgtcagtcc

SEQ ID NO: 25323 - DNA, 20 bp, Artificial
  CRISPR gRNA sequence
ccacagaaatcattgcaagg

SEQ ID NO: 25324 - DNA, 20 bp, Artificial
  CRISPR gRNA sequence
caagggggatgcggagcaat

SEQ ID NO: 25325 - DNA, 20 bp, Artificial
  CRISPR gRNA sequence
gaggaacggagactccaggg

SEQ ID NO: 25326 - DNA, 20 bp, Artificial
  CRISPR gRNA sequence
cagggaagagaggggagatg

SEQ ID NO: 25327 - DNA, 20 bp, Artificial
  CRISPR gRNA sequence
cactaatgaccaccaagaaa

SEQ ID NO: 25328 - DNA, 20 bp, Artificial
  CRISPR gRNA sequence
actaatgaccaccaagaaaa

SEQ ID NO: 25329 - DNA, 20 bp, Artificial
  CRISPR gRNA sequence
atgaccaccaagaaaacaaa

SEQ ID NO: 25330 - DNA, 20 bp, Artificial
  CRISPR gRNA sequence
atgtttacatcctccacctc

SEQ ID NO: 25331 - DNA, 20 bp, Artificial
  CRISPR gRNA sequence
acatcctccacctccatttc

SEQ ID NO: 25332 - DNA, 20 bp, Artificial
  CRISPR gRNA sequence
catcctccacctccatttct

SEQ ID NO: 25333 - DNA, 20 bp, Artificial
  CRISPR gRNA sequence
cacctccatttctatacgca

SEQ ID NO: 25334 - DNA, 20 bp, Artificial
  CRISPR gRNA sequence
catttctatacgcatttctg

SEQ ID NO: 25335 - DNA, 20 bp, Artificial
  CRISPR gRNA sequence
ctatacgcatttctgcttct

SEQ ID NO: 25336 - DNA, 20 bp, Artificial
  CRISPR gRNA sequence
tatacgcatttctgcttctt

SEQ ID NO: 25337 - DNA, 20 bp, Artificial
  CRISPR gRNA sequence
tacgcatttctgcttcttgc

SEQ ID NO: 25338 - DNA, 20 bp, Artificial
  CRISPR gRNA sequence
ctgcttcttgctcttctgtc

SEQ ID NO: 25339 - DNA, 20 bp, Artificial
  CRISPR gRNA sequence
tgcttcttgctcttctgtcc

SEQ ID NO: 25340 - DNA, 20 bp, Artificial
  CRISPR gRNA sequence
cttcttgctcttctgtccat

SEQ ID NO: 25341 - DNA, 20 bp, Artificial
  CRISPR gRNA sequence
cttgctcttctgtccatcct

SEQ ID NO: 25342 - DNA, 20 bp, Artificial
  CRISPR gRNA sequence
ttgctcttctgtccatcctt

SEQ ID NO: 25343 - DNA, 20 bp, Artificial
  CRISPR gRNA sequence
gctcttctgtccatcctttc

SEQ ID NO: 25344 - DNA, 20 bp, Artificial
  CRISPR gRNA sequence
ctcttctgtccatcctttct

SEQ ID NO: 25345 - DNA, 20 bp, Artificial
  CRISPR gRNA sequence
ttctgtccatcctttctaca

SEQ ID NO: 25346 - DNA, 20 bp, Artificial
  CRISPR gRNA sequence
ctgtccatcctttctacaaa

SEQ ID NO: 25347 - DNA, 20 bp, Artificial
  CRISPR gRNA sequence
tgtccatcctttctacaaag

SEQ ID NO: 25348 - DNA, 20 bp, Artificial
  CRISPR gRNA sequence
tccatcctttctacaaagcc

SEQ ID NO: 25349 - DNA, 20 bp, Artificial
  CRISPR gRNA sequence
tctacaaagcccataccata

SEQ ID NO: 25350 - DNA, 20 bp, Artificial
  CRISPR gRNA sequence
ctacaaagcccataccatac

SEQ ID NO: 25351 - DNA, 20 bp, Artificial
  CRISPR gRNA sequence
tacaaagcccataccataca

SEQ ID NO: 25352 - DNA, 20 bp, Artificial
  CRISPR gRNA sequence
caaagcccataccatacacc

SEQ ID NO: 25353 - DNA, 20 bp, Artificial
  CRISPR gRNA sequence
tcccttttcctcccagctcc

SEQ ID NO: 25354 - DNA, 20 bp, Artificial
  CRISPR gRNA sequence
cccttttcctcccagctcct

SEQ ID NO: 25355 - DNA, 20 bp, Artificial
  CRISPR gRNA sequence
ccttttcctcccagctcctt

SEQ ID NO: 25356 - DNA, 20 bp, Artificial
  CRISPR gRNA sequence
ttcctcccagctccttagcc

SEQ ID NO: 25357 - DNA, 20 bp, Artificial
  CRISPR gRNA sequence
tcctcccagctccttagcca

SEQ ID NO: 25358 - DNA, 20 bp, Artificial
  CRISPR gRNA sequence
cctcccagctccttagccaa

SEQ ID NO: 25359 - DNA, 20 bp, Artificial
  CRISPR gRNA sequence
ctcccagctccttagccaag

SEQ ID NO: 25360 - DNA, 20 bp, Artificial
  CRISPR gRNA sequence
ccagctccttagccaagcta

SEQ ID NO: 25361 - DNA, 20 bp, Artificial
  CRISPR gRNA sequence
cttagccaagctactctagt

SEQ ID NO: 25362 - DNA, 20 bp, Artificial
  CRISPR gRNA sequence
agccaagctactctagtatt

SEQ ID NO: 25363 - DNA, 20 bp, Artificial
  CRISPR gRNA sequence
gccaagctactctagtattt

SEQ ID NO: 25364 - DNA, 20 bp, Artificial
  CRISPR gRNA sequence
ctctagtatttgtaataact

SEQ ID NO: 25365 - DNA, 20 bp, Artificial
  CRISPR gRNA sequence
tagtatttgtaataactagc

SEQ ID NO: 25366 - DNA, 20 bp, Artificial
  CRISPR gRNA sequence
gtatttgtaataactagcat

SEQ ID NO: 25367 - DNA, 20 bp, Artificial
  CRISPR gRNA sequence
gtaataactagcatttactg

SEQ ID NO: 25368 - DNA, 20 bp, Artificial
  CRISPR gRNA sequence
taataactagcatttactgg

SEQ ID NO: 25369 - DNA, 20 bp, Artificial
  CRISPR gRNA sequence
gcatttactggatactcata

SEQ ID NO: 25370 - DNA, 20 bp, Artificial
  CRISPR gRNA sequence
actggatactcatagtatgc

SEQ ID NO: 25371 - DNA, 20 bp, Artificial
  CRISPR gRNA sequence
ctggatactcatagtatgct

SEQ ID NO: 25372 - DNA, 20 bp, Artificial
  CRISPR gRNA sequence
gatactcatagtatgctcat

SEQ ID NO: 25373 - DNA, 20 bp, Artificial
  CRISPR gRNA sequence
atagtatgctcattgctgtc

SEQ ID NO: 25374 - DNA, 20 bp, Artificial
  CRISPR gRNA sequence
attgctgtccatacattatc

SEQ ID NO: 25375 - DNA, 20 bp, Artificial
  CRISPR gRNA sequence
ctgtccatacattatcatct

SEQ ID NO: 25376 - DNA, 20 bp, Artificial
  CRISPR gRNA sequence
tccatacattatcatctgga

SEQ ID NO: 25377 - DNA, 20 bp, Artificial
  CRISPR gRNA sequence
tcatctggaatccttacaac

SEQ ID NO: 25378 - DNA, 20 bp, Artificial
  CRISPR gRNA sequence
gaatccttacaacaacaaag

SEQ ID NO: 25379 - DNA, 20 bp, Artificial
  CRISPR gRNA sequence
acaacaacaaaggaaataca

SEQ ID NO: 25380 - DNA, 20 bp, Artificial
  CRISPR gRNA sequence
caacaacaaaggaaatacat

SEQ ID NO: 25381 - DNA, 20 bp, Artificial
  CRISPR gRNA sequence
ttagtttctgtcttttacaa

SEQ ID NO: 25382 - DNA, 20 bp, Artificial
  CRISPR gRNA sequence
gtttctgtcttttacaaatg

SEQ ID NO: 25383 - DNA, 20 bp, Artificial
  CRISPR gRNA sequence
ctgtcttttacaaatgagga

SEQ ID NO: 25384 - DNA, 20 bp, Artificial
  CRISPR gRNA sequence
tgtcttttacaaatgaggaa

SEQ ID NO: 25385 - DNA, 20 bp, Artificial
  CRISPR gRNA sequence
tcttttacaaatgaggaaat

SEQ ID NO: 25386 - DNA, 20 bp, Artificial
  CRISPR gRNA sequence
ttacaaatgaggaaattgag

SEQ ID NO: 25387 - DNA, 20 bp, Artificial
  CRISPR gRNA sequence
tacaaatgaggaaattgagg

SEQ ID NO: 25388 - DNA, 20 bp, Artificial
  CRISPR gRNA sequence
acaaatgaggaaattgaggt

SEQ ID NO: 25389 - DNA, 20 bp, Artificial
  CRISPR gRNA sequence
caaatgaggaaattgaggtt

SEQ ID NO: 25390 - DNA, 20 bp, Artificial
  CRISPR gRNA sequence
aggtttagagaggtgaaacg

SEQ ID NO: 25391 - DNA, 20 bp, Artificial
  CRISPR gRNA sequence
agagaggtgaaacgacctac

SEQ ID NO: 25392 - DNA, 20 bp, Artificial
  CRISPR gRNA sequence
gagaggtgaaacgacctacc

SEQ ID NO: 25393 - DNA, 20 bp, Artificial
  CRISPR gRNA sequence
cccaagtttgcattagagat

SEQ ID NO: 25394 - DNA, 20 bp, Artificial
  CRISPR gRNA sequence
gcattagagatagtaatgta

SEQ ID NO: 25395 - DNA, 20 bp, Artificial
  CRISPR gRNA sequence
cattagagatagtaatgtac

SEQ ID NO: 25396 - DNA, 20 bp, Artificial
  CRISPR gRNA sequence
gagatagtaatgtacagatc

SEQ ID NO: 25397 - DNA, 20 bp, Artificial
  CRISPR gRNA sequence
aaattctaacctaggtcttt

SEQ ID NO: 25398 - DNA, 20 bp, Artificial
  CRISPR gRNA sequence
taacctaggtctttctcgtt

SEQ ID NO: 25399 - DNA, 20 bp, Artificial
  CRISPR gRNA sequence
acctaggtctttctcgtttc

SEQ ID NO: 25400 - DNA, 20 bp, Artificial
  CRISPR gRNA sequence
ggtctttctcgtttcaaagt

SEQ ID NO: 25401 - DNA, 20 bp, Artificial
  CRISPR gRNA sequence
tctcgtttcaaagtctccat

SEQ ID NO: 25402 - DNA, 20 bp, Artificial
  CRISPR gRNA sequence
ctcgtttcaaagtctccatt

SEQ ID NO: 25403 - DNA, 20 bp, Artificial
  CRISPR gRNA sequence
tcgtttcaaagtctccattt

SEQ ID NO: 25404 - DNA, 20 bp, Artificial
  CRISPR gRNA sequence
gtttcaaagtctccattttt

SEQ ID NO: 25405 - DNA, 20 bp, Artificial
  CRISPR gRNA sequence
caaagtctccatttttaacc

SEQ ID NO: 25406 - DNA, 20 bp, Artificial
  CRISPR gRNA sequence
aaagtctccatttttaacca

SEQ ID NO: 25407 - DNA, 20 bp, Artificial
  CRISPR gRNA sequence
catttttaaccacaaaaaaa

SEQ ID NO: 25408 - DNA, 20 bp, Artificial
  CRISPR gRNA sequence
ttaaccacaaaaaaagaaag

SEQ ID NO: 25409 - DNA, 20 bp, Artificial
  CRISPR gRNA sequence
taaccacaaaaaaagaaagt

SEQ ID NO: 25410 - DNA, 20 bp, Artificial
  CRISPR gRNA sequence
aaccacaaaaaaagaaagtg

SEQ ID NO: 25411 - DNA, 20 bp, Artificial
  CRISPR gRNA sequence
accacaaaaaaagaaagtgt

SEQ ID NO: 25412 - DNA, 20 bp, Artificial
  CRISPR gRNA sequence
gggttggaagatttgctaag

SEQ ID NO: 25413 - DNA, 20 bp, Artificial
  CRISPR gRNA sequence
gaagatttgctaaggcttaa

SEQ ID NO: 25414 - DNA, 20 bp, Artificial
  CRISPR gRNA sequence
gctaaggcttaagcagagaa

SEQ ID NO: 25415 - DNA, 20 bp, Artificial
  CRISPR gRNA sequence
ctaaggcttaagcagagaag

SEQ ID NO: 25416 - DNA, 20 bp, Artificial
  CRISPR gRNA sequence
aggcttaagcagagaagcta

SEQ ID NO: 25417 - DNA, 20 bp, Artificial
  CRISPR gRNA sequence
aagcagagaagctaatttgt

SEQ ID NO: 25418 - DNA, 20 bp, Artificial
  CRISPR gRNA sequence
agcagagaagctaatttgta

SEQ ID NO: 25419 - DNA, 20 bp, Artificial
  CRISPR gRNA sequence
atttgtagccttaagaagag

SEQ ID NO: 25420 - DNA, 20 bp, Artificial
  CRISPR gRNA sequence
gtagccttaagaagagctac

SEQ ID NO: 25421 - DNA, 20 bp, Artificial
  CRISPR gRNA sequence
tagccttaagaagagctaca

SEQ ID NO: 25422 - DNA, 20 bp, Artificial
  CRISPR gRNA sequence
aagaagagctacagctttca

SEQ ID NO: 25423 - DNA, 20 bp, Artificial
  CRISPR gRNA sequence
agaagagctacagctttcag

SEQ ID NO: 25424 - DNA, 20 bp, Artificial
  CRISPR gRNA sequence
cagctttcagacaagggcag

SEQ ID NO: 25425 - DNA, 20 bp, Artificial
  CRISPR gRNA sequence
tcagacaagggcaggactct

SEQ ID NO: 25426 - DNA, 20 bp, Artificial
  CRISPR gRNA sequence
cagacaagggcaggactctt

SEQ ID NO: 25427 - DNA, 20 bp, Artificial
  CRISPR gRNA sequence
agacaagggcaggactcttg

SEQ ID NO: 25428 - DNA, 20 bp, Artificial
  CRISPR gRNA sequence
ttggggagaggtggtggtgg

SEQ ID NO: 25429 - DNA, 20 bp, Artificial
  CRISPR gRNA sequence
ggggagaggtggtggtggtg

SEQ ID NO: 25430 - DNA, 20 bp, Artificial
  CRISPR gRNA sequence
gggagaggtggtggtggtgt

SEQ ID NO: 25431 - DNA, 20 bp, Artificial
  CRISPR gRNA sequence
ctgctagtggtttgtttttt

SEQ ID NO: 25432 - DNA, 20 bp, Artificial
  CRISPR gRNA sequence
ctagtggtttgttttttggg

SEQ ID NO: 25433 - DNA, 20 bp, Artificial
  CRISPR gRNA sequence
gtggtttgttttttggggga

SEQ ID NO: 25434 - DNA, 20 bp, Artificial
  CRISPR gRNA sequence
gttttttgggggagagacgt

SEQ ID NO: 25435 - DNA, 20 bp, Artificial
  CRISPR gRNA sequence
ttttttgggggagagacgtg

SEQ ID NO: 25436 - DNA, 20 bp, Artificial
  CRISPR gRNA sequence
tttgggggagagacgtggga

SEQ ID NO: 25437 - DNA, 20 bp, Artificial
  CRISPR gRNA sequence
ttgggggagagacgtgggat

SEQ ID NO: 25438 - DNA, 20 bp, Artificial
  CRISPR gRNA sequence
tgggggagagacgtgggata

SEQ ID NO: 25439 - DNA, 20 bp, Artificial
  CRISPR gRNA sequence
gggggagagacgtgggatag

SEQ ID NO: 25440 - DNA, 20 bp, Artificial
  CRISPR gRNA sequence
ggggagagacgtgggataga

SEQ ID NO: 25441 - DNA, 20 bp, Artificial
  CRISPR gRNA sequence
ttctcaccagcatcaccacc

SEQ ID NO: 25442 - DNA, 20 bp, Artificial
  CRISPR gRNA sequence
ctcaccagcatcaccaccac

SEQ ID NO: 25443 - DNA, 20 bp, Artificial
  CRISPR gRNA sequence
tcaccagcatcaccaccacc

SEQ ID NO: 25444 - DNA, 20 bp, Artificial
  CRISPR gRNA sequence
accagcatcaccaccacctc

SEQ ID NO: 25445 - DNA, 20 bp, Artificial
  CRISPR gRNA sequence
atacagagcctatgttgaaa

SEQ ID NO: 25446 - DNA, 20 bp, Artificial
  CRISPR gRNA sequence
tgttgaaatagaaaaaagtg

SEQ ID NO: 25447 - DNA, 20 bp, Artificial
  CRISPR gRNA sequence
aaatagaaaaaagtggcctt

SEQ ID NO: 25448 - DNA, 20 bp, Artificial
  CRISPR gRNA sequence
tttctggaggatgcagcccc

SEQ ID NO: 25449 - DNA, 20 bp, Artificial
  CRISPR gRNA sequence
ttctggaggatgcagcccct

SEQ ID NO: 25450 - DNA, 20 bp, Artificial
  CRISPR gRNA sequence
tctggaggatgcagccccta

SEQ ID NO: 25451 - DNA, 20 bp, Artificial
  CRISPR gRNA sequence
ctggaggatgcagcccctac

SEQ ID NO: 25452 - DNA, 20 bp, Artificial
  CRISPR gRNA sequence
tggaggatgcagcccctacc

SEQ ID NO: 25453 - DNA, 20 bp, Artificial
  CRISPR gRNA sequence
gaggatgcagcccctaccag

SEQ ID NO: 25454 - DNA, 20 bp, Artificial
  CRISPR gRNA sequence
ccaggaagtaactgcttggc

SEQ ID NO: 25455 - DNA, 20 bp, Artificial
  CRISPR gRNA sequence
cttggctagcaaagtgcaag

SEQ ID NO: 25456 - DNA, 20 bp, Artificial
  CRISPR gRNA sequence
ggctagcaaagtgcaagccg

SEQ ID NO: 25457 - DNA, 20 bp, Artificial
  CRISPR gRNA sequence
gctagcaaagtgcaagccgg

SEQ ID NO: 25458 - DNA, 20 bp, Artificial
  CRISPR gRNA sequence
gcaaagtgcaagccggagtc

SEQ ID NO: 25459 - DNA, 20 bp, Artificial
  CRISPR gRNA sequence
cccccattttccttgttggc

SEQ ID NO: 25460 - DNA, 20 bp, Artificial
  CRISPR gRNA sequence
tccttgttggcttgggcacc

SEQ ID NO: 25461 - DNA, 20 bp, Artificial
  CRISPR gRNA sequence
ccttgttggcttgggcacct

SEQ ID NO: 25462 - DNA, 20 bp, Artificial
  CRISPR gRNA sequence
cttgttggcttgggcacctg

SEQ ID NO: 25463 - DNA, 20 bp, Artificial
  CRISPR gRNA sequence
gttggcttgggcacctgtgt

SEQ ID NO: 25464 - DNA, 20 bp, Artificial
  CRISPR gRNA sequence
ttggcttgggcacctgtgtg

SEQ ID NO: 25465 - DNA, 20 bp, Artificial
  CRISPR gRNA sequence
gcttgggcacctgtgtgcag

SEQ ID NO: 25466 - DNA, 20 bp, Artificial
  CRISPR gRNA sequence
gggcacctgtgtgcagtgaa

SEQ ID NO: 25467 - DNA, 20 bp, Artificial
  CRISPR gRNA sequence
ggcacctgtgtgcagtgaac

SEQ ID NO: 25468 - DNA, 20 bp, Artificial
  CRISPR gRNA sequence
tgtgcagtgaacaacctgca

SEQ ID NO: 25469 - DNA, 20 bp, Artificial
  CRISPR gRNA sequence
caaaactcttcttagtggtc

SEQ ID NO: 25470 - DNA, 20 bp, Artificial
  CRISPR gRNA sequence
ttcttagtggtcttcttcct

SEQ ID NO: 25471 - DNA, 20 bp, Artificial
  CRISPR gRNA sequence
cttagtggtcttcttcctgc

SEQ ID NO: 25472 - DNA, 20 bp, Artificial
  CRISPR gRNA sequence
ttagtggtcttcttcctgcc

SEQ ID NO: 25473 - DNA, 20 bp, Artificial
  CRISPR gRNA sequence
agtggtcttcttcctgccaa

SEQ ID NO: 25474 - DNA, 20 bp, Artificial
  CRISPR gRNA sequence
gtggtcttcttcctgccaac

SEQ ID NO: 25475 - DNA, 20 bp, Artificial
  CRISPR gRNA sequence
cttcctgccaacccaggaac

SEQ ID NO: 25476 - DNA, 20 bp, Artificial
  CRISPR gRNA sequence
ttcctgccaacccaggaaca

SEQ ID NO: 25477 - DNA, 20 bp, Artificial
  CRISPR gRNA sequence
cctgccaacccaggaacagc

SEQ ID NO: 25478 - DNA, 20 bp, Artificial
  CRISPR gRNA sequence
ctgccaacccaggaacagca

SEQ ID NO: 25479 - DNA, 20 bp, Artificial
  CRISPR gRNA sequence
ccaacccaggaacagcagca

SEQ ID NO: 25480 - DNA, 20 bp, Artificial
  CRISPR gRNA sequence
agcagttctgtgcttgatcc

SEQ ID NO: 25481 - DNA, 20 bp, Artificial
  CRISPR gRNA sequence
tgtgcttgatccaaatgtgg

SEQ ID NO: 25482 - DNA, 20 bp, Artificial
  CRISPR gRNA sequence
tgcttgatccaaatgtggcc

SEQ ID NO: 25483 - DNA, 20 bp, Artificial
  CRISPR gRNA sequence
gatccaaatgtggccaattt

SEQ ID NO: 25484 - DNA, 20 bp, Artificial
  CRISPR gRNA sequence
atccaaatgtggccaatttt

SEQ ID NO: 25485 - DNA, 20 bp, Artificial
  CRISPR gRNA sequence
ttccccagagcacagtgtat

SEQ ID NO: 25486 - DNA, 20 bp, Artificial
  CRISPR gRNA sequence
tccccagagcacagtgtatt

SEQ ID NO: 25487 - DNA, 20 bp, Artificial
  CRISPR gRNA sequence
ccccagagcacagtgtattg

SEQ ID NO: 25488 - DNA, 20 bp, Artificial
  CRISPR gRNA sequence
cccagagcacagtgtattga

SEQ ID NO: 25489 - DNA, 20 bp, Artificial
  CRISPR gRNA sequence
aaaatcataccaaggaagaa

SEQ ID NO: 25490 - DNA, 20 bp, Artificial
  CRISPR gRNA sequence
gtaattgttcatgtttcaga

SEQ ID NO: 25491 - DNA, 20 bp, Artificial
  CRISPR gRNA sequence
ttcatgtttcagaaattaca

SEQ ID NO: 25492 - DNA, 20 bp, Artificial
  CRISPR gRNA sequence
atgtttcagaaattacagaa

SEQ ID NO: 25493 - DNA, 20 bp, Artificial
  CRISPR gRNA sequence
cagaaattacagaactgaga

SEQ ID NO: 25494 - DNA, 20 bp, Artificial
  CRISPR gRNA sequence
agaaattacagaactgagag

SEQ ID NO: 25495 - DNA, 20 bp, Artificial
  CRISPR gRNA sequence
cagaactgagagcttgactg

SEQ ID NO: 25496 - DNA, 20 bp, Artificial
  CRISPR gRNA sequence
agagcttgactgcttccttc

SEQ ID NO: 25497 - DNA, 20 bp, Artificial
  CRISPR gRNA sequence
gactgcttccttcccttcct

SEQ ID NO: 25498 - DNA, 20 bp, Artificial
  CRISPR gRNA sequence
actgcttccttcccttcctg

SEQ ID NO: 25499 - DNA, 20 bp, Artificial
  CRISPR gRNA sequence
cttccttcccttcctgggga

SEQ ID NO: 25500 - DNA, 20 bp, Artificial
  CRISPR gRNA sequence
ccttcccttcctggggattt

SEQ ID NO: 25501 - DNA, 20 bp, Artificial
  CRISPR gRNA sequence
cttcccttcctggggattta

SEQ ID NO: 25502 - DNA, 20 bp, Artificial
  CRISPR gRNA sequence
cccttcctggggatttacat

SEQ ID NO: 25503 - DNA, 20 bp, Artificial
  CRISPR gRNA sequence
ccttcctggggatttacatg

SEQ ID NO: 25504 - DNA, 20 bp, Artificial
  CRISPR gRNA sequence
cctggggatttacatggggg

SEQ ID NO: 25505 - DNA, 20 bp, Artificial
  CRISPR gRNA sequence
ctggggatttacatggggga

SEQ ID NO: 25506 - DNA, 20 bp, Artificial
  CRISPR gRNA sequence
gggatttacatgggggaagc

SEQ ID NO: 25507 - DNA, 20 bp, Artificial
  CRISPR gRNA sequence
acatgggggaagcagaagtg

SEQ ID NO: 25508 - DNA, 20 bp, Artificial
  CRISPR gRNA sequence
catgggggaagcagaagtga

SEQ ID NO: 25509 - DNA, 20 bp, Artificial
  CRISPR gRNA sequence
gggctgaggacattcacatt

SEQ ID NO: 25510 - DNA, 20 bp, Artificial
  CRISPR gRNA sequence
aggacattcacatttcctca

SEQ ID NO: 25511 - DNA, 20 bp, Artificial
  CRISPR gRNA sequence
acatttcctcacaactggag

SEQ ID NO: 25512 - DNA, 20 bp, Artificial
  CRISPR gRNA sequence
cctcacaactggaggcagtc

SEQ ID NO: 25513 - DNA, 20 bp, Artificial
  CRISPR gRNA sequence
ctcacaactggaggcagtca

SEQ ID NO: 25514 - DNA, 20 bp, Artificial
  CRISPR gRNA sequence
acaactggaggcagtcatta

SEQ ID NO: 25515 - DNA, 20 bp, Artificial
  CRISPR gRNA sequence
gaggcagtcattaaggattt

SEQ ID NO: 25516 - DNA, 20 bp, Artificial
  CRISPR gRNA sequence
aggatttgggcatgtcatag

SEQ ID NO: 25517 - DNA, 20 bp, Artificial
  CRISPR gRNA sequence
gggcatgtcataggatttgg

SEQ ID NO: 25518 - DNA, 20 bp, Artificial
  CRISPR gRNA sequence
ggcatgtcataggatttggg

SEQ ID NO: 25519 - DNA, 20 bp, Artificial
  CRISPR gRNA sequence
gggtgtttttctcccccctt

SEQ ID NO: 25520 - DNA, 20 bp, Artificial
  CRISPR gRNA sequence
ggtgtttttctcccccctta

SEQ ID NO: 25521 - DNA, 20 bp, Artificial
  CRISPR gRNA sequence
ttctccccccttagtggcat

SEQ ID NO: 25522 - DNA, 20 bp, Artificial
  CRISPR gRNA sequence
tctccccccttagtggcatc

SEQ ID NO: 25523 - DNA, 20 bp, Artificial
  CRISPR gRNA sequence
ctccccccttagtggcatct

SEQ ID NO: 25524 - DNA, 20 bp, Artificial
  CRISPR gRNA sequence
tccccccttagtggcatctc

SEQ ID NO: 25525 - DNA, 20 bp, Artificial
  CRISPR gRNA sequence
cccccttagtggcatctcca

SEQ ID NO: 25526 - DNA, 20 bp, Artificial
  CRISPR gRNA sequence
agtggcatctccacaggcag

SEQ ID NO: 25527 - DNA, 20 bp, Artificial
  CRISPR gRNA sequence
gtggcatctccacaggcagc

SEQ ID NO: 25528 - DNA, 20 bp, Artificial
  CRISPR gRNA sequence
cacaggcagcgaaagctgtc

SEQ ID NO: 25529 - DNA, 20 bp, Artificial
  CRISPR gRNA sequence
tctaagcaaataggtgaggc

SEQ ID NO: 25530 - DNA, 20 bp, Artificial
  CRISPR gRNA sequence
agcaaataggtgaggcagtg

SEQ ID NO: 25531 - DNA, 20 bp, Artificial
  CRISPR gRNA sequence
gtccattttttgttgcttaa

SEQ ID NO: 25532 - DNA, 20 bp, Artificial
  CRISPR gRNA sequence
tttgttgcttaaaacaacat

SEQ ID NO: 25533 - DNA, 20 bp, Artificial
  CRISPR gRNA sequence
ttgttgcttaaaacaacata

SEQ ID NO: 25534 - DNA, 20 bp, Artificial
  CRISPR gRNA sequence
tgttgcttaaaacaacatac

SEQ ID NO: 25535 - DNA, 20 bp, Artificial
  CRISPR gRNA sequence
gttgcttaaaacaacatacc

SEQ ID NO: 25536 - DNA, 20 bp, Artificial
  CRISPR gRNA sequence
ttgcttaaaacaacatacct

SEQ ID NO: 25537 - DNA, 20 bp, Artificial
  CRISPR gRNA sequence
cttaaaacaacatacctgac

SEQ ID NO: 25538 - DNA, 20 bp, Artificial
  CRISPR gRNA sequence
aaaacaacatacctgacact

SEQ ID NO: 25539 - DNA, 20 bp, Artificial
  CRISPR gRNA sequence
aaacaacatacctgacactg

SEQ ID NO: 25540 - DNA, 20 bp, Artificial
  CRISPR gRNA sequence
acactgagtaatttataaag

SEQ ID NO: 25541 - DNA, 20 bp, Artificial
  CRISPR gRNA sequence
agtaatttataaagaaaaaa

SEQ ID NO: 25542 - DNA, 20 bp, Artificial
  CRISPR gRNA sequence
ataaagaaaaaaaatatttc

SEQ ID NO: 25543 - DNA, 20 bp, Artificial
  CRISPR gRNA sequence
taaagaaaaaaaatatttct

SEQ ID NO: 25544 - DNA, 20 bp, Artificial
  CRISPR gRNA sequence
cttacagttatggaggctga

SEQ ID NO: 25545 - DNA, 20 bp, Artificial
  CRISPR gRNA sequence
ttacagttatggaggctgag

SEQ ID NO: 25546 - DNA, 20 bp, Artificial
  CRISPR gRNA sequence
acagttatggaggctgagaa

SEQ ID NO: 25547 - DNA, 20 bp, Artificial
  CRISPR gRNA sequence
cagttatggaggctgagaag

SEQ ID NO: 25548 - DNA, 20 bp, Artificial
  CRISPR gRNA sequence
tggaggctgagaagtccaag

SEQ ID NO: 25549 - DNA, 20 bp, Artificial
  CRISPR gRNA sequence
agaagtccaaggttaggggc

SEQ ID NO: 25550 - DNA, 20 bp, Artificial
  CRISPR gRNA sequence
ggggctgcatctggtgaggg

SEQ ID NO: 25551 - DNA, 20 bp, Artificial
  CRISPR gRNA sequence
catctggtgagggccttctt

SEQ ID NO: 25552 - DNA, 20 bp, Artificial
  CRISPR gRNA sequence
gtgagggccttcttactggt

SEQ ID NO: 25553 - DNA, 20 bp, Artificial
  CRISPR gRNA sequence
cttactggtgaggactctct

SEQ ID NO: 25554 - DNA, 20 bp, Artificial
  CRISPR gRNA sequence
ttactggtgaggactctctg

SEQ ID NO: 25555 - DNA, 20 bp, Artificial
  CRISPR gRNA sequence
actggtgaggactctctgca

SEQ ID NO: 25556 - DNA, 20 bp, Artificial
  CRISPR gRNA sequence
ctggtgaggactctctgcag

SEQ ID NO: 25557 - DNA, 20 bp, Artificial
  CRISPR gRNA sequence
gtgaggactctctgcagagt

SEQ ID NO: 25558 - DNA, 20 bp, Artificial
  CRISPR gRNA sequence
tctgcagagtcccaaggcag

SEQ ID NO: 25559 - DNA, 20 bp, Artificial
  CRISPR gRNA sequence
tgcagagtcccaaggcagtg

SEQ ID NO: 25560 - DNA, 20 bp, Artificial
  CRISPR gRNA sequence
cagagtcccaaggcagtgtg

SEQ ID NO: 25561 - DNA, 20 bp, Artificial
  CRISPR gRNA sequence
cggtgtgatagtctctcttc

SEQ ID NO: 25562 - DNA, 20 bp, Artificial
  CRISPR gRNA sequence
ggtgtgatagtctctcttcc

SEQ ID NO: 25563 - DNA, 20 bp, Artificial
  CRISPR gRNA sequence
tcttcctcttctcataaaac

SEQ ID NO: 25564 - DNA, 20 bp, Artificial
  CRISPR gRNA sequence
ttcctcttctcataaaacca

SEQ ID NO: 25565 - DNA, 20 bp, Artificial
  CRISPR gRNA sequence
cctcttctcataaaaccact

SEQ ID NO: 25566 - DNA, 20 bp, Artificial
  CRISPR gRNA sequence
ctcttctcataaaaccacta

SEQ ID NO: 25567 - DNA, 20 bp, Artificial
  CRISPR gRNA sequence
ttctcataaaaccactagtc

SEQ ID NO: 25568 - DNA, 20 bp, Artificial
  CRISPR gRNA sequence
ctcataaaaccactagtctt

SEQ ID NO: 25569 - DNA, 20 bp, Artificial
  CRISPR gRNA sequence
tcataaaaccactagtctta

SEQ ID NO: 25570 - DNA, 20 bp, Artificial
  CRISPR gRNA sequence
ataaaaccactagtcttact

SEQ ID NO: 25571 - DNA, 20 bp, Artificial
  CRISPR gRNA sequence
gtcttactcccacgacaacc

SEQ ID NO: 25572 - DNA, 20 bp, Artificial
  CRISPR gRNA sequence
actcccacgacaacccatta

SEQ ID NO: 25573 - DNA, 20 bp, Artificial
  CRISPR gRNA sequence
ctcccacgacaacccattaa

SEQ ID NO: 25574 - DNA, 20 bp, Artificial
  CRISPR gRNA sequence
ccacgacaacccattaactt

SEQ ID NO: 25575 - DNA, 20 bp, Artificial
  CRISPR gRNA sequence
acttattaacctgtttatcc

SEQ ID NO: 25576 - DNA, 20 bp, Artificial
  CRISPR gRNA sequence
attaacctgtttatccacta

SEQ ID NO: 25577 - DNA, 20 bp, Artificial
  CRISPR gRNA sequence
ttaacctgtttatccactaa

SEQ ID NO: 25578 - DNA, 20 bp, Artificial
  CRISPR gRNA sequence
acctgtttatccactaatcc

SEQ ID NO: 25579 - DNA, 20 bp, Artificial
  CRISPR gRNA sequence
tttatccactaatccatgaa

SEQ ID NO: 25580 - DNA, 20 bp, Artificial
  CRISPR gRNA sequence
atccactaatccatgaacgg

SEQ ID NO: 25581 - DNA, 20 bp, Artificial
  CRISPR gRNA sequence
tccactaatccatgaacgga

SEQ ID NO: 25582 - DNA, 20 bp, Artificial
  CRISPR gRNA sequence
atccatgaacggattaaccc

SEQ ID NO: 25583 - DNA, 20 bp, Artificial
  CRISPR gRNA sequence
acccattcatcaaggaaaag

SEQ ID NO: 25584 - DNA, 20 bp, Artificial
  CRISPR gRNA sequence
atcaaggaaaagccccagtc

SEQ ID NO: 25585 - DNA, 20 bp, Artificial
  CRISPR gRNA sequence
ttaaaggccccacctctcaa

SEQ ID NO: 25586 - DNA, 20 bp, Artificial
  CRISPR gRNA sequence
aaaggccccacctctcaata

SEQ ID NO: 25587 - DNA, 20 bp, Artificial
  CRISPR gRNA sequence
aaggccccacctctcaatac

SEQ ID NO: 25588 - DNA, 20 bp, Artificial
  CRISPR gRNA sequence
tcaatactgccacatagggg

SEQ ID NO: 25589 - DNA, 20 bp, Artificial
  CRISPR gRNA sequence
aatactgccacataggggat

SEQ ID NO: 25590 - DNA, 20 bp, Artificial
  CRISPR gRNA sequence
ccacataggggattacattt

SEQ ID NO: 25591 - DNA, 20 bp, Artificial
  CRISPR gRNA sequence
catttatacatgagttttgg

SEQ ID NO: 25592 - DNA, 20 bp, Artificial
  CRISPR gRNA sequence
atacatgagttttggagaag

SEQ ID NO: 25593 - DNA, 20 bp, Artificial
  CRISPR gRNA sequence
tacatgagttttggagaaga

SEQ ID NO: 25594 - DNA, 20 bp, Artificial
  CRISPR gRNA sequence
tggagaagacaaacattcac

SEQ ID NO: 25595 - DNA, 20 bp, Artificial
  CRISPR gRNA sequence
ggagaagacaaacattcacg

SEQ ID NO: 25596 - DNA, 20 bp, Artificial
  CRISPR gRNA sequence
gagaagacaaacattcacgt

SEQ ID NO: 25597 - DNA, 20 bp, Artificial
  CRISPR gRNA sequence
acgtcataacaggcagcttc

SEQ ID NO: 25598 - DNA, 20 bp, Artificial
  CRISPR gRNA sequence
cacccaagtctgctcctcaa

SEQ ID NO: 25599 - DNA, 20 bp, Artificial
  CRISPR gRNA sequence
acccaagtctgctcctcaag

SEQ ID NO: 25600 - DNA, 20 bp, Artificial
  CRISPR gRNA sequence
ctcctcaagtctgtgggttt

SEQ ID NO: 25601 - DNA, 20 bp, Artificial
  CRISPR gRNA sequence
ctcaagtctgtgggttttct

SEQ ID NO: 25602 - DNA, 20 bp, Artificial
  CRISPR gRNA sequence
aagtctgtgggttttctctc

SEQ ID NO: 25603 - DNA, 20 bp, Artificial
  CRISPR gRNA sequence
tgggttttctctctgcttct

SEQ ID NO: 25604 - DNA, 20 bp, Artificial
  CRISPR gRNA sequence
tctctctgcttctggaaggt

SEQ ID NO: 25605 - DNA, 20 bp, Artificial
  CRISPR gRNA sequence
ctctctgcttctggaaggtg

SEQ ID NO: 25606 - DNA, 20 bp, Artificial
  CRISPR gRNA sequence
tctctgcttctggaaggtga

SEQ ID NO: 25607 - DNA, 20 bp, Artificial
  CRISPR gRNA sequence
tctgcttctggaaggtgaag

SEQ ID NO: 25608 - DNA, 20 bp, Artificial
  CRISPR gRNA sequence
tgcttctggaaggtgaagcc

SEQ ID NO: 25609 - DNA, 20 bp, Artificial
  CRISPR gRNA sequence
cttctggaaggtgaagccca

SEQ ID NO: 25610 - DNA, 20 bp, Artificial
  CRISPR gRNA sequence
ctggaaggtgaagcccaggc

SEQ ID NO: 25611 - DNA, 20 bp, Artificial
  CRISPR gRNA sequence
tggaaggtgaagcccaggcc

SEQ ID NO: 25612 - DNA, 20 bp, Artificial
  CRISPR gRNA sequence
gaaggtgaagcccaggcctg

SEQ ID NO: 25613 - DNA, 20 bp, Artificial
  CRISPR gRNA sequence
ggcaagtattcttttgcagc

SEQ ID NO: 25614 - DNA, 20 bp, Artificial
  CRISPR gRNA sequence
ttttgcagcatcctgaaata

SEQ ID NO: 25615 - DNA, 20 bp, Artificial
  CRISPR gRNA sequence
ttgcagcatcctgaaatatg

SEQ ID NO: 25616 - DNA, 20 bp, Artificial
  CRISPR gRNA sequence
tgcagcatcctgaaatatga

SEQ ID NO: 25617 - DNA, 20 bp, Artificial
  CRISPR gRNA sequence
gcagcatcctgaaatatgac

SEQ ID NO: 25618 - DNA, 20 bp, Artificial
  CRISPR gRNA sequence
cagcatcctgaaatatgacc

SEQ ID NO: 25619 - DNA, 20 bp, Artificial
  CRISPR gRNA sequence
aaatatgaccttagcttcta

SEQ ID NO: 25620 - DNA, 20 bp, Artificial
  CRISPR gRNA sequence
agcttctaaatgtgtaaaat

SEQ ID NO: 25621 - DNA, 20 bp, Artificial
  CRISPR gRNA sequence
gcttctaaatgtgtaaaatg

SEQ ID NO: 25622 - DNA, 20 bp, Artificial
  CRISPR gRNA sequence
ctaaatgtgtaaaatggaga

SEQ ID NO: 25623 - DNA, 20 bp, Artificial
  CRISPR gRNA sequence
taaatgtgtaaaatggagat

SEQ ID NO: 25624 - DNA, 20 bp, Artificial
  CRISPR gRNA sequence
aatgtgtaaaatggagataa

SEQ ID NO: 25625 - DNA, 20 bp, Artificial
  CRISPR gRNA sequence
taagactgaataagttacaa

SEQ ID NO: 25626 - DNA, 20 bp, Artificial
  CRISPR gRNA sequence
aataagttacaatgtgtaaa

SEQ ID NO: 25627 - DNA, 20 bp, Artificial
  CRISPR gRNA sequence
caatgtgtaaagcatttaga

SEQ ID NO: 25628 - DNA, 20 bp, Artificial
  CRISPR gRNA sequence
agaaaaggaatttgcacaga

SEQ ID NO: 25629 - DNA, 20 bp, Artificial
  CRISPR gRNA sequence
gaaaaggaatttgcacagag

SEQ ID NO: 25630 - DNA, 20 bp, Artificial
  CRISPR gRNA sequence
gcacagagtaagcattcagt

SEQ ID NO: 25631 - DNA, 20 bp, Artificial
  CRISPR gRNA sequence
cacagagtaagcattcagta

SEQ ID NO: 25632 - DNA, 20 bp, Artificial
  CRISPR gRNA sequence
agtagatgttaggtactacc

SEQ ID NO: 25633 - DNA, 20 bp, Artificial
  CRISPR gRNA sequence
ggtactaccccacaaccacc

SEQ ID NO: 25634 - DNA, 20 bp, Artificial
  CRISPR gRNA sequence
ccccacaaccaccgttatca

SEQ ID NO: 25635 - DNA, 20 bp, Artificial
  CRISPR gRNA sequence
tcattattatcaccatcatt

SEQ ID NO: 25636 - DNA, 20 bp, Artificial
  CRISPR gRNA sequence
ttatcaccatcattattatc

SEQ ID NO: 25637 - DNA, 20 bp, Artificial
  CRISPR gRNA sequence
tcaccatcattattatcatc

SEQ ID NO: 25638 - DNA, 20 bp, Artificial
  CRISPR gRNA sequence
ttatcatcttcattttcatc

SEQ ID NO: 25639 - DNA, 20 bp, Artificial
  CRISPR gRNA sequence
tcatcttcattttcatcacc

SEQ ID NO: 25640 - DNA, 20 bp, Artificial
  CRISPR gRNA sequence
cattttcatcaccttcatta

SEQ ID NO: 25641 - DNA, 20 bp, Artificial
  CRISPR gRNA sequence
attttcatcaccttcattat

SEQ ID NO: 25642 - DNA, 20 bp, Artificial
  CRISPR gRNA sequence
tcatcaccttcattatggcc

SEQ ID NO: 25643 - DNA, 20 bp, Artificial
  CRISPR gRNA sequence
catcaccttcattatggcca

SEQ ID NO: 25644 - DNA, 20 bp, Artificial
  CRISPR gRNA sequence
atcaccttcattatggccat

SEQ ID NO: 25645 - DNA, 20 bp, Artificial
  CRISPR gRNA sequence
cattatggccatcattccat

SEQ ID NO: 25646 - DNA, 20 bp, Artificial
  CRISPR gRNA sequence
attatggccatcattccatt

SEQ ID NO: 25647 - DNA, 20 bp, Artificial
  CRISPR gRNA sequence
tggccatcattccattcctc

SEQ ID NO: 25648 - DNA, 20 bp, Artificial
  CRISPR gRNA sequence
cattcctcagctcagaagcc

SEQ ID NO: 25649 - DNA, 20 bp, Artificial
  CRISPR gRNA sequence
ctcagctcagaagccttcta

SEQ ID NO: 25650 - DNA, 20 bp, Artificial
  CRISPR gRNA sequence
agctcagaagccttctatgg

SEQ ID NO: 25651 - DNA, 20 bp, Artificial
  CRISPR gRNA sequence
agaagccttctatggctccc

SEQ ID NO: 25652 - DNA, 20 bp, Artificial
  CRISPR gRNA sequence
ctatggctccccattgctta

SEQ ID NO: 25653 - DNA, 20 bp, Artificial
  CRISPR gRNA sequence
tatggctccccattgcttat

SEQ ID NO: 25654 - DNA, 20 bp, Artificial
  CRISPR gRNA sequence
tggctccccattgcttataa

SEQ ID NO: 25655 - DNA, 20 bp, Artificial
  CRISPR gRNA sequence
cccattgcttataaaatcaa

SEQ ID NO: 25656 - DNA, 20 bp, Artificial
  CRISPR gRNA sequence
cttataaaatcaagtcctaa

SEQ ID NO: 25657 - DNA, 20 bp, Artificial
  CRISPR gRNA sequence
ataaaatcaagtcctaactt

SEQ ID NO: 25658 - DNA, 20 bp, Artificial
  CRISPR gRNA sequence
taaaatcaagtcctaacttt

SEQ ID NO: 25659 - DNA, 20 bp, Artificial
  CRISPR gRNA sequence
actttccccagcatgaaact

SEQ ID NO: 25660 - DNA, 20 bp, Artificial
  CRISPR gRNA sequence
tccccagcatgaaacttcta

SEQ ID NO: 25661 - DNA, 20 bp, Artificial
  CRISPR gRNA sequence
ccccagcatgaaacttctac

SEQ ID NO: 25662 - DNA, 20 bp, Artificial
  CRISPR gRNA sequence
cccagcatgaaacttctacc

SEQ ID NO: 25663 - DNA, 20 bp, Artificial
  CRISPR gRNA sequence
ctaccaccgtcacctatctc

SEQ ID NO: 25664 - DNA, 20 bp, Artificial
  CRISPR gRNA sequence
taccaccgtcacctatctct

SEQ ID NO: 25665 - DNA, 20 bp, Artificial
  CRISPR gRNA sequence
ccaccgtcacctatctctca

SEQ ID NO: 25666 - DNA, 20 bp, Artificial
  CRISPR gRNA sequence
tctctcagggtttcctaaac

SEQ ID NO: 25667 - DNA, 20 bp, Artificial
  CRISPR gRNA sequence
tcagggtttcctaaacatac

SEQ ID NO: 25668 - DNA, 20 bp, Artificial
  CRISPR gRNA sequence
agggtttcctaaacatactc

SEQ ID NO: 25669 - DNA, 20 bp, Artificial
  CRISPR gRNA sequence
cctaaacatactctgaacaa

SEQ ID NO: 25670 - DNA, 20 bp, Artificial
  CRISPR gRNA sequence
ctaaacatactctgaacaag

SEQ ID NO: 25671 - DNA, 20 bp, Artificial
  CRISPR gRNA sequence
aacatactctgaacaagttt

SEQ ID NO: 25672 - DNA, 20 bp, Artificial
  CRISPR gRNA sequence
tgaacaagtttcctcactct

SEQ ID NO: 25673 - DNA, 20 bp, Artificial
  CRISPR gRNA sequence
aacaagtttcctcactctgc

SEQ ID NO: 25674 - DNA, 20 bp, Artificial
  CRISPR gRNA sequence
cctcactctgccactgtgac

SEQ ID NO: 25675 - DNA, 20 bp, Artificial
  CRISPR gRNA sequence
ctcactctgccactgtgacc

SEQ ID NO: 25676 - DNA, 20 bp, Artificial
  CRISPR gRNA sequence
actctgccactgtgacccag

SEQ ID NO: 25677 - DNA, 20 bp, Artificial
  CRISPR gRNA sequence
tgccactgtgacccagaaag

SEQ ID NO: 25678 - DNA, 20 bp, Artificial
  CRISPR gRNA sequence
ccactgtgacccagaaagct

SEQ ID NO: 25679 - DNA, 20 bp, Artificial
  CRISPR gRNA sequence
tgacccagaaagctatctgt

SEQ ID NO: 25680 - DNA, 20 bp, Artificial
  CRISPR gRNA sequence
tctgttctccttctcccaga

SEQ ID NO: 25681 - DNA, 20 bp, Artificial
  CRISPR gRNA sequence
ttctccttctcccagactct

SEQ ID NO: 25682 - DNA, 20 bp, Artificial
  CRISPR gRNA sequence
tccttctcccagactctgcc

SEQ ID NO: 25683 - DNA, 20 bp, Artificial
  CRISPR gRNA sequence
cttctcccagactctgcctc

SEQ ID NO: 25684 - DNA, 20 bp, Artificial
  CRISPR gRNA sequence
ctcccagactctgcctcatc

SEQ ID NO: 25685 - DNA, 20 bp, Artificial
  CRISPR gRNA sequence
tcccagactctgcctcatct

SEQ ID NO: 25686 - DNA, 20 bp, Artificial
  CRISPR gRNA sequence
ccagactctgcctcatcttt

SEQ ID NO: 25687 - DNA, 20 bp, Artificial
  CRISPR gRNA sequence
tgcctcatctttcaaggcct

SEQ ID NO: 25688 - DNA, 20 bp, Artificial
  CRISPR gRNA sequence
cctcatctttcaaggcctgg

SEQ ID NO: 25689 - DNA, 20 bp, Artificial
  CRISPR gRNA sequence
atctttcaaggcctggttcc

SEQ ID NO: 25690 - DNA, 20 bp, Artificial
  CRISPR gRNA sequence
tcaaggcctggttccaggat

SEQ ID NO: 25691 - DNA, 20 bp, Artificial
  CRISPR gRNA sequence
caaggcctggttccaggatc

SEQ ID NO: 25692 - DNA, 20 bp, Artificial
  CRISPR gRNA sequence
aaggcctggttccaggatcc

SEQ ID NO: 25693 - DNA, 20 bp, Artificial
  CRISPR gRNA sequence
gttccaggatcccttcctcc

SEQ ID NO: 25694 - DNA, 20 bp, Artificial
  CRISPR gRNA sequence
caggatcccttcctccagga

SEQ ID NO: 25695 - DNA, 20 bp, Artificial
  CRISPR gRNA sequence
cctccaggaagccttccctg

SEQ ID NO: 25696 - DNA, 20 bp, Artificial
  CRISPR gRNA sequence
ctccaggaagccttccctga

SEQ ID NO: 25697 - DNA, 20 bp, Artificial
  CRISPR gRNA sequence
caggaagccttccctgattg

SEQ ID NO: 25698 - DNA, 20 bp, Artificial
  CRISPR gRNA sequence
ccctgattgccctattccac

SEQ ID NO: 25699 - DNA, 20 bp, Artificial
  CRISPR gRNA sequence
cctgattgccctattccacc

SEQ ID NO: 25700 - DNA, 20 bp, Artificial
  CRISPR gRNA sequence
attgccctattccaccatac

SEQ ID NO: 25701 - DNA, 20 bp, Artificial
  CRISPR gRNA sequence
ccctattccaccatacacct

SEQ ID NO: 25702 - DNA, 20 bp, Artificial
  CRISPR gRNA sequence
ttccaccatacacctttttt

SEQ ID NO: 25703 - DNA, 20 bp, Artificial
  CRISPR gRNA sequence
caccatacaccttttttctc

SEQ ID NO: 25704 - DNA, 20 bp, Artificial
  CRISPR gRNA sequence
ttttctcggacttcatgtca

SEQ ID NO: 25705 - DNA, 20 bp, Artificial
  CRISPR gRNA sequence
tttctcggacttcatgtcat

SEQ ID NO: 25706 - DNA, 20 bp, Artificial
  CRISPR gRNA sequence
ttctcggacttcatgtcatg

SEQ ID NO: 25707 - DNA, 20 bp, Artificial
  CRISPR gRNA sequence
tctcggacttcatgtcatgg

SEQ ID NO: 25708 - DNA, 20 bp, Artificial
  CRISPR gRNA sequence
ctcggacttcatgtcatggt

SEQ ID NO: 25709 - DNA, 20 bp, Artificial
  CRISPR gRNA sequence
tcggacttcatgtcatggtg

SEQ ID NO: 25710 - DNA, 20 bp, Artificial
  CRISPR gRNA sequence
ggacttcatgtcatggtgcc

SEQ ID NO: 25711 - DNA, 20 bp, Artificial
  CRISPR gRNA sequence
catgtcatggtgcctatatt

SEQ ID NO: 25712 - DNA, 20 bp, Artificial
  CRISPR gRNA sequence
atgtcatggtgcctatattc

SEQ ID NO: 25713 - DNA, 20 bp, Artificial
  CRISPR gRNA sequence
tattccaagggctctgagcc

SEQ ID NO: 25714 - DNA, 20 bp, Artificial
  CRISPR gRNA sequence
caagggctctgagccatgta

SEQ ID NO: 25715 - DNA, 20 bp, Artificial
  CRISPR gRNA sequence
tgagccatgtacccctttat

SEQ ID NO: 25716 - DNA, 20 bp, Artificial
  CRISPR gRNA sequence
agccatgtacccctttatat

SEQ ID NO: 25717 - DNA, 20 bp, Artificial
  CRISPR gRNA sequence
tatatagttaccactattta

SEQ ID NO: 25718 - DNA, 20 bp, Artificial
  CRISPR gRNA sequence
atatagttaccactatttac

SEQ ID NO: 25719 - DNA, 20 bp, Artificial
  CRISPR gRNA sequence
tatagttaccactatttact

SEQ ID NO: 25720 - DNA, 20 bp, Artificial
  CRISPR gRNA sequence
ccactatttactgagtgcct

SEQ ID NO: 25721 - DNA, 20 bp, Artificial
  CRISPR gRNA sequence
tttactgagtgcctactgta

SEQ ID NO: 25722 - DNA, 20 bp, Artificial
  CRISPR gRNA sequence
actgagtgcctactgtatac

SEQ ID NO: 25723 - DNA, 20 bp, Artificial
  CRISPR gRNA sequence
ctgagtgcctactgtatacc

SEQ ID NO: 25724 - DNA, 20 bp, Artificial
  CRISPR gRNA sequence
agtgcctactgtataccagc

SEQ ID NO: 25725 - DNA, 20 bp, Artificial
  CRISPR gRNA sequence
ctgtataccagctactgtgt

SEQ ID NO: 25726 - DNA, 20 bp, Artificial
  CRISPR gRNA sequence
tataccagctactgtgttgg

SEQ ID NO: 25727 - DNA, 20 bp, Artificial
  CRISPR gRNA sequence
ctgtgttggatgctctagat

SEQ ID NO: 25728 - DNA, 20 bp, Artificial
  CRISPR gRNA sequence
tgttggatgctctagatgta

SEQ ID NO: 25729 - DNA, 20 bp, Artificial
  CRISPR gRNA sequence
gatgctctagatgtagaacc

SEQ ID NO: 25730 - DNA, 20 bp, Artificial
  CRISPR gRNA sequence
tagatgtagaacctctaatt

SEQ ID NO: 25731 - DNA, 20 bp, Artificial
  CRISPR gRNA sequence
gatgtagaacctctaattat

SEQ ID NO: 25732 - DNA, 20 bp, Artificial
  CRISPR gRNA sequence
taattatcaccatcgattcc

SEQ ID NO: 25733 - DNA, 20 bp, Artificial
  CRISPR gRNA sequence
attatcaccatcgattcctg

SEQ ID NO: 25734 - DNA, 20 bp, Artificial
  CRISPR gRNA sequence
tcaccatcgattcctgggta

SEQ ID NO: 25735 - DNA, 20 bp, Artificial
  CRISPR gRNA sequence
ctgggtagtaggcattattt

SEQ ID NO: 25736 - DNA, 20 bp, Artificial
  CRISPR gRNA sequence
ggtagtaggcattatttatt

SEQ ID NO: 25737 - DNA, 20 bp, Artificial
  CRISPR gRNA sequence
tttattcatcttacacagat

SEQ ID NO: 25738 - DNA, 20 bp, Artificial
  CRISPR gRNA sequence
attcatcttacacagatgag

SEQ ID NO: 25739 - DNA, 20 bp, Artificial
  CRISPR gRNA sequence
ttcatcttacacagatgaga

SEQ ID NO: 25740 - DNA, 20 bp, Artificial
  CRISPR gRNA sequence
atcttacacagatgagaaaa

SEQ ID NO: 25741 - DNA, 20 bp, Artificial
  CRISPR gRNA sequence
acacagatgagaaaatggag

SEQ ID NO: 25742 - DNA, 20 bp, Artificial
  CRISPR gRNA sequence
cacagatgagaaaatggagg

SEQ ID NO: 25743 - DNA, 20 bp, Artificial
  CRISPR gRNA sequence
aataagtagcccaagattgc

SEQ ID NO: 25744 - DNA, 20 bp, Artificial
  CRISPR gRNA sequence
cacagctagtagggctagtg

SEQ ID NO: 25745 - DNA, 20 bp, Artificial
  CRISPR gRNA sequence
gtagggctagtggaaagtag

SEQ ID NO: 25746 - DNA, 20 bp, Artificial
  CRISPR gRNA sequence
gtggaaagtagaggtggaat

SEQ ID NO: 25747 - DNA, 20 bp, Artificial
  CRISPR gRNA sequence
gaactcaaatcctgcagtaa

SEQ ID NO: 25748 - DNA, 20 bp, Artificial
  CRISPR gRNA sequence
aactcaaatcctgcagtaac

SEQ ID NO: 25749 - DNA, 20 bp, Artificial
  CRISPR gRNA sequence
aaatcctgcagtaactctac

SEQ ID NO: 25750 - DNA, 20 bp, Artificial
  CRISPR gRNA sequence
cagtaactctaccattctgc

SEQ ID NO: 25751 - DNA, 20 bp, Artificial
  CRISPR gRNA sequence
taccattctgccttgctctt

SEQ ID NO: 25752 - DNA, 20 bp, Artificial
  CRISPR gRNA sequence
ccattctgccttgctcttct

SEQ ID NO: 25753 - DNA, 20 bp, Artificial
  CRISPR gRNA sequence
tgccttgctcttctttgtag

SEQ ID NO: 25754 - DNA, 20 bp, Artificial
  CRISPR gRNA sequence
ccttgctcttctttgtagca

SEQ ID NO: 25755 - DNA, 20 bp, Artificial
  CRISPR gRNA sequence
gctcttctttgtagcagtag

SEQ ID NO: 25756 - DNA, 20 bp, Artificial
  CRISPR gRNA sequence
ctcttctttgtagcagtaga

SEQ ID NO: 25757 - DNA, 20 bp, Artificial
  CRISPR gRNA sequence
ttctttgtagcagtagataa

SEQ ID NO: 25758 - DNA, 20 bp, Artificial
  CRISPR gRNA sequence
ctttgtagcagtagataagt

SEQ ID NO: 25759 - DNA, 20 bp, Artificial
  CRISPR gRNA sequence
tttgtagcagtagataagtt

SEQ ID NO: 25760 - DNA, 20 bp, Artificial
  CRISPR gRNA sequence
tgtagcagtagataagtttt

SEQ ID NO: 25761 - DNA, 20 bp, Artificial
  CRISPR gRNA sequence
gtagcagtagataagttttc

SEQ ID NO: 25762 - DNA, 20 bp, Artificial
  CRISPR gRNA sequence
tagcagtagataagttttca

SEQ ID NO: 25763 - DNA, 20 bp, Artificial
  CRISPR gRNA sequence
tcatggatacatacctcatc

SEQ ID NO: 25764 - DNA, 20 bp, Artificial
  CRISPR gRNA sequence
catggatacatacctcatcc

SEQ ID NO: 25765 - DNA, 20 bp, Artificial
  CRISPR gRNA sequence
atggatacatacctcatcct

SEQ ID NO: 25766 - DNA, 20 bp, Artificial
  CRISPR gRNA sequence
atccttttgattagattaag

SEQ ID NO: 25767 - DNA, 20 bp, Artificial
  CRISPR gRNA sequence
ttgattagattaagggcccc

SEQ ID NO: 25768 - DNA, 20 bp, Artificial
  CRISPR gRNA sequence
tgattagattaagggcccct

SEQ ID NO: 25769 - DNA, 20 bp, Artificial
  CRISPR gRNA sequence
gattagattaagggcccctg

SEQ ID NO: 25770 - DNA, 20 bp, Artificial
  CRISPR gRNA sequence
attagattaagggcccctgg

SEQ ID NO: 25771 - DNA, 20 bp, Artificial
  CRISPR gRNA sequence
gattaagggcccctggagtg

SEQ ID NO: 25772 - DNA, 20 bp, Artificial
  CRISPR gRNA sequence
agggcccctggagtgtcagt

SEQ ID NO: 25773 - DNA, 20 bp, Artificial
  CRISPR gRNA sequence
gagtgtcagtgttcattcat

SEQ ID NO: 25774 - DNA, 20 bp, Artificial
  CRISPR gRNA sequence
attcatttgtttgatcattc

SEQ ID NO: 25775 - DNA, 20 bp, Artificial
  CRISPR gRNA sequence
atttgtttgatcattcattc

SEQ ID NO: 25776 - DNA, 20 bp, Artificial
  CRISPR gRNA sequence
gtttgatcattcattcattc

SEQ ID NO: 25777 - DNA, 20 bp, Artificial
  CRISPR gRNA sequence
tttgatcattcattcattca

SEQ ID NO: 25778 - DNA, 20 bp, Artificial
  CRISPR gRNA sequence
gatcattcattcattcaaca

SEQ ID NO: 25779 - DNA, 20 bp, Artificial
  CRISPR gRNA sequence
atcattcattcattcaacaa

SEQ ID NO: 25780 - DNA, 20 bp, Artificial
  CRISPR gRNA sequence
attcattcaacaaacatttc

SEQ ID NO: 25781 - DNA, 20 bp, Artificial
  CRISPR gRNA sequence
attcaacaaacatttcttga

SEQ ID NO: 25782 - DNA, 20 bp, Artificial
  CRISPR gRNA sequence
aacaaacatttcttgagtcc

SEQ ID NO: 25783 - DNA, 20 bp, Artificial
  CRISPR gRNA sequence
cttgagtccccactgtgtgc

SEQ ID NO: 25784 - DNA, 20 bp, Artificial
  CRISPR gRNA sequence
ttgagtccccactgtgtgcc

SEQ ID NO: 25785 - DNA, 20 bp, Artificial
  CRISPR gRNA sequence
gagtccccactgtgtgccag

SEQ ID NO: 25786 - DNA, 20 bp, Artificial
  CRISPR gRNA sequence
agtccccactgtgtgccagg

SEQ ID NO: 25787 - DNA, 20 bp, Artificial
  CRISPR gRNA sequence
tgtgccaggcccagaggttc

SEQ ID NO: 25788 - DNA, 20 bp, Artificial
  CRISPR gRNA sequence
cccagcccaaggcctggcac

SEQ ID NO: 25789 - DNA, 20 bp, Artificial
  CRISPR gRNA sequence
gcacacagtgggccttcagt

SEQ ID NO: 25790 - DNA, 20 bp, Artificial
  CRISPR gRNA sequence
cagttagaccttgttgattg

SEQ ID NO: 25791 - DNA, 20 bp, Artificial
  CRISPR gRNA sequence
agttagaccttgttgattga

SEQ ID NO: 25792 - DNA, 20 bp, Artificial
  CRISPR gRNA sequence
gaccttgttgattgactgcg

SEQ ID NO: 25793 - DNA, 20 bp, Artificial
  CRISPR gRNA sequence
gttgattgactgcgcttttc

SEQ ID NO: 25794 - DNA, 20 bp, Artificial
  CRISPR gRNA sequence
ttgattgactgcgcttttcc

SEQ ID NO: 25795 - DNA, 20 bp, Artificial
  CRISPR gRNA sequence
attgactgcgcttttccttg

SEQ ID NO: 25796 - DNA, 20 bp, Artificial
  CRISPR gRNA sequence
actgcgcttttccttgtctg

SEQ ID NO: 25797 - DNA, 20 bp, Artificial
  CRISPR gRNA sequence
cgcttttccttgtctgggca

SEQ ID NO: 25798 - DNA, 20 bp, Artificial
  CRISPR gRNA sequence
ttccttgtctgggcagcgga

SEQ ID NO: 25799 - DNA, 20 bp, Artificial
  CRISPR gRNA sequence
tccttgtctgggcagcggaa

SEQ ID NO: 25800 - DNA, 20 bp, Artificial
  CRISPR gRNA sequence
ccttgtctgggcagcggaac

SEQ ID NO: 25801 - DNA, 20 bp, Artificial
  CRISPR gRNA sequence
cttgtctgggcagcggaact

SEQ ID NO: 25802 - DNA, 20 bp, Artificial
  CRISPR gRNA sequence
gtctgggcagcggaactgga

SEQ ID NO: 25803 - DNA, 20 bp, Artificial
  CRISPR gRNA sequence
tctgggcagcggaactggac

SEQ ID NO: 25804 - DNA, 20 bp, Artificial
  CRISPR gRNA sequence
ggcagcggaactggaccagt

SEQ ID NO: 25805 - DNA, 20 bp, Artificial
  CRISPR gRNA sequence
gaccagtatgtcttccagga

SEQ ID NO: 25806 - DNA, 20 bp, Artificial
  CRISPR gRNA sequence
ccaggactcccagctggagg

SEQ ID NO: 25807 - DNA, 20 bp, Artificial
  CRISPR gRNA sequence
caggactcccagctggaggg

SEQ ID NO: 25808 - DNA, 20 bp, Artificial
  CRISPR gRNA sequence
ccagctggagggcctgagca

SEQ ID NO: 25809 - DNA, 20 bp, Artificial
  CRISPR gRNA sequence
gagggcctgagcaaggacat

SEQ ID NO: 25810 - DNA, 20 bp, Artificial
  CRISPR gRNA sequence
agcaaggacattttcagtaa

SEQ ID NO: 25811 - DNA, 20 bp, Artificial
  CRISPR gRNA sequence
tcagtaagtttgtggtgggt

SEQ ID NO: 25812 - DNA, 20 bp, Artificial
  CRISPR gRNA sequence
cagtaagtttgtggtgggtg

SEQ ID NO: 25813 - DNA, 20 bp, Artificial
  CRISPR gRNA sequence
agtaagtttgtggtgggtgg

SEQ ID NO: 25814 - DNA, 20 bp, Artificial
  CRISPR gRNA sequence
gtggtgggtggggaggtctt

SEQ ID NO: 25815 - DNA, 20 bp, Artificial
  CRISPR gRNA sequence
tggtgggtggggaggtcttg

SEQ ID NO: 25816 - DNA, 20 bp, Artificial
  CRISPR gRNA sequence
ggctcagcctgcatttcctg

SEQ ID NO: 25817 - DNA, 20 bp, Artificial
  CRISPR gRNA sequence
gctcagcctgcatttcctgc

SEQ ID NO: 25818 - DNA, 20 bp, Artificial
  CRISPR gRNA sequence
agcctgcatttcctgccttg

SEQ ID NO: 25819 - DNA, 20 bp, Artificial
  CRISPR gRNA sequence
catttcctgccttgttccct

SEQ ID NO: 25820 - DNA, 20 bp, Artificial
  CRISPR gRNA sequence
cctgccttgttccctggggg

SEQ ID NO: 25821 - DNA, 20 bp, Artificial
  CRISPR gRNA sequence
ctgccttgttccctgggggg

SEQ ID NO: 25822 - DNA, 20 bp, Artificial
  CRISPR gRNA sequence
ccttgttccctggggggtgc

SEQ ID NO: 25823 - DNA, 20 bp, Artificial
  CRISPR gRNA sequence
gttccctggggggtgcccta

SEQ ID NO: 25824 - DNA, 20 bp, Artificial
  CRISPR gRNA sequence
ttccctggggggtgccctaa

SEQ ID NO: 25825 - DNA, 20 bp, Artificial
  CRISPR gRNA sequence
cctggggggtgccctaatac

SEQ ID NO: 25826 - DNA, 20 bp, Artificial
  CRISPR gRNA sequence
gggggtgccctaatacctga

SEQ ID NO: 25827 - DNA, 20 bp, Artificial
  CRISPR gRNA sequence
atacctgacgaccattcatt

SEQ ID NO: 25828 - DNA, 20 bp, Artificial
  CRISPR gRNA sequence
acgaccattcattgatgggc

SEQ ID NO: 25829 - DNA, 20 bp, Artificial
  CRISPR gRNA sequence
attgatgggcagtcagaccc

SEQ ID NO: 25830 - DNA, 20 bp, Artificial
  CRISPR gRNA sequence
atgggcagtcagacccctct

SEQ ID NO: 25831 - DNA, 20 bp, Artificial
  CRISPR gRNA sequence
tccccaaggtgggtacaata

SEQ ID NO: 25832 - DNA, 20 bp, Artificial
  CRISPR gRNA sequence
cccaaggtgggtacaataga

SEQ ID NO: 25833 - DNA, 20 bp, Artificial
  CRISPR gRNA sequence
accttgggctttcattgatt

SEQ ID NO: 25834 - DNA, 20 bp, Artificial
  CRISPR gRNA sequence
gggctttcattgattgtgtg

SEQ ID NO: 25835 - DNA, 20 bp, Artificial
  CRISPR gRNA sequence
ggctttcattgattgtgtga

SEQ ID NO: 25836 - DNA, 20 bp, Artificial
  CRISPR gRNA sequence
tcattgattgtgtgagttgg

SEQ ID NO: 25837 - DNA, 20 bp, Artificial
  CRISPR gRNA sequence
cattgattgtgtgagttggt

SEQ ID NO: 25838 - DNA, 20 bp, Artificial
  CRISPR gRNA sequence
attgattgtgtgagttggtc

SEQ ID NO: 25839 - DNA, 20 bp, Artificial
  CRISPR gRNA sequence
attgtgtgagttggtctctg

SEQ ID NO: 25840 - DNA, 20 bp, Artificial
  CRISPR gRNA sequence
tgtgagttggtctctggttt

SEQ ID NO: 25841 - DNA, 20 bp, Artificial
  CRISPR gRNA sequence
gtctctggtttttctcaaag

SEQ ID NO: 25842 - DNA, 20 bp, Artificial
  CRISPR gRNA sequence
tggtttttctcaaagtagag

SEQ ID NO: 25843 - DNA, 20 bp, Artificial
  CRISPR gRNA sequence
gtttttctcaaagtagagca

SEQ ID NO: 25844 - DNA, 20 bp, Artificial
  CRISPR gRNA sequence
ttctcaaagtagagcacata

SEQ ID NO: 25845 - DNA, 20 bp, Artificial
  CRISPR gRNA sequence
tctcaaagtagagcacatag

SEQ ID NO: 25846 - DNA, 20 bp, Artificial
  CRISPR gRNA sequence
ctcaaagtagagcacatagg

SEQ ID NO: 25847 - DNA, 20 bp, Artificial
  CRISPR gRNA sequence
tcaaagtagagcacatagga

SEQ ID NO: 25848 - DNA, 20 bp, Artificial
  CRISPR gRNA sequence
aaagtagagcacataggacc

SEQ ID NO: 25849 - DNA, 20 bp, Artificial
  CRISPR gRNA sequence
ggcagaaaagtcagaaaaga

SEQ ID NO: 25850 - DNA, 20 bp, Artificial
  CRISPR gRNA sequence
cctgatccaacctagccttg

SEQ ID NO: 25851 - DNA, 20 bp, Artificial
  CRISPR gRNA sequence
atccaacctagccttgcttg

SEQ ID NO: 25852 - DNA, 20 bp, Artificial
  CRISPR gRNA sequence
gccttgcttgagacctggcc

SEQ ID NO: 25853 - DNA, 20 bp, Artificial
  CRISPR gRNA sequence
gcttgagacctggcctttcc

SEQ ID NO: 25854 - DNA, 20 bp, Artificial
  CRISPR gRNA sequence
cttgagacctggcctttcct

SEQ ID NO: 25855 - DNA, 20 bp, Artificial
  CRISPR gRNA sequence
gagacctggcctttccttga

SEQ ID NO: 25856 - DNA, 20 bp, Artificial
  CRISPR gRNA sequence
agacctggcctttccttgac

SEQ ID NO: 25857 - DNA, 20 bp, Artificial
  CRISPR gRNA sequence
gcctttccttgactccaaag

SEQ ID NO: 25858 - DNA, 20 bp, Artificial
  CRISPR gRNA sequence
tccttgactccaaagcctgc

SEQ ID NO: 25859 - DNA, 20 bp, Artificial
  CRISPR gRNA sequence
ccttgactccaaagcctgct

SEQ ID NO: 25860 - DNA, 20 bp, Artificial
  CRISPR gRNA sequence
cttgactccaaagcctgctg

SEQ ID NO: 25861 - DNA, 20 bp, Artificial
  CRISPR gRNA sequence
gactccaaagcctgctgtgg

SEQ ID NO: 25862 - DNA, 20 bp, Artificial
  CRISPR gRNA sequence
actccaaagcctgctgtggg

SEQ ID NO: 25863 - DNA, 20 bp, Artificial
  CRISPR gRNA sequence
caaagcctgctgtgggtcca

SEQ ID NO: 25864 - DNA, 20 bp, Artificial
  CRISPR gRNA sequence
ctgtgggtccaacttgcttc

SEQ ID NO: 25865 - DNA, 20 bp, Artificial
  CRISPR gRNA sequence
tgggtccaacttgcttccct

SEQ ID NO: 25866 - DNA, 20 bp, Artificial
  CRISPR gRNA sequence
gcttccctcgctaagtcctg

SEQ ID NO: 25867 - DNA, 20 bp, Artificial
  CRISPR gRNA sequence
cttccctcgctaagtcctgt

SEQ ID NO: 25868 - DNA, 20 bp, Artificial
  CRISPR gRNA sequence
ccctcgctaagtcctgtctg

SEQ ID NO: 25869 - DNA, 20 bp, Artificial
  CRISPR gRNA sequence
cctcgctaagtcctgtctgg

SEQ ID NO: 25870 - DNA, 20 bp, Artificial
  CRISPR gRNA sequence
gctaagtcctgtctggttgg

SEQ ID NO: 25871 - DNA, 20 bp, Artificial
  CRISPR gRNA sequence
agtcctgtctggttgggagg

SEQ ID NO: 25872 - DNA, 20 bp, Artificial
  CRISPR gRNA sequence
tctggttgggaggcccttta

SEQ ID NO: 25873 - DNA, 20 bp, Artificial
  CRISPR gRNA sequence
gttgggaggccctttaaaag

SEQ ID NO: 25874 - DNA, 20 bp, Artificial
  CRISPR gRNA sequence
ggaggccctttaaaagccaa

SEQ ID NO: 25875 - DNA, 20 bp, Artificial
  CRISPR gRNA sequence
taaaagccaacaggagcctt

SEQ ID NO: 25876 - DNA, 20 bp, Artificial
  CRISPR gRNA sequence
aaaagccaacaggagcctta

SEQ ID NO: 25877 - DNA, 20 bp, Artificial
  CRISPR gRNA sequence
aaagccaacaggagccttaa

SEQ ID NO: 25878 - DNA, 20 bp, Artificial
  CRISPR gRNA sequence
aaaatgtacatctgattatt

SEQ ID NO: 25879 - DNA, 20 bp, Artificial
  CRISPR gRNA sequence
aaatgtacatctgattattt

SEQ ID NO: 25880 - DNA, 20 bp, Artificial
  CRISPR gRNA sequence
attatttcatggccctgata

SEQ ID NO: 25881 - DNA, 20 bp, Artificial
  CRISPR gRNA sequence
tttcatggccctgataaccc

SEQ ID NO: 25882 - DNA, 20 bp, Artificial
  CRISPR gRNA sequence
catggccctgataaccctcc

SEQ ID NO: 25883 - DNA, 20 bp, Artificial
  CRISPR gRNA sequence
atggccctgataaccctcca

SEQ ID NO: 25884 - DNA, 20 bp, Artificial
  CRISPR gRNA sequence
ataaccctccaatggctaca

SEQ ID NO: 25885 - DNA, 20 bp, Artificial
  CRISPR gRNA sequence
caatggctacaaaatacatg

SEQ ID NO: 25886 - DNA, 20 bp, Artificial
  CRISPR gRNA sequence
caaaatacatgccacaaggc

SEQ ID NO: 25887 - DNA, 20 bp, Artificial
  CRISPR gRNA sequence
tatggcccttcctccctctc

SEQ ID NO: 25888 - DNA, 20 bp, Artificial
  CRISPR gRNA sequence
cctccctctccaaacccact

SEQ ID NO: 25889 - DNA, 20 bp, Artificial
  CRISPR gRNA sequence
ctccctctccaaacccacta

SEQ ID NO: 25890 - DNA, 20 bp, Artificial
  CRISPR gRNA sequence
cctctccaaacccactatga

SEQ ID NO: 25891 - DNA, 20 bp, Artificial
  CRISPR gRNA sequence
tccaaacccactatgagaca

SEQ ID NO: 25892 - DNA, 20 bp, Artificial
  CRISPR gRNA sequence
caaacccactatgagacacc

SEQ ID NO: 25893 - DNA, 20 bp, Artificial
  CRISPR gRNA sequence
tgagacaccacacttcagcc

SEQ ID NO: 25894 - DNA, 20 bp, Artificial
  CRISPR gRNA sequence
cagccaccaccagcttctcc

SEQ ID NO: 25895 - DNA, 20 bp, Artificial
  CRISPR gRNA sequence
agccaccaccagcttctcca

SEQ ID NO: 25896 - DNA, 20 bp, Artificial
  CRISPR gRNA sequence
ctccactcctataacccatg

SEQ ID NO: 25897 - DNA, 20 bp, Artificial
  CRISPR gRNA sequence
tccactcctataacccatgt

SEQ ID NO: 25898 - DNA, 20 bp, Artificial
  CRISPR gRNA sequence
cactcctataacccatgtgc

SEQ ID NO: 25899 - DNA, 20 bp, Artificial
  CRISPR gRNA sequence
ctataacccatgtgcccttt

SEQ ID NO: 25900 - DNA, 20 bp, Artificial
  CRISPR gRNA sequence
taacccatgtgccctttcaa

SEQ ID NO: 25901 - DNA, 20 bp, Artificial
  CRISPR gRNA sequence
tcaagcctcggggcctttgc

SEQ ID NO: 25902 - DNA, 20 bp, Artificial
  CRISPR gRNA sequence
caagcctcggggcctttgca

SEQ ID NO: 25903 - DNA, 20 bp, Artificial
  CRISPR gRNA sequence
aagcctcggggcctttgcag

SEQ ID NO: 25904 - DNA, 20 bp, Artificial
  CRISPR gRNA sequence
ggggcctttgcagttgctat

SEQ ID NO: 25905 - DNA, 20 bp, Artificial
  CRISPR gRNA sequence
tgcagttgctatagtctcta

SEQ ID NO: 25906 - DNA, 20 bp, Artificial
  CRISPR gRNA sequence
gcagttgctatagtctctat

SEQ ID NO: 25907 - DNA, 20 bp, Artificial
  CRISPR gRNA sequence
cagttgctatagtctctatc

SEQ ID NO: 25908 - DNA, 20 bp, Artificial
  CRISPR gRNA sequence
ctatagtctctatctggaat

SEQ ID NO: 25909 - DNA, 20 bp, Artificial
  CRISPR gRNA sequence
tagtctctatctggaatgcc

SEQ ID NO: 25910 - DNA, 20 bp, Artificial
  CRISPR gRNA sequence
tatctggaatgcccttcccc

SEQ ID NO: 25911 - DNA, 20 bp, Artificial
  CRISPR gRNA sequence
tctggaatgcccttccccca

SEQ ID NO: 25912 - DNA, 20 bp, Artificial
  CRISPR gRNA sequence
gaatgcccttcccccagttc

SEQ ID NO: 25913 - DNA, 20 bp, Artificial
  CRISPR gRNA sequence
cccccagttcttcccatggc

SEQ ID NO: 25914 - DNA, 20 bp, Artificial
  CRISPR gRNA sequence
ccccagttcttcccatggct

SEQ ID NO: 25915 - DNA, 20 bp, Artificial
  CRISPR gRNA sequence
ttcccatggctgactccttt

SEQ ID NO: 25916 - DNA, 20 bp, Artificial
  CRISPR gRNA sequence
cccatggctgactcctttga

SEQ ID NO: 25917 - DNA, 20 bp, Artificial
  CRISPR gRNA sequence
ccatggctgactcctttgaa

SEQ ID NO: 25918 - DNA, 20 bp, Artificial
  CRISPR gRNA sequence
actcctttgaatctttctgg

SEQ ID NO: 25919 - DNA, 20 bp, Artificial
  CRISPR gRNA sequence
ctttgaatctttctggtgtt

SEQ ID NO: 25920 - DNA, 20 bp, Artificial
  CRISPR gRNA sequence
tgaatctttctggtgttggc

SEQ ID NO: 25921 - DNA, 20 bp, Artificial
  CRISPR gRNA sequence
gaatctttctggtgttggct

SEQ ID NO: 25922 - DNA, 20 bp, Artificial
  CRISPR gRNA sequence
aatctttctggtgttggcta

SEQ ID NO: 25923 - DNA, 20 bp, Artificial
  CRISPR gRNA sequence
tctggtgttggctaaactgt

SEQ ID NO: 25924 - DNA, 20 bp, Artificial
  CRISPR gRNA sequence
ctggtgttggctaaactgtc

SEQ ID NO: 25925 - DNA, 20 bp, Artificial
  CRISPR gRNA sequence
tggtgttggctaaactgtca

SEQ ID NO: 25926 - DNA, 20 bp, Artificial
  CRISPR gRNA sequence
gtgttggctaaactgtcacc

SEQ ID NO: 25927 - DNA, 20 bp, Artificial
  CRISPR gRNA sequence
gctaaactgtcacctcttcc

SEQ ID NO: 25928 - DNA, 20 bp, Artificial
  CRISPR gRNA sequence
aactgtcacctcttcctgga

SEQ ID NO: 25929 - DNA, 20 bp, Artificial
  CRISPR gRNA sequence
tcacctcttcctggaaccct

SEQ ID NO: 25930 - DNA, 20 bp, Artificial
  CRISPR gRNA sequence
ttcctggaacccttctctga

SEQ ID NO: 25931 - DNA, 20 bp, Artificial
  CRISPR gRNA sequence
cctggaacccttctctgacc

SEQ ID NO: 25932 - DNA, 20 bp, Artificial
  CRISPR gRNA sequence
ctggaacccttctctgacca

SEQ ID NO: 25933 - DNA, 20 bp, Artificial
  CRISPR gRNA sequence
gaacccttctctgaccatcc

SEQ ID NO: 25934 - DNA, 20 bp, Artificial
  CRISPR gRNA sequence
ctctgaccatccttccatgt

SEQ ID NO: 25935 - DNA, 20 bp, Artificial
  CRISPR gRNA sequence
tctgaccatccttccatgta

SEQ ID NO: 25936 - DNA, 20 bp, Artificial
  CRISPR gRNA sequence
tgaccatccttccatgtaga

SEQ ID NO: 25937 - DNA, 20 bp, Artificial
  CRISPR gRNA sequence
accatccttccatgtagatt

SEQ ID NO: 25938 - DNA, 20 bp, Artificial
  CRISPR gRNA sequence
ccatgtagattagctcagtt

SEQ ID NO: 25939 - DNA, 20 bp, Artificial
  CRISPR gRNA sequence
catgtagattagctcagtta

SEQ ID NO: 25940 - DNA, 20 bp, Artificial
  CRISPR gRNA sequence
gctcagttattctcaccttg

SEQ ID NO: 25941 - DNA, 20 bp, Artificial
  CRISPR gRNA sequence
agttattctcaccttgtgtg

SEQ ID NO: 25942 - DNA, 20 bp, Artificial
  CRISPR gRNA sequence
ttctcaccttgtgtgtcttt

SEQ ID NO: 25943 - DNA, 20 bp, Artificial
  CRISPR gRNA sequence
tcaccttgtgtgtctttttc

SEQ ID NO: 25944 - DNA, 20 bp, Artificial
  CRISPR gRNA sequence
accttgtgtgtctttttcct

SEQ ID NO: 25945 - DNA, 20 bp, Artificial
  CRISPR gRNA sequence
gtgtgtctttttccttgcag

SEQ ID NO: 25946 - DNA, 20 bp, Artificial
  CRISPR gRNA sequence
tgtgtctttttccttgcagt

SEQ ID NO: 25947 - DNA, 20 bp, Artificial
  CRISPR gRNA sequence
tttccttgcagtttagcact

SEQ ID NO: 25948 - DNA, 20 bp, Artificial
  CRISPR gRNA sequence
ttccttgcagtttagcactc

SEQ ID NO: 25949 - DNA, 20 bp, Artificial
  CRISPR gRNA sequence
tccttgcagtttagcactca

SEQ ID NO: 25950 - DNA, 20 bp, Artificial
  CRISPR gRNA sequence
ccttgcagtttagcactcat

SEQ ID NO: 25951 - DNA, 20 bp, Artificial
  CRISPR gRNA sequence
cttgcagtttagcactcatt

SEQ ID NO: 25952 - DNA, 20 bp, Artificial
  CRISPR gRNA sequence
gcagtttagcactcattacc

SEQ ID NO: 25953 - DNA, 20 bp, Artificial
  CRISPR gRNA sequence
cagtttagcactcattacca

SEQ ID NO: 25954 - DNA, 20 bp, Artificial
  CRISPR gRNA sequence
agcactcattaccatctgga

SEQ ID NO: 25955 - DNA, 20 bp, Artificial
  CRISPR gRNA sequence
gcactcattaccatctggac

SEQ ID NO: 25956 - DNA, 20 bp, Artificial
  CRISPR gRNA sequence
attaccatctggacatattt

SEQ ID NO: 25957 - DNA, 20 bp, Artificial
  CRISPR gRNA sequence
ccatctggacatattttacg

SEQ ID NO: 25958 - DNA, 20 bp, Artificial
  CRISPR gRNA sequence
gacatattttacgccttgct

SEQ ID NO: 25959 - DNA, 20 bp, Artificial
  CRISPR gRNA sequence
tacgccttgctctcccactg

SEQ ID NO: 25960 - DNA, 20 bp, Artificial
  CRISPR gRNA sequence
acgccttgctctcccactgt

SEQ ID NO: 25961 - DNA, 20 bp, Artificial
  CRISPR gRNA sequence
cgccttgctctcccactgtg

SEQ ID NO: 25962 - DNA, 20 bp, Artificial
  CRISPR gRNA sequence
gctctcccactgtgaggaca

SEQ ID NO: 25963 - DNA, 20 bp, Artificial
  CRISPR gRNA sequence
ctctcccactgtgaggacag

SEQ ID NO: 25964 - DNA, 20 bp, Artificial
  CRISPR gRNA sequence
tcccactgtgaggacaggga

SEQ ID NO: 25965 - DNA, 20 bp, Artificial
  CRISPR gRNA sequence
ccactgtgaggacagggacc

SEQ ID NO: 25966 - DNA, 20 bp, Artificial
  CRISPR gRNA sequence
tgaggacagggaccttgtct

SEQ ID NO: 25967 - DNA, 20 bp, Artificial
  CRISPR gRNA sequence
gtctttcttgctcgtgactg

SEQ ID NO: 25968 - DNA, 20 bp, Artificial
  CRISPR gRNA sequence
tctttcttgctcgtgactgt

SEQ ID NO: 25969 - DNA, 20 bp, Artificial
  CRISPR gRNA sequence
tcttgctcgtgactgtttcc

SEQ ID NO: 25970 - DNA, 20 bp, Artificial
  CRISPR gRNA sequence
cttgctcgtgactgtttccc

SEQ ID NO: 25971 - DNA, 20 bp, Artificial
  CRISPR gRNA sequence
ttgctcgtgactgtttcccc

SEQ ID NO: 25972 - DNA, 20 bp, Artificial
  CRISPR gRNA sequence
gctcgtgactgtttccccag

SEQ ID NO: 25973 - DNA, 20 bp, Artificial
  CRISPR gRNA sequence
ctcgtgactgtttccccagc

SEQ ID NO: 25974 - DNA, 20 bp, Artificial
  CRISPR gRNA sequence
gtgactgtttccccagcatc

SEQ ID NO: 25975 - DNA, 20 bp, Artificial
  CRISPR gRNA sequence
tttccccagcatctagtgca

SEQ ID NO: 25976 - DNA, 20 bp, Artificial
  CRISPR gRNA sequence
ccccagcatctagtgcagtg

SEQ ID NO: 25977 - DNA, 20 bp, Artificial
  CRISPR gRNA sequence
cccagcatctagtgcagtgc

SEQ ID NO: 25978 - DNA, 20 bp, Artificial
  CRISPR gRNA sequence
gtgcagtgcctggtatgcag

SEQ ID NO: 25979 - DNA, 20 bp, Artificial
  CRISPR gRNA sequence
gtatgcagtagcacctcagt

SEQ ID NO: 25980 - DNA, 20 bp, Artificial
  CRISPR gRNA sequence
agtagatatctgttgaatga

SEQ ID NO: 25981 - DNA, 20 bp, Artificial
  CRISPR gRNA sequence
ttgaatgaaaacatctgtaa

SEQ ID NO: 25982 - DNA, 20 bp, Artificial
  CRISPR gRNA sequence
aatgaaaacatctgtaaaat

SEQ ID NO: 25983 - DNA, 20 bp, Artificial
  CRISPR gRNA sequence
taaaatgggtgtaacagtta

SEQ ID NO: 25984 - DNA, 20 bp, Artificial
  CRISPR gRNA sequence
actgagtacttattatgggt

SEQ ID NO: 25985 - DNA, 20 bp, Artificial
  CRISPR gRNA sequence
agtacttattatgggtctga

SEQ ID NO: 25986 - DNA, 20 bp, Artificial
  CRISPR gRNA sequence
attatgggtctgaccatgtg

SEQ ID NO: 25987 - DNA, 20 bp, Artificial
  CRISPR gRNA sequence
ttatgggtctgaccatgtgt

SEQ ID NO: 25988 - DNA, 20 bp, Artificial
  CRISPR gRNA sequence
tgggtctgaccatgtgtaag

SEQ ID NO: 25989 - DNA, 20 bp, Artificial
  CRISPR gRNA sequence
accatgtgtaagtcctgtat

SEQ ID NO: 25990 - DNA, 20 bp, Artificial
  CRISPR gRNA sequence
tatctatttattcagttctt

SEQ ID NO: 25991 - DNA, 20 bp, Artificial
  CRISPR gRNA sequence
tttattcagttcttaaacag

SEQ ID NO: 25992 - DNA, 20 bp, Artificial
  CRISPR gRNA sequence
attcagttcttaaacaggtg

SEQ ID NO: 25993 - DNA, 20 bp, Artificial
  CRISPR gRNA sequence
ttcagttcttaaacaggtga

SEQ ID NO: 25994 - DNA, 20 bp, Artificial
  CRISPR gRNA sequence
agttcttaaacaggtgaatc

SEQ ID NO: 25995 - DNA, 20 bp, Artificial
  CRISPR gRNA sequence
ttaaacaggtgaatcgcaca

SEQ ID NO: 25996 - DNA, 20 bp, Artificial
  CRISPR gRNA sequence
aaacaggtgaatcgcacaca

SEQ ID NO: 25997 - DNA, 20 bp, Artificial
  CRISPR gRNA sequence
aacaggtgaatcgcacacag

SEQ ID NO: 25998 - DNA, 20 bp, Artificial
  CRISPR gRNA sequence
taaaagtgcaaagaatattc

SEQ ID NO: 25999 - DNA, 20 bp, Artificial
  CRISPR gRNA sequence
aaaagtgcaaagaatattca

SEQ ID NO: 26000 - DNA, 20 bp, Artificial
  CRISPR gRNA sequence
aaagtgcaaagaatattcag

SEQ ID NO: 26001 - DNA, 20 bp, Artificial
  CRISPR gRNA sequence
agtgaaggctgggcgcagcg

SEQ ID NO: 26002 - DNA, 20 bp, Artificial
  CRISPR gRNA sequence
ggcgcagcggctcacacctg

SEQ ID NO: 26003 - DNA, 20 bp, Artificial
  CRISPR gRNA sequence
acacctgtaatcccagcagt

SEQ ID NO: 26004 - DNA, 20 bp, Artificial
  CRISPR gRNA sequence
taatcccagcagtttgggag

SEQ ID NO: 26005 - DNA, 20 bp, Artificial
  CRISPR gRNA sequence
gggaggccaagggggacgga

SEQ ID NO: 26006 - DNA, 20 bp, Artificial
  CRISPR gRNA sequence
ggaggccaagggggacggat

SEQ ID NO: 26007 - DNA, 20 bp, Artificial
  CRISPR gRNA sequence
gaggtcaggagtttgatacc

SEQ ID NO: 26008 - DNA, 20 bp, Artificial
  CRISPR gRNA sequence
aggtcaggagtttgatacct

SEQ ID NO: 26009 - DNA, 20 bp, Artificial
  CRISPR gRNA sequence
gatacctgcctggccaacat

SEQ ID NO: 26010 - DNA, 20 bp, Artificial
  CRISPR gRNA sequence
atacctgcctggccaacatg

SEQ ID NO: 26011 - DNA, 20 bp, Artificial
  CRISPR gRNA sequence
cctggccaacatggtgaaac

SEQ ID NO: 26012 - DNA, 20 bp, Artificial
  CRISPR gRNA sequence
gccaacatggtgaaaccgcg

SEQ ID NO: 26013 - DNA, 20 bp, Artificial
  CRISPR gRNA sequence
taccaaaaaatacaaaaatt

SEQ ID NO: 26014 - DNA, 20 bp, Artificial
  CRISPR gRNA sequence
ccaaaaaatacaaaaattag

SEQ ID NO: 26015 - DNA, 20 bp, Artificial
  CRISPR gRNA sequence
gccgggtgtggtggtgcacg

SEQ ID NO: 26016 - DNA, 20 bp, Artificial
  CRISPR gRNA sequence
taatcccagctactcgggag

SEQ ID NO: 26017 - DNA, 20 bp, Artificial
  CRISPR gRNA sequence
ctcgggaggctgaggcagga

SEQ ID NO: 26018 - DNA, 20 bp, Artificial
  CRISPR gRNA sequence
gggaggctgaggcaggagaa

SEQ ID NO: 26019 - DNA, 20 bp, Artificial
  CRISPR gRNA sequence
aggcaggagaatcgcttgaa

SEQ ID NO: 26020 - DNA, 20 bp, Artificial
  CRISPR gRNA sequence
gaacccaggaggtggaggtt

SEQ ID NO: 26021 - DNA, 20 bp, Artificial
  CRISPR gRNA sequence
aacccaggaggtggaggttg

SEQ ID NO: 26022 - DNA, 20 bp, Artificial
  CRISPR gRNA sequence
cagtgagctaagatcacgcc

SEQ ID NO: 26023 - DNA, 20 bp, Artificial
  CRISPR gRNA sequence
agatcacgccactgcactcc

SEQ ID NO: 26024 - DNA, 20 bp, Artificial
  CRISPR gRNA sequence
cactccagcctgggtggcag

SEQ ID NO: 26025 - DNA, 20 bp, Artificial
  CRISPR gRNA sequence
cagcctgggtggcagagtaa

SEQ ID NO: 26026 - DNA, 20 bp, Artificial
  CRISPR gRNA sequence
ggtggcagagtaagactctg

SEQ ID NO: 26027 - DNA, 20 bp, Artificial
  CRISPR gRNA sequence
tgtctcaaacaacaacaacc

SEQ ID NO: 26028 - DNA, 20 bp, Artificial
  CRISPR gRNA sequence
tctcaaacaacaacaaccaa

SEQ ID NO: 26029 - DNA, 20 bp, Artificial
  CRISPR gRNA sequence
aaacaacaacaaccaaaaga

SEQ ID NO: 26030 - DNA, 20 bp, Artificial
  CRISPR gRNA sequence
agtgaaaaaaaaatctccct

SEQ ID NO: 26031 - DNA, 20 bp, Artificial
  CRISPR gRNA sequence
cctcccactcctgttctgta

SEQ ID NO: 26032 - DNA, 20 bp, Artificial
  CRISPR gRNA sequence
ccactcctgttctgtagtcc

SEQ ID NO: 26033 - DNA, 20 bp, Artificial
  CRISPR gRNA sequence
ctgttctgtagtccctcagt

SEQ ID NO: 26034 - DNA, 20 bp, Artificial
  CRISPR gRNA sequence
ttctgtagtccctcagtttt

SEQ ID NO: 26035 - DNA, 20 bp, Artificial
  CRISPR gRNA sequence
tgtagtccctcagttttgct

SEQ ID NO: 26036 - DNA, 20 bp, Artificial
  CRISPR gRNA sequence
tagtccctcagttttgctcc

SEQ ID NO: 26037 - DNA, 20 bp, Artificial
  CRISPR gRNA sequence
agttttgctcctatcttagt

SEQ ID NO: 26038 - DNA, 20 bp, Artificial
  CRISPR gRNA sequence
tgctcctatcttagtcaacc

SEQ ID NO: 26039 - DNA, 20 bp, Artificial
  CRISPR gRNA sequence
gctcctatcttagtcaacct

SEQ ID NO: 26040 - DNA, 20 bp, Artificial
  CRISPR gRNA sequence
ctcctatcttagtcaaccta

SEQ ID NO: 26041 - DNA, 20 bp, Artificial
  CRISPR gRNA sequence
ctatcttagtcaacctatgt

SEQ ID NO: 26042 - DNA, 20 bp, Artificial
  CRISPR gRNA sequence
tcttagtcaacctatgtgac

SEQ ID NO: 26043 - DNA, 20 bp, Artificial
  CRISPR gRNA sequence
agtcaacctatgtgaccagc

SEQ ID NO: 26044 - DNA, 20 bp, Artificial
  CRISPR gRNA sequence
gtcaacctatgtgaccagct

SEQ ID NO: 26045 - DNA, 20 bp, Artificial
  CRISPR gRNA sequence
tgtgaccagcttcctttttg

SEQ ID NO: 26046 - DNA, 20 bp, Artificial
  CRISPR gRNA sequence
cctttttgccttgtcagaaa

SEQ ID NO: 26047 - DNA, 20 bp, Artificial
  CRISPR gRNA sequence
ctttttgccttgtcagaaat

SEQ ID NO: 26048 - DNA, 20 bp, Artificial
  CRISPR gRNA sequence
tttgccttgtcagaaataaa

SEQ ID NO: 26049 - DNA, 20 bp, Artificial
  CRISPR gRNA sequence
ttgccttgtcagaaataaag

SEQ ID NO: 26050 - DNA, 20 bp, Artificial
  CRISPR gRNA sequence
tgccttgtcagaaataaagc

SEQ ID NO: 26051 - DNA, 20 bp, Artificial
  CRISPR gRNA sequence
gccttgtcagaaataaagcg

SEQ ID NO: 26052 - DNA, 20 bp, Artificial
  CRISPR gRNA sequence
ccttgtcagaaataaagcga

SEQ ID NO: 26053 - DNA, 20 bp, Artificial
  CRISPR gRNA sequence
gtcagaaataaagcgagctc

SEQ ID NO: 26054 - DNA, 20 bp, Artificial
  CRISPR gRNA sequence
tcagaaataaagcgagctcc

SEQ ID NO: 26055 - DNA, 20 bp, Artificial
  CRISPR gRNA sequence
ctgtatttgctttaattttc

SEQ ID NO: 26056 - DNA, 20 bp, Artificial
  CRISPR gRNA sequence
tatttgctttaattttccat

SEQ ID NO: 26057 - DNA, 20 bp, Artificial
  CRISPR gRNA sequence
gctttaattttccatgcaaa

SEQ ID NO: 26058 - DNA, 20 bp, Artificial
  CRISPR gRNA sequence
ctttaattttccatgcaaat

SEQ ID NO: 26059 - DNA, 20 bp, Artificial
  CRISPR gRNA sequence
taattttccatgcaaatgac

SEQ ID NO: 26060 - DNA, 20 bp, Artificial
  CRISPR gRNA sequence
aattttccatgcaaatgacc

SEQ ID NO: 26061 - DNA, 20 bp, Artificial
  CRISPR gRNA sequence
attttccatgcaaatgacca

SEQ ID NO: 26062 - DNA, 20 bp, Artificial
  CRISPR gRNA sequence
tccatgcaaatgaccacatt

SEQ ID NO: 26063 - DNA, 20 bp, Artificial
  CRISPR gRNA sequence
ccatgcaaatgaccacattt

SEQ ID NO: 26064 - DNA, 20 bp, Artificial
  CRISPR gRNA sequence
catgcaaatgaccacatttt

SEQ ID NO: 26065 - DNA, 20 bp, Artificial
  CRISPR gRNA sequence
tatttacactattctgcatt

SEQ ID NO: 26066 - DNA, 20 bp, Artificial
  CRISPR gRNA sequence
atttacactattctgcattt

SEQ ID NO: 26067 - DNA, 20 bp, Artificial
  CRISPR gRNA sequence
tttacactattctgcatttt

SEQ ID NO: 26068 - DNA, 20 bp, Artificial
  CRISPR gRNA sequence
acactattctgcattttgct

SEQ ID NO: 26069 - DNA, 20 bp, Artificial
  CRISPR gRNA sequence
cactattctgcattttgctt

SEQ ID NO: 26070 - DNA, 20 bp, Artificial
  CRISPR gRNA sequence
ttctgcattttgctttcttc

SEQ ID NO: 26071 - DNA, 20 bp, Artificial
  CRISPR gRNA sequence
tgcattttgctttcttcatt

SEQ ID NO: 26072 - DNA, 20 bp, Artificial
  CRISPR gRNA sequence
cattttgctttcttcattta

SEQ ID NO: 26073 - DNA, 20 bp, Artificial
  CRISPR gRNA sequence
tgctttcttcatttacttca

SEQ ID NO: 26074 - DNA, 20 bp, Artificial
  CRISPR gRNA sequence
gctttcttcatttacttcat

SEQ ID NO: 26075 - DNA, 20 bp, Artificial
  CRISPR gRNA sequence
ctttcttcatttacttcatt

SEQ ID NO: 26076 - DNA, 20 bp, Artificial
  CRISPR gRNA sequence
tcttcatttacttcattact

SEQ ID NO: 26077 - DNA, 20 bp, Artificial
  CRISPR gRNA sequence
cttcatttacttcattactc

SEQ ID NO: 26078 - DNA, 20 bp, Artificial
  CRISPR gRNA sequence
ttcatttacttcattactcc

SEQ ID NO: 26079 - DNA, 20 bp, Artificial
  CRISPR gRNA sequence
catttacttcattactccct

SEQ ID NO: 26080 - DNA, 20 bp, Artificial
  CRISPR gRNA sequence
atttacttcattactccctg

SEQ ID NO: 26081 - DNA, 20 bp, Artificial
  CRISPR gRNA sequence
acttcattactccctgtctg

SEQ ID NO: 26082 - DNA, 20 bp, Artificial
  CRISPR gRNA sequence
cttcattactccctgtctgg

SEQ ID NO: 26083 - DNA, 20 bp, Artificial
  CRISPR gRNA sequence
cattactccctgtctgggag

SEQ ID NO: 26084 - DNA, 20 bp, Artificial
  CRISPR gRNA sequence
attactccctgtctgggagg

SEQ ID NO: 26085 - DNA, 20 bp, Artificial
  CRISPR gRNA sequence
ctccctgtctgggaggtcac

SEQ ID NO: 26086 - DNA, 20 bp, Artificial
  CRISPR gRNA sequence
cctgtctgggaggtcacgtt

SEQ ID NO: 26087 - DNA, 20 bp, Artificial
  CRISPR gRNA sequence
tctgggaggtcacgttccat

SEQ ID NO: 26088 - DNA, 20 bp, Artificial
  CRISPR gRNA sequence
ggaggtcacgttccatatta

SEQ ID NO: 26089 - DNA, 20 bp, Artificial
  CRISPR gRNA sequence
catattattgagggagagga

SEQ ID NO: 26090 - DNA, 20 bp, Artificial
  CRISPR gRNA sequence
ttgagggagaggacacggtc

SEQ ID NO: 26091 - DNA, 20 bp, Artificial
  CRISPR gRNA sequence
agggagaggacacggtccta

SEQ ID NO: 26092 - DNA, 20 bp, Artificial
  CRISPR gRNA sequence
tcttcagcagcttctttatt

SEQ ID NO: 26093 - DNA, 20 bp, Artificial
  CRISPR gRNA sequence
cagcagcttctttattttct

SEQ ID NO: 26094 - DNA, 20 bp, Artificial
  CRISPR gRNA sequence
agcagcttctttattttctt

SEQ ID NO: 26095 - DNA, 20 bp, Artificial
  CRISPR gRNA sequence
ctttattttctttcttttct

SEQ ID NO: 26096 - DNA, 20 bp, Artificial
  CRISPR gRNA sequence
tttattttctttcttttctt

SEQ ID NO: 26097 - DNA, 20 bp, Artificial
  CRISPR gRNA sequence
tattttctttcttttcttgt

SEQ ID NO: 26098 - DNA, 20 bp, Artificial
  CRISPR gRNA sequence
attttctttcttttcttgtt

SEQ ID NO: 26099 - DNA, 20 bp, Artificial
  CRISPR gRNA sequence
ttttctttcttttcttgttt

SEQ ID NO: 26100 - DNA, 20 bp, Artificial
  CRISPR gRNA sequence
tctttcttttcttgtttttc

SEQ ID NO: 26101 - DNA, 20 bp, Artificial
  CRISPR gRNA sequence
ctttcttttcttgtttttct

SEQ ID NO: 26102 - DNA, 20 bp, Artificial
  CRISPR gRNA sequence
tttcttttcttgtttttctt

SEQ ID NO: 26103 - DNA, 20 bp, Artificial
  CRISPR gRNA sequence
tcttttcttgtttttcttct

SEQ ID NO: 26104 - DNA, 20 bp, Artificial
  CRISPR gRNA sequence
cttttcttgtttttcttctt

SEQ ID NO: 26105 - DNA, 20 bp, Artificial
  CRISPR gRNA sequence
ttttcttgtttttcttcttt

SEQ ID NO: 26106 - DNA, 20 bp, Artificial
  CRISPR gRNA sequence
ttcttgtttttcttctttat

SEQ ID NO: 26107 - DNA, 20 bp, Artificial
  CRISPR gRNA sequence
tcttgtttttcttctttatg

SEQ ID NO: 26108 - DNA, 20 bp, Artificial
  CRISPR gRNA sequence
cttgtttttcttctttatgt

SEQ ID NO: 26109 - DNA, 20 bp, Artificial
  CRISPR gRNA sequence
ttgtttttcttctttatgtt

SEQ ID NO: 26110 - DNA, 20 bp, Artificial
  CRISPR gRNA sequence
gtttttcttctttatgtttt

SEQ ID NO: 26111 - DNA, 20 bp, Artificial
  CRISPR gRNA sequence
tttttcttctttatgttttc

SEQ ID NO: 26112 - DNA, 20 bp, Artificial
  CRISPR gRNA sequence
ttcttctttatgttttcatt

SEQ ID NO: 26113 - DNA, 20 bp, Artificial
  CRISPR gRNA sequence
tcttctttatgttttcattt

SEQ ID NO: 26114 - DNA, 20 bp, Artificial
  CRISPR gRNA sequence
cttctttatgttttcatttg

SEQ ID NO: 26115 - DNA, 20 bp, Artificial
  CRISPR gRNA sequence
ttctttatgttttcatttga

SEQ ID NO: 26116 - DNA, 20 bp, Artificial
  CRISPR gRNA sequence
ctttatgttttcatttgata

SEQ ID NO: 26117 - DNA, 20 bp, Artificial
  CRISPR gRNA sequence
tttatgttttcatttgataa

SEQ ID NO: 26118 - DNA, 20 bp, Artificial
  CRISPR gRNA sequence
tatgttttcatttgataaat

SEQ ID NO: 26119 - DNA, 20 bp, Artificial
  CRISPR gRNA sequence
atgttttcatttgataaata

SEQ ID NO: 26120 - DNA, 20 bp, Artificial
  CRISPR gRNA sequence
tgttttcatttgataaatat

SEQ ID NO: 26121 - DNA, 20 bp, Artificial
  CRISPR gRNA sequence
tcatttgataaatatttccc

SEQ ID NO: 26122 - DNA, 20 bp, Artificial
  CRISPR gRNA sequence
catttgataaatatttcccc

SEQ ID NO: 26123 - DNA, 20 bp, Artificial
  CRISPR gRNA sequence
atttgataaatatttccccc

SEQ ID NO: 26124 - DNA, 20 bp, Artificial
  CRISPR gRNA sequence
gataaatatttccccccaag

SEQ ID NO: 26125 - DNA, 20 bp, Artificial
  CRISPR gRNA sequence
ataaatatttccccccaaga

SEQ ID NO: 26126 - DNA, 20 bp, Artificial
  CRISPR gRNA sequence
ccccccaagattttattgtg

SEQ ID NO: 26127 - DNA, 20 bp, Artificial
  CRISPR gRNA sequence
cccccaagattttattgtga

SEQ ID NO: 26128 - DNA, 20 bp, Artificial
  CRISPR gRNA sequence
tattgtgaaagttttcggcc

SEQ ID NO: 26129 - DNA, 20 bp, Artificial
  CRISPR gRNA sequence
attgtgaaagttttcggcca

SEQ ID NO: 26130 - DNA, 20 bp, Artificial
  CRISPR gRNA sequence
ttgtgaaagttttcggccag

SEQ ID NO: 26131 - DNA, 20 bp, Artificial
  CRISPR gRNA sequence
tgaaagttttcggccaggcg

SEQ ID NO: 26132 - DNA, 20 bp, Artificial
  CRISPR gRNA sequence
tcggccaggcgtggtggctc

SEQ ID NO: 26133 - DNA, 20 bp, Artificial
  CRISPR gRNA sequence
cggccaggcgtggtggctca

SEQ ID NO: 26134 - DNA, 20 bp, Artificial
  CRISPR gRNA sequence
ggccaggcgtggtggctcac

SEQ ID NO: 26135 - DNA, 20 bp, Artificial
  CRISPR gRNA sequence
acatctgtaatcccagcact

SEQ ID NO: 26136 - DNA, 20 bp, Artificial
  CRISPR gRNA sequence
taatcccagcactttgggag

SEQ ID NO: 26137 - DNA, 20 bp, Artificial
  CRISPR gRNA sequence
tgggaggccaaggctggcag

SEQ ID NO: 26138 - DNA, 20 bp, Artificial
  CRISPR gRNA sequence
gggaggccaaggctggcaga

SEQ ID NO: 26139 - DNA, 20 bp, Artificial
  CRISPR gRNA sequence
ggaggccaaggctggcagat

SEQ ID NO: 26140 - DNA, 20 bp, Artificial
  CRISPR gRNA sequence
gcagatcacctgaggtcaag

SEQ ID NO: 26141 - DNA, 20 bp, Artificial
  CRISPR gRNA sequence
aggtcaagagtttgagacca

SEQ ID NO: 26142 - DNA, 20 bp, Artificial
  CRISPR gRNA sequence
gagaccagcctggccaacat

SEQ ID NO: 26143 - DNA, 20 bp, Artificial
  CRISPR gRNA sequence
agaccagcctggccaacatg

SEQ ID NO: 26144 - DNA, 20 bp, Artificial
  CRISPR gRNA sequence
gccaacatggtgaaacccca

SEQ ID NO: 26145 - DNA, 20 bp, Artificial
  CRISPR gRNA sequence
tactaaaaatacaaaaatta

SEQ ID NO: 26146 - DNA, 20 bp, Artificial
  CRISPR gRNA sequence
ctaaaaatacaaaaattagc

SEQ ID NO: 26147 - DNA, 20 bp, Artificial
  CRISPR gRNA sequence
aaaatacaaaaattagccag

SEQ ID NO: 26148 - DNA, 20 bp, Artificial
  CRISPR gRNA sequence
gccaggcgtggtggcgaaca

SEQ ID NO: 26149 - DNA, 20 bp, Artificial
  CRISPR gRNA sequence
taatcccagctaccagggag

SEQ ID NO: 26150 - DNA, 20 bp, Artificial
  CRISPR gRNA sequence
ccagggaggctagggtggga

SEQ ID NO: 26151 - DNA, 20 bp, Artificial
  CRISPR gRNA sequence
gggtgggagaatcgcttgaa

SEQ ID NO: 26152 - DNA, 20 bp, Artificial
  CRISPR gRNA sequence
gaacctaagaagcagaggtt

SEQ ID NO: 26153 - DNA, 20 bp, Artificial
  CRISPR gRNA sequence
aacctaagaagcagaggttg

SEQ ID NO: 26154 - DNA, 20 bp, Artificial
  CRISPR gRNA sequence
agaagcagaggttgcagtga

SEQ ID NO: 26155 - DNA, 20 bp, Artificial
  CRISPR gRNA sequence
cagtgagccaagattgcgcc

SEQ ID NO: 26156 - DNA, 20 bp, Artificial
  CRISPR gRNA sequence
cgccagtgcactccagcctg

SEQ ID NO: 26157 - DNA, 20 bp, Artificial
  CRISPR gRNA sequence
cagcctgggcaacagagcta

SEQ ID NO: 26158 - DNA, 20 bp, Artificial
  CRISPR gRNA sequence
ggcaacagagctagactctg

SEQ ID NO: 26159 - DNA, 20 bp, Artificial
  CRISPR gRNA sequence
gactctgtttcaaaaaaaaa

SEQ ID NO: 26160 - DNA, 20 bp, Artificial
  CRISPR gRNA sequence
tgtttcaaaaaaaaaaaaaa

SEQ ID NO: 26161 - DNA, 20 bp, Artificial
  CRISPR gRNA sequence
tttcaaaaaaaaaaaaaaat

SEQ ID NO: 26162 - DNA, 20 bp, Artificial
  CRISPR gRNA sequence
caaaaaaaaaaaaaaatgtt

SEQ ID NO: 26163 - DNA, 20 bp, Artificial
  CRISPR gRNA sequence
aaaaaaaaaaaaaaatgttt

SEQ ID NO: 26164 - DNA, 20 bp, Artificial
  CRISPR gRNA sequence
tcaagatacaataaaagtga

SEQ ID NO: 26165 - DNA, 20 bp, Artificial
  CRISPR gRNA sequence
caagatacaataaaagtgaa

SEQ ID NO: 26166 - DNA, 20 bp, Artificial
  CRISPR gRNA sequence
aagatacaataaaagtgaaa

SEQ ID NO: 26167 - DNA, 20 bp, Artificial
  CRISPR gRNA sequence
tgaaggtccatatacccacc

SEQ ID NO: 26168 - DNA, 20 bp, Artificial
  CRISPR gRNA sequence
tgattctacaattaatgttg

SEQ ID NO: 26169 - DNA, 20 bp, Artificial
  CRISPR gRNA sequence
gattctacaattaatgttgg

SEQ ID NO: 26170 - DNA, 20 bp, Artificial
  CRISPR gRNA sequence
attctacaattaatgttggg

SEQ ID NO: 26171 - DNA, 20 bp, Artificial
  CRISPR gRNA sequence
tacaattaatgttgggtttt

SEQ ID NO: 26172 - DNA, 20 bp, Artificial
  CRISPR gRNA sequence
caattaatgttgggttttat

SEQ ID NO: 26173 - DNA, 20 bp, Artificial
  CRISPR gRNA sequence
atgttgggttttattcatct

SEQ ID NO: 26174 - DNA, 20 bp, Artificial
  CRISPR gRNA sequence
ggttttattcatcttatcac

SEQ ID NO: 26175 - DNA, 20 bp, Artificial
  CRISPR gRNA sequence
tattcatcttatcacatctc

SEQ ID NO: 26176 - DNA, 20 bp, Artificial
  CRISPR gRNA sequence
attcatcttatcacatctct

SEQ ID NO: 26177 - DNA, 20 bp, Artificial
  CRISPR gRNA sequence
ttcatcttatcacatctcta

SEQ ID NO: 26178 - DNA, 20 bp, Artificial
  CRISPR gRNA sequence
atcttatcacatctctattc

SEQ ID NO: 26179 - DNA, 20 bp, Artificial
  CRISPR gRNA sequence
atcacatctctattcatctg

SEQ ID NO: 26180 - DNA, 20 bp, Artificial
  CRISPR gRNA sequence
tcacatctctattcatctgt

SEQ ID NO: 26181 - DNA, 20 bp, Artificial
  CRISPR gRNA sequence
tattcatctgtccatccctc

SEQ ID NO: 26182 - DNA, 20 bp, Artificial
  CRISPR gRNA sequence
ttcatctgtccatccctcta

SEQ ID NO: 26183 - DNA, 20 bp, Artificial
  CRISPR gRNA sequence
atctgtccatccctctatcc

SEQ ID NO: 26184 - DNA, 20 bp, Artificial
  CRISPR gRNA sequence
tccatccctctatccatcca

SEQ ID NO: 26185 - DNA, 20 bp, Artificial
  CRISPR gRNA sequence
tatccatccacacacccatt

SEQ ID NO: 26186 - DNA, 20 bp, Artificial
  CRISPR gRNA sequence
tccatccacacacccattca

SEQ ID NO: 26187 - DNA, 20 bp, Artificial
  CRISPR gRNA sequence
attatatttttggtacattt

SEQ ID NO: 26188 - DNA, 20 bp, Artificial
  CRISPR gRNA sequence
tatttttggtacatttcaat

SEQ ID NO: 26189 - DNA, 20 bp, Artificial
  CRISPR gRNA sequence
ttggtacatttcaatgtaca

SEQ ID NO: 26190 - DNA, 20 bp, Artificial
  CRISPR gRNA sequence
tggtacatttcaatgtacat

SEQ ID NO: 26191 - DNA, 20 bp, Artificial
  CRISPR gRNA sequence
ggtacatttcaatgtacatt

SEQ ID NO: 26192 - DNA, 20 bp, Artificial
  CRISPR gRNA sequence
gtacatttcaatgtacattt

SEQ ID NO: 26193 - DNA, 20 bp, Artificial
  CRISPR gRNA sequence
caatgtacatttcaaatgta

SEQ ID NO: 26194 - DNA, 20 bp, Artificial
  CRISPR gRNA sequence
aatgtacatttcaaatgtaa

SEQ ID NO: 26195 - DNA, 20 bp, Artificial
  CRISPR gRNA sequence
caaatgtaaattgcagattt

SEQ ID NO: 26196 - DNA, 20 bp, Artificial
  CRISPR gRNA sequence
aaatgtaaattgcagattta

SEQ ID NO: 26197 - DNA, 20 bp, Artificial
  CRISPR gRNA sequence
cagatttacactcccctcgt

SEQ ID NO: 26198 - DNA, 20 bp, Artificial
  CRISPR gRNA sequence
acactcccctcgtgtacttc

SEQ ID NO: 26199 - DNA, 20 bp, Artificial
  CRISPR gRNA sequence
cactcccctcgtgtacttca

SEQ ID NO: 26200 - DNA, 20 bp, Artificial
  CRISPR gRNA sequence
ccctcgtgtacttcagcatc

SEQ ID NO: 26201 - DNA, 20 bp, Artificial
  CRISPR gRNA sequence
gtgtacttcagcatcctttc

SEQ ID NO: 26202 - DNA, 20 bp, Artificial
  CRISPR gRNA sequence
cagcatcctttcttttaagg

SEQ ID NO: 26203 - DNA, 20 bp, Artificial
  CRISPR gRNA sequence
agcatcctttcttttaaggc

SEQ ID NO: 26204 - DNA, 20 bp, Artificial
  CRISPR gRNA sequence
tcttttaaggccatgcagtg

SEQ ID NO: 26205 - DNA, 20 bp, Artificial
  CRISPR gRNA sequence
cttttaaggccatgcagtgt

SEQ ID NO: 26206 - DNA, 20 bp, Artificial
  CRISPR gRNA sequence
ttttaaggccatgcagtgtt

SEQ ID NO: 26207 - DNA, 20 bp, Artificial
  CRISPR gRNA sequence
ttaaggccatgcagtgtttc

SEQ ID NO: 26208 - DNA, 20 bp, Artificial
  CRISPR gRNA sequence
taaggccatgcagtgtttcg

SEQ ID NO: 26209 - DNA, 20 bp, Artificial
  CRISPR gRNA sequence
aaggccatgcagtgtttcgt

SEQ ID NO: 26210 - DNA, 20 bp, Artificial
  CRISPR gRNA sequence
aggccatgcagtgtttcgtt

SEQ ID NO: 26211 - DNA, 20 bp, Artificial
  CRISPR gRNA sequence
cgttgggtagatgaaccata

SEQ ID NO: 26212 - DNA, 20 bp, Artificial
  CRISPR gRNA sequence
gttgggtagatgaaccataa

SEQ ID NO: 26213 - DNA, 20 bp, Artificial
  CRISPR gRNA sequence
ggtagatgaaccataatttg

SEQ ID NO: 26214 - DNA, 20 bp, Artificial
  CRISPR gRNA sequence
gtttaagcagtcccttgcta

SEQ ID NO: 26215 - DNA, 20 bp, Artificial
  CRISPR gRNA sequence
tttaagcagtcccttgctaa

SEQ ID NO: 26216 - DNA, 20 bp, Artificial
  CRISPR gRNA sequence
aagcagtcccttgctaaggg

SEQ ID NO: 26217 - DNA, 20 bp, Artificial
  CRISPR gRNA sequence
agcagtcccttgctaaggga

SEQ ID NO: 26218 - DNA, 20 bp, Artificial
  CRISPR gRNA sequence
gctaagggacacgtgggttt

SEQ ID NO: 26219 - DNA, 20 bp, Artificial
  CRISPR gRNA sequence
ctaagggacacgtgggtttt

SEQ ID NO: 26220 - DNA, 20 bp, Artificial
  CRISPR gRNA sequence
agggacacgtgggtttttaa

SEQ ID NO: 26221 - DNA, 20 bp, Artificial
  CRISPR gRNA sequence
ttaatctgttgctgtgagtg

SEQ ID NO: 26222 - DNA, 20 bp, Artificial
  CRISPR gRNA sequence
taatctgttgctgtgagtgc

SEQ ID NO: 26223 - DNA, 20 bp, Artificial
  CRISPR gRNA sequence
aatctgttgctgtgagtgct

SEQ ID NO: 26224 - DNA, 20 bp, Artificial
  CRISPR gRNA sequence
atctgttgctgtgagtgctt

SEQ ID NO: 26225 - DNA, 20 bp, Artificial
  CRISPR gRNA sequence
ttgctgtgagtgcttgatac

SEQ ID NO: 26226 - DNA, 20 bp, Artificial
  CRISPR gRNA sequence
ctgtgagtgcttgatactca

SEQ ID NO: 26227 - DNA, 20 bp, Artificial
  CRISPR gRNA sequence
tgagtgcttgatactcactc

SEQ ID NO: 26228 - DNA, 20 bp, Artificial
  CRISPR gRNA sequence
gatactcactcactgatttc

SEQ ID NO: 26229 - DNA, 20 bp, Artificial
  CRISPR gRNA sequence
atactcactcactgatttct

SEQ ID NO: 26230 - DNA, 20 bp, Artificial
  CRISPR gRNA sequence
actcactgatttctggcata

SEQ ID NO: 26231 - DNA, 20 bp, Artificial
  CRISPR gRNA sequence
actgatttctggcatactcc

SEQ ID NO: 26232 - DNA, 20 bp, Artificial
  CRISPR gRNA sequence
atttctggcatactcctgca

SEQ ID NO: 26233 - DNA, 20 bp, Artificial
  CRISPR gRNA sequence
ctggcatactcctgcaatgt

SEQ ID NO: 26234 - DNA, 20 bp, Artificial
  CRISPR gRNA sequence
tggcatactcctgcaatgta

SEQ ID NO: 26235 - DNA, 20 bp, Artificial
  CRISPR gRNA sequence
gcatactcctgcaatgtagg

SEQ ID NO: 26236 - DNA, 20 bp, Artificial
  CRISPR gRNA sequence
ctgcaatgtaggaaccacca

SEQ ID NO: 26237 - DNA, 20 bp, Artificial
  CRISPR gRNA sequence
caatgtaggaaccaccaccc

SEQ ID NO: 26238 - DNA, 20 bp, Artificial
  CRISPR gRNA sequence
catagatgtgagatcaaagg

SEQ ID NO: 26239 - DNA, 20 bp, Artificial
  CRISPR gRNA sequence
atagatgtgagatcaaaggt

SEQ ID NO: 26240 - DNA, 20 bp, Artificial
  CRISPR gRNA sequence
agagaagctgcattgcaaag

SEQ ID NO: 26241 - DNA, 20 bp, Artificial
  CRISPR gRNA sequence
cattgcaaaggcacacagct

SEQ ID NO: 26242 - DNA, 20 bp, Artificial
  CRISPR gRNA sequence
caaaggcacacagctaggaa

SEQ ID NO: 26243 - DNA, 20 bp, Artificial
  CRISPR gRNA sequence
ggaagcggttcaaaagcagg

SEQ ID NO: 26244 - DNA, 20 bp, Artificial
  CRISPR gRNA sequence
aaaagcaggttcctttgttt

SEQ ID NO: 26245 - DNA, 20 bp, Artificial
  CRISPR gRNA sequence
ctttgttttgttttgttttg

SEQ ID NO: 26246 - DNA, 20 bp, Artificial
  CRISPR gRNA sequence
tgttttgttttgttttgttt

SEQ ID NO: 26247 - DNA, 20 bp, Artificial
  CRISPR gRNA sequence
gttttgttttgttttgtttt

SEQ ID NO: 26248 - DNA, 20 bp, Artificial
  CRISPR gRNA sequence
ttttgttttgttttgttttt

SEQ ID NO: 26249 - DNA, 20 bp, Artificial
  CRISPR gRNA sequence
tgttttgttttgttttttgg

SEQ ID NO: 26250 - DNA, 20 bp, Artificial
  CRISPR gRNA sequence
gttttgttttgttttttggc

SEQ ID NO: 26251 - DNA, 20 bp, Artificial
  CRISPR gRNA sequence
ttttgttttgttttttggct

SEQ ID NO: 26252 - DNA, 20 bp, Artificial
  CRISPR gRNA sequence
tgttttgttttttggctcaa

SEQ ID NO: 26253 - DNA, 20 bp, Artificial
  CRISPR gRNA sequence
gttttgttttttggctcaaa

SEQ ID NO: 26254 - DNA, 20 bp, Artificial
  CRISPR gRNA sequence
ttttgttttttggctcaaac

SEQ ID NO: 26255 - DNA, 20 bp, Artificial
  CRISPR gRNA sequence
tgttttttggctcaaaccca

SEQ ID NO: 26256 - DNA, 20 bp, Artificial
  CRISPR gRNA sequence
gttttttggctcaaacccat

SEQ ID NO: 26257 - DNA, 20 bp, Artificial
  CRISPR gRNA sequence
ttttttggctcaaacccatg

SEQ ID NO: 26258 - DNA, 20 bp, Artificial
  CRISPR gRNA sequence
tttggctcaaacccatgttg

SEQ ID NO: 26259 - DNA, 20 bp, Artificial
  CRISPR gRNA sequence
ttggctcaaacccatgttgt

SEQ ID NO: 26260 - DNA, 20 bp, Artificial
  CRISPR gRNA sequence
tggctcaaacccatgttgtg

SEQ ID NO: 26261 - DNA, 20 bp, Artificial
  CRISPR gRNA sequence
ggctcaaacccatgttgtgt

SEQ ID NO: 26262 - DNA, 20 bp, Artificial
  CRISPR gRNA sequence
gctcaaacccatgttgtgtc

SEQ ID NO: 26263 - DNA, 20 bp, Artificial
  CRISPR gRNA sequence
aaacccatgttgtgtcccca

SEQ ID NO: 26264 - DNA, 20 bp, Artificial
  CRISPR gRNA sequence
tgtccccatttgtgactcgg

SEQ ID NO: 26265 - DNA, 20 bp, Artificial
  CRISPR gRNA sequence
gtgactcggcctcttctgct

SEQ ID NO: 26266 - DNA, 20 bp, Artificial
  CRISPR gRNA sequence
tgactcggcctcttctgctg

SEQ ID NO: 26267 - DNA, 20 bp, Artificial
  CRISPR gRNA sequence
ggcctcttctgctgctacac

SEQ ID NO: 26268 - DNA, 20 bp, Artificial
  CRISPR gRNA sequence
ttctgctgctacactgcctg

SEQ ID NO: 26269 - DNA, 20 bp, Artificial
  CRISPR gRNA sequence
ctgctgctacactgcctggt

SEQ ID NO: 26270 - DNA, 20 bp, Artificial
  CRISPR gRNA sequence
tgctgctacactgcctggta

SEQ ID NO: 26271 - DNA, 20 bp, Artificial
  CRISPR gRNA sequence
ctgctacactgcctggtatg

SEQ ID NO: 26272 - DNA, 20 bp, Artificial
  CRISPR gRNA sequence
ctacactgcctggtatggtt

SEQ ID NO: 26273 - DNA, 20 bp, Artificial
  CRISPR gRNA sequence
cactgcctggtatggtttga

SEQ ID NO: 26274 - DNA, 20 bp, Artificial
  CRISPR gRNA sequence
cctggtatggtttgagatgg

SEQ ID NO: 26275 - DNA, 20 bp, Artificial
  CRISPR gRNA sequence
gtatggtttgagatggggtt

SEQ ID NO: 26276 - DNA, 20 bp, Artificial
  CRISPR gRNA sequence
gagatggggtttgggttcaa

SEQ ID NO: 26277 - DNA, 20 bp, Artificial
  CRISPR gRNA sequence
agatggggtttgggttcaag

SEQ ID NO: 26278 - DNA, 20 bp, Artificial
  CRISPR gRNA sequence
gggttcaagccaaggagctg

SEQ ID NO: 26279 - DNA, 20 bp, Artificial
  CRISPR gRNA sequence
ggttcaagccaaggagctgg

SEQ ID NO: 26280 - DNA, 20 bp, Artificial
  CRISPR gRNA sequence
aagccaaggagctggggttg

SEQ ID NO: 26281 - DNA, 20 bp, Artificial
  CRISPR gRNA sequence
gggttggaatgttagagcga

SEQ ID NO: 26282 - DNA, 20 bp, Artificial
  CRISPR gRNA sequence
gaatgttagagcgaggggag

SEQ ID NO: 26283 - DNA, 20 bp, Artificial
  CRISPR gRNA sequence
gagcgaggggaggaaaatgg

SEQ ID NO: 26284 - DNA, 20 bp, Artificial
  CRISPR gRNA sequence
cccagccttgaagttaaggc

SEQ ID NO: 26285 - DNA, 20 bp, Artificial
  CRISPR gRNA sequence
gaagttaaggccgtatagcc

SEQ ID NO: 26286 - DNA, 20 bp, Artificial
  CRISPR gRNA sequence
aagttaaggccgtatagcct

SEQ ID NO: 26287 - DNA, 20 bp, Artificial
  CRISPR gRNA sequence
aggccgtatagcctgctaga

SEQ ID NO: 26288 - DNA, 20 bp, Artificial
  CRISPR gRNA sequence
ctagagtcctgagccccttc

SEQ ID NO: 26289 - DNA, 20 bp, Artificial
  CRISPR gRNA sequence
gagtcctgagccccttctgg

SEQ ID NO: 26290 - DNA, 20 bp, Artificial
  CRISPR gRNA sequence
agccccttctggcttgggac

SEQ ID NO: 26291 - DNA, 20 bp, Artificial
  CRISPR gRNA sequence
ctggcttgggacatcctctc

SEQ ID NO: 26292 - DNA, 20 bp, Artificial
  CRISPR gRNA sequence
tggcttgggacatcctctcc

SEQ ID NO: 26293 - DNA, 20 bp, Artificial
  CRISPR gRNA sequence
gcttgggacatcctctccct

SEQ ID NO: 26294 - DNA, 20 bp, Artificial
  CRISPR gRNA sequence
gggacatcctctccctgggg

SEQ ID NO: 26295 - DNA, 20 bp, Artificial
  CRISPR gRNA sequence
ggacatcctctccctggggc

SEQ ID NO: 26296 - DNA, 20 bp, Artificial
  CRISPR gRNA sequence
tccctggggcagctgatcac

SEQ ID NO: 26297 - DNA, 20 bp, Artificial
  CRISPR gRNA sequence
cctggggcagctgatcacat

SEQ ID NO: 26298 - DNA, 20 bp, Artificial
  CRISPR gRNA sequence
gggcagctgatcacatgttt

SEQ ID NO: 26299 - DNA, 20 bp, Artificial
  CRISPR gRNA sequence
atcacatgttttctctgcag

SEQ ID NO: 26300 - DNA, 20 bp, Artificial
  CRISPR gRNA sequence
tctctgcagccttcccagag

SEQ ID NO: 26301 - DNA, 20 bp, Artificial
  CRISPR gRNA sequence
ctctgcagccttcccagagg

SEQ ID NO: 26302 - DNA, 20 bp, Artificial
  CRISPR gRNA sequence
tctgcagccttcccagagga

SEQ ID NO: 26303 - DNA, 20 bp, Artificial
  CRISPR gRNA sequence
tgcagccttcccagaggagc

SEQ ID NO: 26304 - DNA, 20 bp, Artificial
  CRISPR gRNA sequence
cagccttcccagaggagctt

SEQ ID NO: 26305 - DNA, 20 bp, Artificial
  CRISPR gRNA sequence
cccagaggagcttccggcag

SEQ ID NO: 26306 - DNA, 20 bp, Artificial
  CRISPR gRNA sequence
ccagaggagcttccggcaga

SEQ ID NO: 26307 - DNA, 20 bp, Artificial
  CRISPR gRNA sequence
ccggcagacctgaagcactg

SEQ ID NO: 26308 - DNA, 20 bp, Artificial
  CRISPR gRNA sequence
cggcagacctgaagcactgg

SEQ ID NO: 26309 - DNA, 20 bp, Artificial
  CRISPR gRNA sequence
aagcactggaagccaggtgt

SEQ ID NO: 26310 - DNA, 20 bp, Artificial
  CRISPR gRNA sequence
gaagccaggtgtgcagggca

SEQ ID NO: 26311 - DNA, 20 bp, Artificial
  CRISPR gRNA sequence
gggttgggaagggtggatgc

SEQ ID NO: 26312 - DNA, 20 bp, Artificial
  CRISPR gRNA sequence
ggaagggtggatgccttggg

SEQ ID NO: 26313 - DNA, 20 bp, Artificial
  CRISPR gRNA sequence
ggggaggggatggaagagat

SEQ ID NO: 26314 - DNA, 20 bp, Artificial
  CRISPR gRNA sequence
gggaggggatggaagagatt

SEQ ID NO: 26315 - DNA, 20 bp, Artificial
  CRISPR gRNA sequence
aactcctggcccaagtctga

SEQ ID NO: 26316 - DNA, 20 bp, Artificial
  CRISPR gRNA sequence
ctggcccaagtctgatgggg

SEQ ID NO: 26317 - DNA, 20 bp, Artificial
  CRISPR gRNA sequence
gcccaagtctgatggggatg

SEQ ID NO: 26318 - DNA, 20 bp, Artificial
  CRISPR gRNA sequence
atggggatggtgcatggtgc

SEQ ID NO: 26319 - DNA, 20 bp, Artificial
  CRISPR gRNA sequence
cccttctttgggtagaggct

SEQ ID NO: 26320 - DNA, 20 bp, Artificial
  CRISPR gRNA sequence
ctttgggtagaggctgagag

SEQ ID NO: 26321 - DNA, 20 bp, Artificial
  CRISPR gRNA sequence
tttgggtagaggctgagagc

SEQ ID NO: 26322 - DNA, 20 bp, Artificial
  CRISPR gRNA sequence
tgggtagaggctgagagctt

SEQ ID NO: 26323 - DNA, 20 bp, Artificial
  CRISPR gRNA sequence
gggtagaggctgagagcttg

SEQ ID NO: 26324 - DNA, 20 bp, Artificial
  CRISPR gRNA sequence
ggtagaggctgagagcttgg

SEQ ID NO: 26325 - DNA, 20 bp, Artificial
  CRISPR gRNA sequence
agagcttggggtcccttaga

SEQ ID NO: 26326 - DNA, 20 bp, Artificial
  CRISPR gRNA sequence
ggggtcccttagagtcctct

SEQ ID NO: 26327 - DNA, 20 bp, Artificial
  CRISPR gRNA sequence
gggtcccttagagtcctcta

SEQ ID NO: 26328 - DNA, 20 bp, Artificial
  CRISPR gRNA sequence
agagtcctctaaggggctca

SEQ ID NO: 26329 - DNA, 20 bp, Artificial
  CRISPR gRNA sequence
gagtcctctaaggggctcac

SEQ ID NO: 26330 - DNA, 20 bp, Artificial
  CRISPR gRNA sequence
taaggggctcacgactgttt

SEQ ID NO: 26331 - DNA, 20 bp, Artificial
  CRISPR gRNA sequence
aggggctcacgactgtttgt

SEQ ID NO: 26332 - DNA, 20 bp, Artificial
  CRISPR gRNA sequence
acgactgtttgtggaaggtg

SEQ ID NO: 26333 - DNA, 20 bp, Artificial
  CRISPR gRNA sequence
tttgtggaaggtggtagggg

SEQ ID NO: 26334 - DNA, 20 bp, Artificial
  CRISPR gRNA sequence
gtggaaggtggtaggggctt

SEQ ID NO: 26335 - DNA, 20 bp, Artificial
  CRISPR gRNA sequence
tggaaggtggtaggggcttg

SEQ ID NO: 26336 - DNA, 20 bp, Artificial
  CRISPR gRNA sequence
ggagctaacagattgttcat

SEQ ID NO: 26337 - DNA, 20 bp, Artificial
  CRISPR gRNA sequence
gagctaacagattgttcata

SEQ ID NO: 26338 - DNA, 20 bp, Artificial
  CRISPR gRNA sequence
acagattgttcataggttct

SEQ ID NO: 26339 - DNA, 20 bp, Artificial
  CRISPR gRNA sequence
ttcataggttctattctgcc

SEQ ID NO: 26340 - DNA, 20 bp, Artificial
  CRISPR gRNA sequence
ataggttctattctgcccca

SEQ ID NO: 26341 - DNA, 20 bp, Artificial
  CRISPR gRNA sequence
tattctgccccagctctccg

SEQ ID NO: 26342 - DNA, 20 bp, Artificial
  CRISPR gRNA sequence
ttctgccccagctctccgtg

SEQ ID NO: 26343 - DNA, 20 bp, Artificial
  CRISPR gRNA sequence
tgccccagctctccgtgtgg

SEQ ID NO: 26344 - DNA, 20 bp, Artificial
  CRISPR gRNA sequence
ccccagctctccgtgtggag

SEQ ID NO: 26345 - DNA, 20 bp, Artificial
  CRISPR gRNA sequence
tccgtgtggaggccctaggg

SEQ ID NO: 26346 - DNA, 20 bp, Artificial
  CRISPR gRNA sequence
cgtgtggaggccctagggtc

SEQ ID NO: 26347 - DNA, 20 bp, Artificial
  CRISPR gRNA sequence
gggtcctgctcagcatagct

SEQ ID NO: 26348 - DNA, 20 bp, Artificial
  CRISPR gRNA sequence
ctcagcatagctctcagagc

SEQ ID NO: 26349 - DNA, 20 bp, Artificial
  CRISPR gRNA sequence
agcatagctctcagagccaa

SEQ ID NO: 26350 - DNA, 20 bp, Artificial
  CRISPR gRNA sequence
tcagagccaagtcacaagga

SEQ ID NO: 26351 - DNA, 20 bp, Artificial
  CRISPR gRNA sequence
agagccaagtcacaaggaga

SEQ ID NO: 26352 - DNA, 20 bp, Artificial
  CRISPR gRNA sequence
ggggactgcctggcacagag

SEQ ID NO: 26353 - DNA, 20 bp, Artificial
  CRISPR gRNA sequence
cctggcacagagcagttgct

SEQ ID NO: 26354 - DNA, 20 bp, Artificial
  CRISPR gRNA sequence
gcacagagcagttgctgatc

SEQ ID NO: 26355 - DNA, 20 bp, Artificial
  CRISPR gRNA sequence
ctgatcaacacagctgcagc

SEQ ID NO: 26356 - DNA, 20 bp, Artificial
  CRISPR gRNA sequence
atcaacacagctgcagccag

SEQ ID NO: 26357 - DNA, 20 bp, Artificial
  CRISPR gRNA sequence
cagccagggctgagaagatg

SEQ ID NO: 26358 - DNA, 20 bp, Artificial
  CRISPR gRNA sequence
agaagatgacaagcatttcc

SEQ ID NO: 26359 - DNA, 20 bp, Artificial
  CRISPR gRNA sequence
cctctgtcaggagagacatc

SEQ ID NO: 26360 - DNA, 20 bp, Artificial
  CRISPR gRNA sequence
ctctgtcaggagagacatcc

SEQ ID NO: 26361 - DNA, 20 bp, Artificial
  CRISPR gRNA sequence
tgtcaggagagacatccatg

SEQ ID NO: 26362 - DNA, 20 bp, Artificial
  CRISPR gRNA sequence
tcaggagagacatccatgcc

SEQ ID NO: 26363 - DNA, 20 bp, Artificial
  CRISPR gRNA sequence
cagggccctccccatcccag

SEQ ID NO: 26364 - DNA, 20 bp, Artificial
  CRISPR gRNA sequence
cccatcccaggaaggcccct

SEQ ID NO: 26365 - DNA, 20 bp, Artificial
  CRISPR gRNA sequence
caagcacccagtctctaaca

SEQ ID NO: 26366 - DNA, 20 bp, Artificial
  CRISPR gRNA sequence
taacacagcccacttcctca

SEQ ID NO: 26367 - DNA, 20 bp, Artificial
  CRISPR gRNA sequence
acacagcccacttcctcaca

SEQ ID NO: 26368 - DNA, 20 bp, Artificial
  CRISPR gRNA sequence
cctcacagctgagcccccca

SEQ ID NO: 26369 - DNA, 20 bp, Artificial
  CRISPR gRNA sequence
ctcacagctgagccccccac

SEQ ID NO: 26370 - DNA, 20 bp, Artificial
  CRISPR gRNA sequence
acagctgagccccccactgt

SEQ ID NO: 26371 - DNA, 20 bp, Artificial
  CRISPR gRNA sequence
agccccccactgtggtgact

SEQ ID NO: 26372 - DNA, 20 bp, Artificial
  CRISPR gRNA sequence
tggtgactggcagtctccta

SEQ ID NO: 26373 - DNA, 20 bp, Artificial
  CRISPR gRNA sequence
gcagtctcctagtgagacca

SEQ ID NO: 26374 - DNA, 20 bp, Artificial
  CRISPR gRNA sequence
ctagtgagaccagtgagcga

SEQ ID NO: 26375 - DNA, 20 bp, Artificial
  CRISPR gRNA sequence
gtgagaccagtgagcgactg

SEQ ID NO: 26376 - DNA, 20 bp, Artificial
  CRISPR gRNA sequence
ctccaccctgccctgcctgc

SEQ ID NO: 26377 - DNA, 20 bp, Artificial
  CRISPR gRNA sequence
caccctgccctgcctgccac

SEQ ID NO: 26378 - DNA, 20 bp, Artificial
  CRISPR gRNA sequence
ccctgcctgccactgcctgc

SEQ ID NO: 26379 - DNA, 20 bp, Artificial
  CRISPR gRNA sequence
cctgccactgcctgcgctgt

SEQ ID NO: 26380 - DNA, 20 bp, Artificial
  CRISPR gRNA sequence
ccactgcctgcgctgttcaa

SEQ ID NO: 26381 - DNA, 20 bp, Artificial
  CRISPR gRNA sequence
cctgcgctgttcaaccagga

SEQ ID NO: 26382 - DNA, 20 bp, Artificial
  CRISPR gRNA sequence
cgctgttcaaccaggagcca

SEQ ID NO: 26383 - DNA, 20 bp, Artificial
  CRISPR gRNA sequence
ttcaaccaggagccagcctc

SEQ ID NO: 26384 - DNA, 20 bp, Artificial
  CRISPR gRNA sequence
aaccaggagccagcctccgg

SEQ ID NO: 26385 - DNA, 20 bp, Artificial
  CRISPR gRNA sequence
cggccagatgcgcctggaga

SEQ ID NO: 26386 - DNA, 20 bp, Artificial
  CRISPR gRNA sequence
gagaaaaccgaccagattcc

SEQ ID NO: 26387 - DNA, 20 bp, Artificial
  CRISPR gRNA sequence
ccagtatgttagggggcttg

SEQ ID NO: 26388 - DNA, 20 bp, Artificial
  CRISPR gRNA sequence
gggggcttggagagagtggg

SEQ ID NO: 26389 - DNA, 20 bp, Artificial
  CRISPR gRNA sequence
ggagagagtgggctttctcc

SEQ ID NO: 26390 - DNA, 20 bp, Artificial
  CRISPR gRNA sequence
gagagagtgggctttctccc

SEQ ID NO: 26391 - DNA, 20 bp, Artificial
  CRISPR gRNA sequence
tctccctcttgggaggtgga

SEQ ID NO: 26392 - DNA, 20 bp, Artificial
  CRISPR gRNA sequence
ctccctcttgggaggtggat

SEQ ID NO: 26393 - DNA, 20 bp, Artificial
  CRISPR gRNA sequence
tccctcttgggaggtggata

SEQ ID NO: 26394 - DNA, 20 bp, Artificial
  CRISPR gRNA sequence
cctcttgggaggtggataag

SEQ ID NO: 26395 - DNA, 20 bp, Artificial
  CRISPR gRNA sequence
ttgggaggtggataaggagt

SEQ ID NO: 26396 - DNA, 20 bp, Artificial
  CRISPR gRNA sequence
gggaggtggataaggagttg

SEQ ID NO: 26397 - DNA, 20 bp, Artificial
  CRISPR gRNA sequence
ggaggtggataaggagttga

SEQ ID NO: 26398 - DNA, 20 bp, Artificial
  CRISPR gRNA sequence
acactaaggcagggactgtc

SEQ ID NO: 26399 - DNA, 20 bp, Artificial
  CRISPR gRNA sequence
aggcagggactgtcaggaac

SEQ ID NO: 26400 - DNA, 20 bp, Artificial
  CRISPR gRNA sequence
tcaggaactggacctcacct

SEQ ID NO: 26401 - DNA, 20 bp, Artificial
  CRISPR gRNA sequence
gacctcacctctccccaacc

SEQ ID NO: 26402 - DNA, 20 bp, Artificial
  CRISPR gRNA sequence
acctctccccaaccctatca

SEQ ID NO: 26403 - DNA, 20 bp, Artificial
  CRISPR gRNA sequence
tccccaaccctatcagtgtc

SEQ ID NO: 26404 - DNA, 20 bp, Artificial
  CRISPR gRNA sequence
cccaaccctatcagtgtcac

SEQ ID NO: 26405 - DNA, 20 bp, Artificial
  CRISPR gRNA sequence
tcagtgtcactcacctctgc

SEQ ID NO: 26406 - DNA, 20 bp, Artificial
  CRISPR gRNA sequence
acctctgccccagccagttt

SEQ ID NO: 26407 - DNA, 20 bp, Artificial
  CRISPR gRNA sequence
tgccccagccagttttatcc

SEQ ID NO: 26408 - DNA, 20 bp, Artificial
  CRISPR gRNA sequence
ccccagccagttttatcctt

SEQ ID NO: 26409 - DNA, 20 bp, Artificial
  CRISPR gRNA sequence
tatccttggggcccccgtca

SEQ ID NO: 26410 - DNA, 20 bp, Artificial
  CRISPR gRNA sequence
atccttggggcccccgtcag

SEQ ID NO: 26411 - DNA, 20 bp, Artificial
  CRISPR gRNA sequence
tccttggggcccccgtcagc

SEQ ID NO: 26412 - DNA, 20 bp, Artificial
  CRISPR gRNA sequence
ggggcccccgtcagctcaat

SEQ ID NO: 26413 - DNA, 20 bp, Artificial
  CRISPR gRNA sequence
gggcccccgtcagctcaatc

SEQ ID NO: 26414 - DNA, 20 bp, Artificial
  CRISPR gRNA sequence
aatccctggcagagaacatg

SEQ ID NO: 26415 - DNA, 20 bp, Artificial
  CRISPR gRNA sequence
gcagagaacatgcctcagaa

SEQ ID NO: 26416 - DNA, 20 bp, Artificial
  CRISPR gRNA sequence
agaaggaaacacatccgtgc

SEQ ID NO: 26417 - DNA, 20 bp, Artificial
  CRISPR gRNA sequence
caccaattagagcattcacc

SEQ ID NO: 26418 - DNA, 20 bp, Artificial
  CRISPR gRNA sequence
gagcattcacctgccagcct

SEQ ID NO: 26419 - DNA, 20 bp, Artificial
  CRISPR gRNA sequence
acctgccagccttattcgtt

SEQ ID NO: 26420 - DNA, 20 bp, Artificial
  CRISPR gRNA sequence
ccagccttattcgttcatca

SEQ ID NO: 26421 - DNA, 20 bp, Artificial
  CRISPR gRNA sequence
attcgttcatcagctcttca

SEQ ID NO: 26422 - DNA, 20 bp, Artificial
  CRISPR gRNA sequence
ttcgttcatcagctcttcat

SEQ ID NO: 26423 - DNA, 20 bp, Artificial
  CRISPR gRNA sequence
gttcatcagctcttcatgga

SEQ ID NO: 26424 - DNA, 20 bp, Artificial
  CRISPR gRNA sequence
atcagctcttcatggagccc

SEQ ID NO: 26425 - DNA, 20 bp, Artificial
  CRISPR gRNA sequence
ttcatggagccccttctctg

SEQ ID NO: 26426 - DNA, 20 bp, Artificial
  CRISPR gRNA sequence
catggagccccttctctgtg

SEQ ID NO: 26427 - DNA, 20 bp, Artificial
  CRISPR gRNA sequence
atggagccccttctctgtgc

SEQ ID NO: 26428 - DNA, 20 bp, Artificial
  CRISPR gRNA sequence
ctctgtgccaactgctctgc

SEQ ID NO: 26429 - DNA, 20 bp, Artificial
  CRISPR gRNA sequence
tctgtgccaactgctctgct

SEQ ID NO: 26430 - DNA, 20 bp, Artificial
  CRISPR gRNA sequence
tgtgccaactgctctgctag

SEQ ID NO: 26431 - DNA, 20 bp, Artificial
  CRISPR gRNA sequence
tgccaactgctctgctaggt

SEQ ID NO: 26432 - DNA, 20 bp, Artificial
  CRISPR gRNA sequence
ctctgctaggtgctaagaat

SEQ ID NO: 26433 - DNA, 20 bp, Artificial
  CRISPR gRNA sequence
tgctaggtgctaagaattcc

SEQ ID NO: 26434 - DNA, 20 bp, Artificial
  CRISPR gRNA sequence
ctaggtgctaagaattccat

SEQ ID NO: 26435 - DNA, 20 bp, Artificial
  CRISPR gRNA sequence
ggtgctaagaattccatcag

SEQ ID NO: 26436 - DNA, 20 bp, Artificial
  CRISPR gRNA sequence
agaattccatcagggcagga

SEQ ID NO: 26437 - DNA, 20 bp, Artificial
  CRISPR gRNA sequence
catcagggcaggacagaaac

SEQ ID NO: 26438 - DNA, 20 bp, Artificial
  CRISPR gRNA sequence
ctgctcttagggaaattagg

SEQ ID NO: 26439 - DNA, 20 bp, Artificial
  CRISPR gRNA sequence
ctcttagggaaattagggcc

SEQ ID NO: 26440 - DNA, 20 bp, Artificial
  CRISPR gRNA sequence
ttagggaaattagggccctt

SEQ ID NO: 26441 - DNA, 20 bp, Artificial
  CRISPR gRNA sequence
agggaaattagggcccttta

SEQ ID NO: 26442 - DNA, 20 bp, Artificial
  CRISPR gRNA sequence
gggaaattagggccctttag

SEQ ID NO: 26443 - DNA, 20 bp, Artificial
  CRISPR gRNA sequence
gggccctttaggggggtcag

SEQ ID NO: 26444 - DNA, 20 bp, Artificial
  CRISPR gRNA sequence
taggggggtcagacattaat

SEQ ID NO: 26445 - DNA, 20 bp, Artificial
  CRISPR gRNA sequence
aggggggtcagacattaatc

SEQ ID NO: 26446 - DNA, 20 bp, Artificial
  CRISPR gRNA sequence
ggggggtcagacattaatca

SEQ ID NO: 26447 - DNA, 20 bp, Artificial
  CRISPR gRNA sequence
atcaaataagcaaaagcaga

SEQ ID NO: 26448 - DNA, 20 bp, Artificial
  CRISPR gRNA sequence
tgcaagatcccacctcactg

SEQ ID NO: 26449 - DNA, 20 bp, Artificial
  CRISPR gRNA sequence
actgcctttgtctcttgcag

SEQ ID NO: 26450 - DNA, 20 bp, Artificial
  CRISPR gRNA sequence
cctttgtctcttgcagtgcc

SEQ ID NO: 26451 - DNA, 20 bp, Artificial
  CRISPR gRNA sequence
tgtctcttgcagtgcctttc

SEQ ID NO: 26452 - DNA, 20 bp, Artificial
  CRISPR gRNA sequence
gtctcttgcagtgcctttct

SEQ ID NO: 26453 - DNA, 20 bp, Artificial
  CRISPR gRNA sequence
tctcttgcagtgcctttctc

SEQ ID NO: 26454 - DNA, 20 bp, Artificial
  CRISPR gRNA sequence
ttgcagtgcctttctccagt

SEQ ID NO: 26455 - DNA, 20 bp, Artificial
  CRISPR gRNA sequence
gcagtgcctttctccagttc

SEQ ID NO: 26456 - DNA, 20 bp, Artificial
  CRISPR gRNA sequence
cagtgcctttctccagttcc

SEQ ID NO: 26457 - DNA, 20 bp, Artificial
  CRISPR gRNA sequence
tctccagttcctcgttgagc

SEQ ID NO: 26458 - DNA, 20 bp, Artificial
  CRISPR gRNA sequence
ctccagttcctcgttgagct

SEQ ID NO: 26459 - DNA, 20 bp, Artificial
  CRISPR gRNA sequence
tccagttcctcgttgagctg

SEQ ID NO: 26460 - DNA, 20 bp, Artificial
  CRISPR gRNA sequence
cagttcctcgttgagctgcc

SEQ ID NO: 26461 - DNA, 20 bp, Artificial
  CRISPR gRNA sequence
ctcgttgagctgcctgaatc

SEQ ID NO: 26462 - DNA, 20 bp, Artificial
  CRISPR gRNA sequence
gttgagctgcctgaatctcc

SEQ ID NO: 26463 - DNA, 20 bp, Artificial
  CRISPR gRNA sequence
agctgcctgaatctccctga

SEQ ID NO: 26464 - DNA, 20 bp, Artificial
  CRISPR gRNA sequence
cctgaatctccctgagggac

SEQ ID NO: 26465 - DNA, 20 bp, Artificial
  CRISPR gRNA sequence
aatctccctgagggacccat

SEQ ID NO: 26466 - DNA, 20 bp, Artificial
  CRISPR gRNA sequence
cctgagggacccatccagtt

SEQ ID NO: 26467 - DNA, 20 bp, Artificial
  CRISPR gRNA sequence
agggacccatccagtttgtc

SEQ ID NO: 26468 - DNA, 20 bp, Artificial
  CRISPR gRNA sequence
gtccccaccatctccactct

SEQ ID NO: 26469 - DNA, 20 bp, Artificial
  CRISPR gRNA sequence
tccccaccatctccactctg

SEQ ID NO: 26470 - DNA, 20 bp, Artificial
  CRISPR gRNA sequence
cactctgccccatgggctct

SEQ ID NO: 26471 - DNA, 20 bp, Artificial
  CRISPR gRNA sequence
tgccccatgggctctggcaa

SEQ ID NO: 26472 - DNA, 20 bp, Artificial
  CRISPR gRNA sequence
ccccatgggctctggcaaat

SEQ ID NO: 26473 - DNA, 20 bp, Artificial
  CRISPR gRNA sequence
tggcaaatctctgaggctgg

SEQ ID NO: 26474 - DNA, 20 bp, Artificial
  CRISPR gRNA sequence
gcaaatctctgaggctggaa

SEQ ID NO: 26475 - DNA, 20 bp, Artificial
  CRISPR gRNA sequence
tgaggctggaacaggggtct

SEQ ID NO: 26476 - DNA, 20 bp, Artificial
  CRISPR gRNA sequence
aggctggaacaggggtctcc

SEQ ID NO: 26477 - DNA, 20 bp, Artificial
  CRISPR gRNA sequence
gaacaggggtctccagtata

SEQ ID NO: 26478 - DNA, 20 bp, Artificial
  CRISPR gRNA sequence
cagtatattcatctaccatg

SEQ ID NO: 26479 - DNA, 20 bp, Artificial
  CRISPR gRNA sequence
atctaccatggtgagtgcgg

SEQ ID NO: 26480 - DNA, 20 bp, Artificial
  CRISPR gRNA sequence
ccatggtgagtgcggggcct

SEQ ID NO: 26481 - DNA, 20 bp, Artificial
  CRISPR gRNA sequence
gctccccgaccacctctccc

SEQ ID NO: 26482 - DNA, 20 bp, Artificial
  CRISPR gRNA sequence
cccgaccacctctccctcct

SEQ ID NO: 26483 - DNA, 20 bp, Artificial
  CRISPR gRNA sequence
tccctcctacctgactgctc

SEQ ID NO: 26484 - DNA, 20 bp, Artificial
  CRISPR gRNA sequence
cctcctacctgactgctccc

SEQ ID NO: 26485 - DNA, 20 bp, Artificial
  CRISPR gRNA sequence
ctacctgactgctccctgac

SEQ ID NO: 26486 - DNA, 20 bp, Artificial
  CRISPR gRNA sequence
cctgactgctccctgacctc

SEQ ID NO: 26487 - DNA, 20 bp, Artificial
  CRISPR gRNA sequence
actgctccctgacctcatcc

SEQ ID NO: 26488 - DNA, 20 bp, Artificial
  CRISPR gRNA sequence
ctccctgacctcatcctccc

SEQ ID NO: 26489 - DNA, 20 bp, Artificial
  CRISPR gRNA sequence
cctgacctcatcctccccat

SEQ ID NO: 26490 - DNA, 20 bp, Artificial
  CRISPR gRNA sequence
acctcatcctccccatactc

SEQ ID NO: 26491 - DNA, 20 bp, Artificial
  CRISPR gRNA sequence
atcctccccatactccatgc

SEQ ID NO: 26492 - DNA, 20 bp, Artificial
  CRISPR gRNA sequence
cccatactccatgcacttgg

SEQ ID NO: 26493 - DNA, 20 bp, Artificial
  CRISPR gRNA sequence
catgcacttggcagtggtgc

SEQ ID NO: 26494 - DNA, 20 bp, Artificial
  CRISPR gRNA sequence
ggcagtggtgccctagcacc

SEQ ID NO: 26495 - DNA, 20 bp, Artificial
  CRISPR gRNA sequence
gcagtggtgccctagcacct

SEQ ID NO: 26496 - DNA, 20 bp, Artificial
  CRISPR gRNA sequence
gcaccttctcatgatcctcc

SEQ ID NO: 26497 - DNA, 20 bp, Artificial
  CRISPR gRNA sequence
ctcatgatcctccctcccca

SEQ ID NO: 26498 - DNA, 20 bp, Artificial
  CRISPR gRNA sequence
tcatgatcctccctccccag

SEQ ID NO: 26499 - DNA, 20 bp, Artificial
  CRISPR gRNA sequence
atgatcctccctccccagca

SEQ ID NO: 26500 - DNA, 20 bp, Artificial
  CRISPR gRNA sequence
cctccccagcacaactttct

SEQ ID NO: 26501 - DNA, 20 bp, Artificial
  CRISPR gRNA sequence
cccagcacaactttctctgt

SEQ ID NO: 26502 - DNA, 20 bp, Artificial
  CRISPR gRNA sequence
tctctgtccctatttcccaa

SEQ ID NO: 26503 - DNA, 20 bp, Artificial
  CRISPR gRNA sequence
ctctgtccctatttcccaaa

SEQ ID NO: 26504 - DNA, 20 bp, Artificial
  CRISPR gRNA sequence
tctgtccctatttcccaaaa

SEQ ID NO: 26505 - DNA, 20 bp, Artificial
  CRISPR gRNA sequence
tgtccctatttcccaaaaat

SEQ ID NO: 26506 - DNA, 20 bp, Artificial
  CRISPR gRNA sequence
tccctatttcccaaaaatca

SEQ ID NO: 26507 - DNA, 20 bp, Artificial
  CRISPR gRNA sequence
tttcccaaaaatcaaagcag

SEQ ID NO: 26508 - DNA, 20 bp, Artificial
  CRISPR gRNA sequence
cccaaaaatcaaagcagaag

SEQ ID NO: 26509 - DNA, 20 bp, Artificial
  CRISPR gRNA sequence
ccaaaaatcaaagcagaaga

SEQ ID NO: 26510 - DNA, 20 bp, Artificial
  CRISPR gRNA sequence
ctgaggtggtctgggtgcat

SEQ ID NO: 26511 - DNA, 20 bp, Artificial
  CRISPR gRNA sequence
aggtggtctgggtgcatgac

SEQ ID NO: 26512 - DNA, 20 bp, Artificial
  CRISPR gRNA sequence
ggtgcatgaccaagagtggt

SEQ ID NO: 26513 - DNA, 20 bp, Artificial
  CRISPR gRNA sequence
tgtggccttccatatgttgc

SEQ ID NO: 26514 - DNA, 20 bp, Artificial
  CRISPR gRNA sequence
ccatatgttgctttcccctt

SEQ ID NO: 26515 - DNA, 20 bp, Artificial
  CRISPR gRNA sequence
catatgttgctttccccttc

SEQ ID NO: 26516 - DNA, 20 bp, Artificial
  CRISPR gRNA sequence
ctttccccttctgaccctta

SEQ ID NO: 26517 - DNA, 20 bp, Artificial
  CRISPR gRNA sequence
tccccttctgacccttagtt

SEQ ID NO: 26518 - DNA, 20 bp, Artificial
  CRISPR gRNA sequence
ccccttctgacccttagttt

SEQ ID NO: 26519 - DNA, 20 bp, Artificial
  CRISPR gRNA sequence
cccttctgacccttagtttt

SEQ ID NO: 26520 - DNA, 20 bp, Artificial
  CRISPR gRNA sequence
ctgacccttagtttttcctt

SEQ ID NO: 26521 - DNA, 20 bp, Artificial
  CRISPR gRNA sequence
tgacccttagtttttcctta

SEQ ID NO: 26522 - DNA, 20 bp, Artificial
  CRISPR gRNA sequence
acccttagtttttccttatt

SEQ ID NO: 26523 - DNA, 20 bp, Artificial
  CRISPR gRNA sequence
agtttttccttatttttttt

SEQ ID NO: 26524 - DNA, 20 bp, Artificial
  CRISPR gRNA sequence
gtttttccttatttttttta

SEQ ID NO: 26525 - DNA, 20 bp, Artificial
  CRISPR gRNA sequence
ttccttattttttttaaatg

SEQ ID NO: 26526 - DNA, 20 bp, Artificial
  CRISPR gRNA sequence
tccttattttttttaaatgt

SEQ ID NO: 26527 - DNA, 20 bp, Artificial
  CRISPR gRNA sequence
ccttattttttttaaatgtt

SEQ ID NO: 26528 - DNA, 20 bp, Artificial
  CRISPR gRNA sequence
cttattttttttaaatgttt

SEQ ID NO: 26529 - DNA, 20 bp, Artificial
  CRISPR gRNA sequence
attttttttaaatgtttttg

SEQ ID NO: 26530 - DNA, 20 bp, Artificial
  CRISPR gRNA sequence
ttttttttaaatgtttttgt

SEQ ID NO: 26531 - DNA, 20 bp, Artificial
  CRISPR gRNA sequence
tttttaaatgtttttgtttt

SEQ ID NO: 26532 - DNA, 20 bp, Artificial
  CRISPR gRNA sequence
ttttaaatgtttttgttttt

SEQ ID NO: 26533 - DNA, 20 bp, Artificial
  CRISPR gRNA sequence
tttaaatgtttttgttttta

SEQ ID NO: 26534 - DNA, 20 bp, Artificial
  CRISPR gRNA sequence
ttaaatgtttttgtttttaa

SEQ ID NO: 26535 - DNA, 20 bp, Artificial
  CRISPR gRNA sequence
taaatgtttttgtttttaaa

SEQ ID NO: 26536 - DNA, 20 bp, Artificial
  CRISPR gRNA sequence
aaatgtttttgtttttaaat

SEQ ID NO: 26537 - DNA, 20 bp, Artificial
  CRISPR gRNA sequence
aatgtttttgtttttaaatt

SEQ ID NO: 26538 - DNA, 20 bp, Artificial
  CRISPR gRNA sequence
ttgtttttaaattgcaacat

SEQ ID NO: 26539 - DNA, 20 bp, Artificial
  CRISPR gRNA sequence
tgtttttaaattgcaacatc

SEQ ID NO: 26540 - DNA, 20 bp, Artificial
  CRISPR gRNA sequence
gtttttaaattgcaacatca

SEQ ID NO: 26541 - DNA, 20 bp, Artificial
  CRISPR gRNA sequence
tttttaaattgcaacatcaa

SEQ ID NO: 26542 - DNA, 20 bp, Artificial
  CRISPR gRNA sequence
ttaaattgcaacatcaatac

SEQ ID NO: 26543 - DNA, 20 bp, Artificial
  CRISPR gRNA sequence
taaattgcaacatcaataca

SEQ ID NO: 26544 - DNA, 20 bp, Artificial
  CRISPR gRNA sequence
aaattgcaacatcaatacat

SEQ ID NO: 26545 - DNA, 20 bp, Artificial
  CRISPR gRNA sequence
aattgcaacatcaatacatg

SEQ ID NO: 26546 - DNA, 20 bp, Artificial
  CRISPR gRNA sequence
caacatcaatacatgctcac

SEQ ID NO: 26547 - DNA, 20 bp, Artificial
  CRISPR gRNA sequence
actaataagctaatgacaag

SEQ ID NO: 26548 - DNA, 20 bp, Artificial
  CRISPR gRNA sequence
ataagctaatgacaagtgat

SEQ ID NO: 26549 - DNA, 20 bp, Artificial
  CRISPR gRNA sequence
atgacaagtgatgtttacaa

SEQ ID NO: 26550 - DNA, 20 bp, Artificial
  CRISPR gRNA sequence
acaagaattcactgtctctc

SEQ ID NO: 26551 - DNA, 20 bp, Artificial
  CRISPR gRNA sequence
caagaattcactgtctctct

SEQ ID NO: 26552 - DNA, 20 bp, Artificial
  CRISPR gRNA sequence
actgtctctctcactctttt

SEQ ID NO: 26553 - DNA, 20 bp, Artificial
  CRISPR gRNA sequence
tctctctcactcttttagta

SEQ ID NO: 26554 - DNA, 20 bp, Artificial
  CRISPR gRNA sequence
tctcactcttttagtatact

SEQ ID NO: 26555 - DNA, 20 bp, Artificial
  CRISPR gRNA sequence
tcactcttttagtatactga

SEQ ID NO: 26556 - DNA, 20 bp, Artificial
  CRISPR gRNA sequence
actcttttagtatactgatg

SEQ ID NO: 26557 - DNA, 20 bp, Artificial
  CRISPR gRNA sequence
ttttagtatactgatgtgaa

SEQ ID NO: 26558 - DNA, 20 bp, Artificial
  CRISPR gRNA sequence
ttagtatactgatgtgaata

SEQ ID NO: 26559 - DNA, 20 bp, Artificial
  CRISPR gRNA sequence
tagtatactgatgtgaatag

SEQ ID NO: 26560 - DNA, 20 bp, Artificial
  CRISPR gRNA sequence
agtatactgatgtgaatagt

SEQ ID NO: 26561 - DNA, 20 bp, Artificial
  CRISPR gRNA sequence
gtatactgatgtgaatagtt

SEQ ID NO: 26562 - DNA, 20 bp, Artificial
  CRISPR gRNA sequence
atgtgaatagtttggtgtgc

SEQ ID NO: 26563 - DNA, 20 bp, Artificial
  CRISPR gRNA sequence
ggtgtgcatccttgcatagc

SEQ ID NO: 26564 - DNA, 20 bp, Artificial
  CRISPR gRNA sequence
gtgtgcatccttgcatagct

SEQ ID NO: 26565 - DNA, 20 bp, Artificial
  CRISPR gRNA sequence
gcatagctttctctgatttg

SEQ ID NO: 26566 - DNA, 20 bp, Artificial
  CRISPR gRNA sequence
catagctttctctgatttgt

SEQ ID NO: 26567 - DNA, 20 bp, Artificial
  CRISPR gRNA sequence
tctctgatttgtcttgtttc

SEQ ID NO: 26568 - DNA, 20 bp, Artificial
  CRISPR gRNA sequence
ctctgatttgtcttgtttcc

SEQ ID NO: 26569 - DNA, 20 bp, Artificial
  CRISPR gRNA sequence
tctgatttgtcttgtttcct

SEQ ID NO: 26570 - DNA, 20 bp, Artificial
  CRISPR gRNA sequence
tgatttgtcttgtttcctaa

SEQ ID NO: 26571 - DNA, 20 bp, Artificial
  CRISPR gRNA sequence
atttgtcttgtttcctaatc

SEQ ID NO: 26572 - DNA, 20 bp, Artificial
  CRISPR gRNA sequence
gtcttgtttcctaatcagta

SEQ ID NO: 26573 - DNA, 20 bp, Artificial
  CRISPR gRNA sequence
tcttgtttcctaatcagtaa

SEQ ID NO: 26574 - DNA, 20 bp, Artificial
  CRISPR gRNA sequence
gtttcctaatcagtaaaatg

SEQ ID NO: 26575 - DNA, 20 bp, Artificial
  CRISPR gRNA sequence
tttcctaatcagtaaaatgg

SEQ ID NO: 26576 - DNA, 20 bp, Artificial
  CRISPR gRNA sequence
cctaatcagtaaaatggtcc

SEQ ID NO: 26577 - DNA, 20 bp, Artificial
  CRISPR gRNA sequence
ctaatcagtaaaatggtccc

SEQ ID NO: 26578 - DNA, 20 bp, Artificial
  CRISPR gRNA sequence
atcagtaaaatggtccctac

SEQ ID NO: 26579 - DNA, 20 bp, Artificial
  CRISPR gRNA sequence
ctgacccaccacactgaggg

SEQ ID NO: 26580 - DNA, 20 bp, Artificial
  CRISPR gRNA sequence
acccaccacactgaggggtt

SEQ ID NO: 26581 - DNA, 20 bp, Artificial
  CRISPR gRNA sequence
aggggttgtgacttgtctca

SEQ ID NO: 26582 - DNA, 20 bp, Artificial
  CRISPR gRNA sequence
tgacttgtctcagggaaggt

SEQ ID NO: 26583 - DNA, 20 bp, Artificial
  CRISPR gRNA sequence
gtctcagggaaggtgtgttt

SEQ ID NO: 26584 - DNA, 20 bp, Artificial
  CRISPR gRNA sequence
tctcagggaaggtgtgtttg

SEQ ID NO: 26585 - DNA, 20 bp, Artificial
  CRISPR gRNA sequence
agggaaggtgtgtttgggct

SEQ ID NO: 26586 - DNA, 20 bp, Artificial
  CRISPR gRNA sequence
gggctgtcagggatgagacc

SEQ ID NO: 26587 - DNA, 20 bp, Artificial
  CRISPR gRNA sequence
ggctgtcagggatgagacca

SEQ ID NO: 26588 - DNA, 20 bp, Artificial
  CRISPR gRNA sequence
tcagggatgagaccaggagg

SEQ ID NO: 26589 - DNA, 20 bp, Artificial
  CRISPR gRNA sequence
ccactcaagtccagagcatc

SEQ ID NO: 26590 - DNA, 20 bp, Artificial
  CRISPR gRNA sequence
cactcaagtccagagcatcc

SEQ ID NO: 26591 - DNA, 20 bp, Artificial
  CRISPR gRNA sequence
aagtccagagcatccattcc

SEQ ID NO: 26592 - DNA, 20 bp, Artificial
  CRISPR gRNA sequence
ctggttgcaagacagtttca

SEQ ID NO: 26593 - DNA, 20 bp, Artificial
  CRISPR gRNA sequence
gttgcaagacagtttcagta

SEQ ID NO: 26594 - DNA, 20 bp, Artificial
  CRISPR gRNA sequence
caagacagtttcagtataac

SEQ ID NO: 26595 - DNA, 20 bp, Artificial
  CRISPR gRNA sequence
cagtataacgcactggtatc

SEQ ID NO: 26596 - DNA, 20 bp, Artificial
  CRISPR gRNA sequence
agtataacgcactggtatct

SEQ ID NO: 26597 - DNA, 20 bp, Artificial
  CRISPR gRNA sequence
gtatctcagaagcagagaag

SEQ ID NO: 26598 - DNA, 20 bp, Artificial
  CRISPR gRNA sequence
agaagcagagaagcagttcc

SEQ ID NO: 26599 - DNA, 20 bp, Artificial
  CRISPR gRNA sequence
ctgatatctaggaaaatgag

SEQ ID NO: 26600 - DNA, 20 bp, Artificial
  CRISPR gRNA sequence
atatctaggaaaatgagcac

SEQ ID NO: 26601 - DNA, 20 bp, Artificial
  CRISPR gRNA sequence
ggaaaatgagcactgaccac

SEQ ID NO: 26602 - DNA, 20 bp, Artificial
  CRISPR gRNA sequence
accacacagcaggaagagtg

SEQ ID NO: 26603 - DNA, 20 bp, Artificial
  CRISPR gRNA sequence
ccctaagttccttatgagct

SEQ ID NO: 26604 - DNA, 20 bp, Artificial
  CRISPR gRNA sequence
agttccttatgagctaattg

SEQ ID NO: 26605 - DNA, 20 bp, Artificial
  CRISPR gRNA sequence
cttatgagctaattgcaccc

SEQ ID NO: 26606 - DNA, 20 bp, Artificial
  CRISPR gRNA sequence
atgagctaattgcacccatt

SEQ ID NO: 26607 - DNA, 20 bp, Artificial
  CRISPR gRNA sequence
tgagctaattgcacccattt

SEQ ID NO: 26608 - DNA, 20 bp, Artificial
  CRISPR gRNA sequence
attgcacccatttcacagat

SEQ ID NO: 26609 - DNA, 20 bp, Artificial
  CRISPR gRNA sequence
cacccatttcacagattgga

SEQ ID NO: 26610 - DNA, 20 bp, Artificial
  CRISPR gRNA sequence
cacagattggaaaagcaagg

SEQ ID NO: 26611 - DNA, 20 bp, Artificial
  CRISPR gRNA sequence
acagattggaaaagcaaggt

SEQ ID NO: 26612 - DNA, 20 bp, Artificial
  CRISPR gRNA sequence
gaaaagcaaggttccaggag

SEQ ID NO: 26613 - DNA, 20 bp, Artificial
  CRISPR gRNA sequence
caggagctagatgtaactcc

SEQ ID NO: 26614 - DNA, 20 bp, Artificial
  CRISPR gRNA sequence
gatgtaactccagagctctt

SEQ ID NO: 26615 - DNA, 20 bp, Artificial
  CRISPR gRNA sequence
cagagctctttcttcagctc

SEQ ID NO: 26616 - DNA, 20 bp, Artificial
  CRISPR gRNA sequence
tttcttcagctctgtcctga

SEQ ID NO: 26617 - DNA, 20 bp, Artificial
  CRISPR gRNA sequence
tcttcagctctgtcctgaaa

SEQ ID NO: 26618 - DNA, 20 bp, Artificial
  CRISPR gRNA sequence
cttcagctctgtcctgaaat

SEQ ID NO: 26619 - DNA, 20 bp, Artificial
  CRISPR gRNA sequence
ttcagctctgtcctgaaata

SEQ ID NO: 26620 - DNA, 20 bp, Artificial
  CRISPR gRNA sequence
cagctctgtcctgaaatatc

SEQ ID NO: 26621 - DNA, 20 bp, Artificial
  CRISPR gRNA sequence
agctctgtcctgaaatatct

SEQ ID NO: 26622 - DNA, 20 bp, Artificial
  CRISPR gRNA sequence
tgtcctgaaatatcttcctt

SEQ ID NO: 26623 - DNA, 20 bp, Artificial
  CRISPR gRNA sequence
tcctgaaatatcttcctttg

SEQ ID NO: 26624 - DNA, 20 bp, Artificial
  CRISPR gRNA sequence
aaatatcttcctttggaagt

SEQ ID NO: 26625 - DNA, 20 bp, Artificial
  CRISPR gRNA sequence
cctttggaagttctactctc

SEQ ID NO: 26626 - DNA, 20 bp, Artificial
  CRISPR gRNA sequence
ctttggaagttctactctct

SEQ ID NO: 26627 - DNA, 20 bp, Artificial
  CRISPR gRNA sequence
tggaagttctactctcttct

SEQ ID NO: 26628 - DNA, 20 bp, Artificial
  CRISPR gRNA sequence
ggaagttctactctcttctc

SEQ ID NO: 26629 - DNA, 20 bp, Artificial
  CRISPR gRNA sequence
gaagttctactctcttctct

SEQ ID NO: 26630 - DNA, 20 bp, Artificial
  CRISPR gRNA sequence
tactctcttctctccagact

SEQ ID NO: 26631 - DNA, 20 bp, Artificial
  CRISPR gRNA sequence
ctctcttctctccagacttc

SEQ ID NO: 26632 - DNA, 20 bp, Artificial
  CRISPR gRNA sequence
tcttctctccagacttcctg

SEQ ID NO: 26633 - DNA, 20 bp, Artificial
  CRISPR gRNA sequence
ttctctccagacttcctgag

SEQ ID NO: 26634 - DNA, 20 bp, Artificial
  CRISPR gRNA sequence
ctctccagacttcctgagct

SEQ ID NO: 26635 - DNA, 20 bp, Artificial
  CRISPR gRNA sequence
tctccagacttcctgagctc

SEQ ID NO: 26636 - DNA, 20 bp, Artificial
  CRISPR gRNA sequence
tccagacttcctgagctcca

SEQ ID NO: 26637 - DNA, 20 bp, Artificial
  CRISPR gRNA sequence
cagacttcctgagctccaca

SEQ ID NO: 26638 - DNA, 20 bp, Artificial
  CRISPR gRNA sequence
cctgagctccacagcccagt

SEQ ID NO: 26639 - DNA, 20 bp, Artificial
  CRISPR gRNA sequence
ctgagctccacagcccagtt

SEQ ID NO: 26640 - DNA, 20 bp, Artificial
  CRISPR gRNA sequence
agctccacagcccagtttgg

SEQ ID NO: 26641 - DNA, 20 bp, Artificial
  CRISPR gRNA sequence
cacagcccagtttggagtag

SEQ ID NO: 26642 - DNA, 20 bp, Artificial
  CRISPR gRNA sequence
ggagtaggggtgacccaagt

SEQ ID NO: 26643 - DNA, 20 bp, Artificial
  CRISPR gRNA sequence
gagtaggggtgacccaagtg

SEQ ID NO: 26644 - DNA, 20 bp, Artificial
  CRISPR gRNA sequence
ctggaatcaatacctggtta

SEQ ID NO: 26645 - DNA, 20 bp, Artificial
  CRISPR gRNA sequence
tggaatcaatacctggttat

SEQ ID NO: 26646 - DNA, 20 bp, Artificial
  CRISPR gRNA sequence
gaatcaatacctggttattc

SEQ ID NO: 26647 - DNA, 20 bp, Artificial
  CRISPR gRNA sequence
gttattctcacaccactctc

SEQ ID NO: 26648 - DNA, 20 bp, Artificial
  CRISPR gRNA sequence
ttctcacaccactctccacc

SEQ ID NO: 26649 - DNA, 20 bp, Artificial
  CRISPR gRNA sequence
tcacaccactctccaccccc

SEQ ID NO: 26650 - DNA, 20 bp, Artificial
  CRISPR gRNA sequence
acaccactctccacccccaa

SEQ ID NO: 26651 - DNA, 20 bp, Artificial
  CRISPR gRNA sequence
tccacccccaatgtaggtga

SEQ ID NO: 26652 - DNA, 20 bp, Artificial
  CRISPR gRNA sequence
cacccccaatgtaggtgagg

SEQ ID NO: 26653 - DNA, 20 bp, Artificial
  CRISPR gRNA sequence
ccagtggattcactgtccac

SEQ ID NO: 26654 - DNA, 20 bp, Artificial
  CRISPR gRNA sequence
actgtccacggcctcccaac

SEQ ID NO: 26655 - DNA, 20 bp, Artificial
  CRISPR gRNA sequence
tccacggcctcccaacatct

SEQ ID NO: 26656 - DNA, 20 bp, Artificial
  CRISPR gRNA sequence
ccaacatctccagaccggcc

SEQ ID NO: 26657 - DNA, 20 bp, Artificial
  CRISPR gRNA sequence
cagaccggccaggctccacc

SEQ ID NO: 26658 - DNA, 20 bp, Artificial
  CRISPR gRNA sequence
caccagccccttcgctccat

SEQ ID NO: 26659 - DNA, 20 bp, Artificial
  CRISPR gRNA sequence
cgctccatcagccactgacc

SEQ ID NO: 26660 - DNA, 20 bp, Artificial
  CRISPR gRNA sequence
gctccatcagccactgacct

SEQ ID NO: 26661 - DNA, 20 bp, Artificial
  CRISPR gRNA sequence
catcagccactgacctgccc

SEQ ID NO: 26662 - DNA, 20 bp, Artificial
  CRISPR gRNA sequence
acctgcccagcatgcctgaa

SEQ ID NO: 26663 - DNA, 20 bp, Artificial
  CRISPR gRNA sequence
cccagcatgcctgaacctgc

SEQ ID NO: 26664 - DNA, 20 bp, Artificial
  CRISPR gRNA sequence
aacctgccctgacctcccga

SEQ ID NO: 26665 - DNA, 20 bp, Artificial
  CRISPR gRNA sequence
ccctgacctcccgagcaaac

SEQ ID NO: 26666 - DNA, 20 bp, Artificial
  CRISPR gRNA sequence
acctcccgagcaaacatgac

SEQ ID NO: 26667 - DNA, 20 bp, Artificial
  CRISPR gRNA sequence
ccgagcaaacatgacaggta

SEQ ID NO: 26668 - DNA, 20 bp, Artificial
  CRISPR gRNA sequence
agggcctgtgagaggtacta

SEQ ID NO: 26669 - DNA, 20 bp, Artificial
  CRISPR gRNA sequence
gggcctgtgagaggtactag

SEQ ID NO: 26670 - DNA, 20 bp, Artificial
  CRISPR gRNA sequence
tgagaggtactagaagcagg

SEQ ID NO: 26671 - DNA, 20 bp, Artificial
  CRISPR gRNA sequence
gaagcaggatcgaggccctg

SEQ ID NO: 26672 - DNA, 20 bp, Artificial
  CRISPR gRNA sequence
gggaaggaattgtctcaaat

SEQ ID NO: 26673 - DNA, 20 bp, Artificial
  CRISPR gRNA sequence
tctcaaataagatccacaag

SEQ ID NO: 26674 - DNA, 20 bp, Artificial
  CRISPR gRNA sequence
aaataagatccacaagcaaa

SEQ ID NO: 26675 - DNA, 20 bp, Artificial
  CRISPR gRNA sequence
cctgtagggacaacaggtca

SEQ ID NO: 26676 - DNA, 20 bp, Artificial
  CRISPR gRNA sequence
tagggacaacaggtcatgtt

SEQ ID NO: 26677 - DNA, 20 bp, Artificial
  CRISPR gRNA sequence
aggggtcagtcgggacaggg

SEQ ID NO: 26678 - DNA, 20 bp, Artificial
  CRISPR gRNA sequence
ggggtcagtcgggacaggga

SEQ ID NO: 26679 - DNA, 20 bp, Artificial
  CRISPR gRNA sequence
cagggagtggaggcatggtt

SEQ ID NO: 26680 - DNA, 20 bp, Artificial
  CRISPR gRNA sequence
tgggggaatggacagctaga

SEQ ID NO: 26681 - DNA, 20 bp, Artificial
  CRISPR gRNA sequence
gagaatccacatcccatcca

SEQ ID NO: 26682 - DNA, 20 bp, Artificial
  CRISPR gRNA sequence
cagctgcttgttacccagca

SEQ ID NO: 26683 - DNA, 20 bp, Artificial
  CRISPR gRNA sequence
agctgcttgttacccagcag

SEQ ID NO: 26684 - DNA, 20 bp, Artificial
  CRISPR gRNA sequence
cttgttacccagcagaaaag

SEQ ID NO: 26685 - DNA, 20 bp, Artificial
  CRISPR gRNA sequence
gttacccagcagaaaagcca

SEQ ID NO: 26686 - DNA, 20 bp, Artificial
  CRISPR gRNA sequence
ttacccagcagaaaagccag

SEQ ID NO: 26687 - DNA, 20 bp, Artificial
  CRISPR gRNA sequence
cccagcagaaaagccagaca

SEQ ID NO: 26688 - DNA, 20 bp, Artificial
  CRISPR gRNA sequence
ttgaagttgaaaaccctgat

SEQ ID NO: 26689 - DNA, 20 bp, Artificial
  CRISPR gRNA sequence
tgaagttgaaaaccctgatt

SEQ ID NO: 26690 - DNA, 20 bp, Artificial
  CRISPR gRNA sequence
gaagttgaaaaccctgattt

SEQ ID NO: 26691 - DNA, 20 bp, Artificial
  CRISPR gRNA sequence
aagttgaaaaccctgatttt

SEQ ID NO: 26692 - DNA, 20 bp, Artificial
  CRISPR gRNA sequence
aaaaccctgatttttacata

SEQ ID NO: 26693 - DNA, 20 bp, Artificial
  CRISPR gRNA sequence
atttttacatagatattgtg

SEQ ID NO: 26694 - DNA, 20 bp, Artificial
  CRISPR gRNA sequence
ttacatagatattgtgattt

SEQ ID NO: 26695 - DNA, 20 bp, Artificial
  CRISPR gRNA sequence
tacatagatattgtgatttt

SEQ ID NO: 26696 - DNA, 20 bp, Artificial
  CRISPR gRNA sequence
acatagatattgtgattttt

SEQ ID NO: 26697 - DNA, 20 bp, Artificial
  CRISPR gRNA sequence
catagatattgtgatttttt

SEQ ID NO: 26698 - DNA, 20 bp, Artificial
  CRISPR gRNA sequence
tgattttttaatttttattt

SEQ ID NO: 26699 - DNA, 20 bp, Artificial
  CRISPR gRNA sequence
tttaatttttattttattat

SEQ ID NO: 26700 - DNA, 20 bp, Artificial
  CRISPR gRNA sequence
ttaatttttattttattatt

SEQ ID NO: 26701 - DNA, 20 bp, Artificial
  CRISPR gRNA sequence
taatttttattttattattt

SEQ ID NO: 26702 - DNA, 20 bp, Artificial
  CRISPR gRNA sequence
aatttttattttattattta

SEQ ID NO: 26703 - DNA, 20 bp, Artificial
  CRISPR gRNA sequence
atttttattttattatttat

SEQ ID NO: 26704 - DNA, 20 bp, Artificial
  CRISPR gRNA sequence
ttattttattatttatttat

SEQ ID NO: 26705 - DNA, 20 bp, Artificial
  CRISPR gRNA sequence
tattttattatttatttatt

SEQ ID NO: 26706 - DNA, 20 bp, Artificial
  CRISPR gRNA sequence
attttattatttatttattg

SEQ ID NO: 26707 - DNA, 20 bp, Artificial
  CRISPR gRNA sequence
ttttattatttatttattgt

SEQ ID NO: 26708 - DNA, 20 bp, Artificial
  CRISPR gRNA sequence
tattatttatttattgttga

SEQ ID NO: 26709 - DNA, 20 bp, Artificial
  CRISPR gRNA sequence
attatttatttattgttgag

SEQ ID NO: 26710 - DNA, 20 bp, Artificial
  CRISPR gRNA sequence
ttatttatttattgttgaga

SEQ ID NO: 26711 - DNA, 20 bp, Artificial
  CRISPR gRNA sequence
tttatttattgttgagatgg

SEQ ID NO: 26712 - DNA, 20 bp, Artificial
  CRISPR gRNA sequence
atttattgttgagatggagt

SEQ ID NO: 26713 - DNA, 20 bp, Artificial
  CRISPR gRNA sequence
tttattgttgagatggagtc

SEQ ID NO: 26714 - DNA, 20 bp, Artificial
  CRISPR gRNA sequence
attgttgagatggagtctca

SEQ ID NO: 26715 - DNA, 20 bp, Artificial
  CRISPR gRNA sequence
ttgttgagatggagtctcac

SEQ ID NO: 26716 - DNA, 20 bp, Artificial
  CRISPR gRNA sequence
ttgagatggagtctcactct

SEQ ID NO: 26717 - DNA, 20 bp, Artificial
  CRISPR gRNA sequence
agatggagtctcactctgtt

SEQ ID NO: 26718 - DNA, 20 bp, Artificial
  CRISPR gRNA sequence
actctgttgcccaggctaga

SEQ ID NO: 26719 - DNA, 20 bp, Artificial
  CRISPR gRNA sequence
tgttgcccaggctagagtgc

SEQ ID NO: 26720 - DNA, 20 bp, Artificial
  CRISPR gRNA sequence
ttgcccaggctagagtgcag

SEQ ID NO: 26721 - DNA, 20 bp, Artificial
  CRISPR gRNA sequence
cccaggctagagtgcagtgg

SEQ ID NO: 26722 - DNA, 20 bp, Artificial
  CRISPR gRNA sequence
gagtgcagtggtgcgatctc

SEQ ID NO: 26723 - DNA, 20 bp, Artificial
  CRISPR gRNA sequence
agatcactgcaacctccgcc

SEQ ID NO: 26724 - DNA, 20 bp, Artificial
  CRISPR gRNA sequence
caacctccgccctacaggtt

SEQ ID NO: 26725 - DNA, 20 bp, Artificial
  CRISPR gRNA sequence
cgccctacaggttcaagtga

SEQ ID NO: 26726 - DNA, 20 bp, Artificial
  CRISPR gRNA sequence
caggttcaagtgattctcct

SEQ ID NO: 26727 - DNA, 20 bp, Artificial
  CRISPR gRNA sequence
aagtgattctcctgcctcag

SEQ ID NO: 26728 - DNA, 20 bp, Artificial
  CRISPR gRNA sequence
tcctgcctcagcctccggag

SEQ ID NO: 26729 - DNA, 20 bp, Artificial
  CRISPR gRNA sequence
ctgcctcagcctccggagca

SEQ ID NO: 26730 - DNA, 20 bp, Artificial
  CRISPR gRNA sequence
cctcagcctccggagcagct

SEQ ID NO: 26731 - DNA, 20 bp, Artificial
  CRISPR gRNA sequence
agcctccggagcagctggaa

SEQ ID NO: 26732 - DNA, 20 bp, Artificial
  CRISPR gRNA sequence
cggagcagctggaattacag

SEQ ID NO: 26733 - DNA, 20 bp, Artificial
  CRISPR gRNA sequence
gaattacaggtgtgcaccgt

SEQ ID NO: 26734 - DNA, 20 bp, Artificial
  CRISPR gRNA sequence
caggtgtgcaccgtcacacc

SEQ ID NO: 26735 - DNA, 20 bp, Artificial
  CRISPR gRNA sequence
ttgtaatttcagtagagaca

SEQ ID NO: 26736 - DNA, 20 bp, Artificial
  CRISPR gRNA sequence
tgtaatttcagtagagacaa

SEQ ID NO: 26737 - DNA, 20 bp, Artificial
  CRISPR gRNA sequence
gtaatttcagtagagacaag

SEQ ID NO: 26738 - DNA, 20 bp, Artificial
  CRISPR gRNA sequence
taatttcagtagagacaagt

SEQ ID NO: 26739 - DNA, 20 bp, Artificial
  CRISPR gRNA sequence
cagtagagacaagtttaacc

SEQ ID NO: 26740 - DNA, 20 bp, Artificial
  CRISPR gRNA sequence
agtagagacaagtttaacca

SEQ ID NO: 26741 - DNA, 20 bp, Artificial
  CRISPR gRNA sequence
aaccatgttggccaggctgg

SEQ ID NO: 26742 - DNA, 20 bp, Artificial
  CRISPR gRNA sequence
accatgttggccaggctggt

SEQ ID NO: 26743 - DNA, 20 bp, Artificial
  CRISPR gRNA sequence
gccaggctggtctcgaactc

SEQ ID NO: 26744 - DNA, 20 bp, Artificial
  CRISPR gRNA sequence
gtctcgaactcctgatctca

SEQ ID NO: 26745 - DNA, 20 bp, Artificial
  CRISPR gRNA sequence
gaactcctgatctcaagtga

SEQ ID NO: 26746 - DNA, 20 bp, Artificial
  CRISPR gRNA sequence
ctgatctcaagtgatccacc

SEQ ID NO: 26747 - DNA, 20 bp, Artificial
  CRISPR gRNA sequence
atctcaagtgatccacctgc

SEQ ID NO: 26748 - DNA, 20 bp, Artificial
  CRISPR gRNA sequence
aagtgatccacctgcctcga

SEQ ID NO: 26749 - DNA, 20 bp, Artificial
  CRISPR gRNA sequence
cctcgacctcccaaagtgct

SEQ ID NO: 26750 - DNA, 20 bp, Artificial
  CRISPR gRNA sequence
gacctcccaaagtgctggga

SEQ ID NO: 26751 - DNA, 20 bp, Artificial
  CRISPR gRNA sequence
ccaaagtgctgggattacag

SEQ ID NO: 26752 - DNA, 20 bp, Artificial
  CRISPR gRNA sequence
ggattacaggtgtgagccac

SEQ ID NO: 26753 - DNA, 20 bp, Artificial
  CRISPR gRNA sequence
caggtgtgagccactgcacc

SEQ ID NO: 26754 - DNA, 20 bp, Artificial
  CRISPR gRNA sequence
cacccagcctgatattgcga

SEQ ID NO: 26755 - DNA, 20 bp, Artificial
  CRISPR gRNA sequence
atattgcgattttctttttt

SEQ ID NO: 26756 - DNA, 20 bp, Artificial
  CRISPR gRNA sequence
cgattttcttttttaaacat

SEQ ID NO: 26757 - DNA, 20 bp, Artificial
  CRISPR gRNA sequence
tcttttttaaacatgagtga

SEQ ID NO: 26758 - DNA, 20 bp, Artificial
  CRISPR gRNA sequence
cttttttaaacatgagtgaa

SEQ ID NO: 26759 - DNA, 20 bp, Artificial
  CRISPR gRNA sequence
ttttttaaacatgagtgaaa

SEQ ID NO: 26760 - DNA, 20 bp, Artificial
  CRISPR gRNA sequence
ttttaaacatgagtgaaatt

SEQ ID NO: 26761 - DNA, 20 bp, Artificial
  CRISPR gRNA sequence
tttaaacatgagtgaaattt

SEQ ID NO: 26762 - DNA, 20 bp, Artificial
  CRISPR gRNA sequence
ttaaacatgagtgaaatttt

SEQ ID NO: 26763 - DNA, 20 bp, Artificial
  CRISPR gRNA sequence
taaacatgagtgaaattttt

SEQ ID NO: 26764 - DNA, 20 bp, Artificial
  CRISPR gRNA sequence
aaacatgagtgaaattttta

SEQ ID NO: 26765 - DNA, 20 bp, Artificial
  CRISPR gRNA sequence
aacatgagtgaaatttttaa

SEQ ID NO: 26766 - DNA, 20 bp, Artificial
  CRISPR gRNA sequence
ttaaaagtacagttggccaa

SEQ ID NO: 26767 - DNA, 20 bp, Artificial
  CRISPR gRNA sequence
taaaagtacagttggccaaa

SEQ ID NO: 26768 - DNA, 20 bp, Artificial
  CRISPR gRNA sequence
aaaagtacagttggccaaag

SEQ ID NO: 26769 - DNA, 20 bp, Artificial
  CRISPR gRNA sequence
aaagtacagttggccaaaga

SEQ ID NO: 26770 - DNA, 20 bp, Artificial
  CRISPR gRNA sequence
gccaaagaaagacatatttg

SEQ ID NO: 26771 - DNA, 20 bp, Artificial
  CRISPR gRNA sequence
gagttagatacagcctcagg

SEQ ID NO: 26772 - DNA, 20 bp, Artificial
  CRISPR gRNA sequence
agttagatacagcctcaggc

SEQ ID NO: 26773 - DNA, 20 bp, Artificial
  CRISPR gRNA sequence
gatacagcctcaggccgcta

SEQ ID NO: 26774 - DNA, 20 bp, Artificial
  CRISPR gRNA sequence
aggccgctatcttataacct

SEQ ID NO: 26775 - DNA, 20 bp, Artificial
  CRISPR gRNA sequence
tcttataacctccatcttgg

SEQ ID NO: 26776 - DNA, 20 bp, Artificial
  CRISPR gRNA sequence
ataacctccatcttgggaaa

SEQ ID NO: 26777 - DNA, 20 bp, Artificial
  CRISPR gRNA sequence
taacctccatcttgggaaac

SEQ ID NO: 26778 - DNA, 20 bp, Artificial
  CRISPR gRNA sequence
catcttgggaaactcagccc

SEQ ID NO: 26779 - DNA, 20 bp, Artificial
  CRISPR gRNA sequence
gggaaactcagcccatgaag

SEQ ID NO: 26780 - DNA, 20 bp, Artificial
  CRISPR gRNA sequence
ggaaactcagcccatgaagg

SEQ ID NO: 26781 - DNA, 20 bp, Artificial
  CRISPR gRNA sequence
agcccatgaaggctgtaagg

SEQ ID NO: 26782 - DNA, 20 bp, Artificial
  CRISPR gRNA sequence
taaggactaagtggcccaga

SEQ ID NO: 26783 - DNA, 20 bp, Artificial
  CRISPR gRNA sequence
agtggcccagagggaggggg

SEQ ID NO: 26784 - DNA, 20 bp, Artificial
  CRISPR gRNA sequence
accctaaatctggcacctgc

SEQ ID NO: 26785 - DNA, 20 bp, Artificial
  CRISPR gRNA sequence
aatctggcacctgcttctcc

SEQ ID NO: 26786 - DNA, 20 bp, Artificial
  CRISPR gRNA sequence
gcacctgcttctccatctcc

SEQ ID NO: 26787 - DNA, 20 bp, Artificial
  CRISPR gRNA sequence
cttctccatctccagagcac

SEQ ID NO: 26788 - DNA, 20 bp, Artificial
  CRISPR gRNA sequence
ctccatctccagagcacaag

SEQ ID NO: 26789 - DNA, 20 bp, Artificial
  CRISPR gRNA sequence
tccatctccagagcacaaga

SEQ ID NO: 26790 - DNA, 20 bp, Artificial
  CRISPR gRNA sequence
catctccagagcacaagacg

SEQ ID NO: 26791 - DNA, 20 bp, Artificial
  CRISPR gRNA sequence
cagagcacaagacgtccccc

SEQ ID NO: 26792 - DNA, 20 bp, Artificial
  CRISPR gRNA sequence
gagaggtctccaacaagctt

SEQ ID NO: 26793 - DNA, 20 bp, Artificial
  CRISPR gRNA sequence
caacaagcttccaaaatggc

SEQ ID NO: 26794 - DNA, 20 bp, Artificial
  CRISPR gRNA sequence
ccaaaatggcctggtgagtg

SEQ ID NO: 26795 - DNA, 20 bp, Artificial
  CRISPR gRNA sequence
caaaatggcctggtgagtga

SEQ ID NO: 26796 - DNA, 20 bp, Artificial
  CRISPR gRNA sequence
gtgagtgatgcgggatctct

SEQ ID NO: 26797 - DNA, 20 bp, Artificial
  CRISPR gRNA sequence
tctgccctgggtggtggaga

SEQ ID NO: 26798 - DNA, 20 bp, Artificial
  CRISPR gRNA sequence
tgccctgggtggtggagatg

SEQ ID NO: 26799 - DNA, 20 bp, Artificial
  CRISPR gRNA sequence
ccctgggtggtggagatgga

SEQ ID NO: 26800 - DNA, 20 bp, Artificial
  CRISPR gRNA sequence
ggtggtggagatggaagccc

SEQ ID NO: 26801 - DNA, 20 bp, Artificial
  CRISPR gRNA sequence
gcttcacattgctcattcac

SEQ ID NO: 26802 - DNA, 20 bp, Artificial
  CRISPR gRNA sequence
cacattgctcattcacttga

SEQ ID NO: 26803 - DNA, 20 bp, Artificial
  CRISPR gRNA sequence
acattgctcattcacttgac

SEQ ID NO: 26804 - DNA, 20 bp, Artificial
  CRISPR gRNA sequence
ctcattcacttgacacttat

SEQ ID NO: 26805 - DNA, 20 bp, Artificial
  CRISPR gRNA sequence
attcacttgacacttattca

SEQ ID NO: 26806 - DNA, 20 bp, Artificial
  CRISPR gRNA sequence
acttgacacttattcaaccc

SEQ ID NO: 26807 - DNA, 20 bp, Artificial
  CRISPR gRNA sequence
gacacttattcaaccccttc

SEQ ID NO: 26808 - DNA, 20 bp, Artificial
  CRISPR gRNA sequence
acacttattcaaccccttct

SEQ ID NO: 26809 - DNA, 20 bp, Artificial
  CRISPR gRNA sequence
attcaaccccttctttgttg

SEQ ID NO: 26810 - DNA, 20 bp, Artificial
  CRISPR gRNA sequence
ttcaaccccttctttgttgg

SEQ ID NO: 26811 - DNA, 20 bp, Artificial
  CRISPR gRNA sequence
aaccccttctttgttggctc

SEQ ID NO: 26812 - DNA, 20 bp, Artificial
  CRISPR gRNA sequence
ctttgttggctcacacactc

SEQ ID NO: 26813 - DNA, 20 bp, Artificial
  CRISPR gRNA sequence
tttgttggctcacacactca

SEQ ID NO: 26814 - DNA, 20 bp, Artificial
  CRISPR gRNA sequence
tgttggctcacacactcatt

SEQ ID NO: 26815 - DNA, 20 bp, Artificial
  CRISPR gRNA sequence
gttggctcacacactcattt

SEQ ID NO: 26816 - DNA, 20 bp, Artificial
  CRISPR gRNA sequence
ttggctcacacactcattta

SEQ ID NO: 26817 - DNA, 20 bp, Artificial
  CRISPR gRNA sequence
gctcacacactcatttattt

SEQ ID NO: 26818 - DNA, 20 bp, Artificial
  CRISPR gRNA sequence
acacactcatttatttattc

SEQ ID NO: 26819 - DNA, 20 bp, Artificial
  CRISPR gRNA sequence
atttatttattcattcattc

SEQ ID NO: 26820 - DNA, 20 bp, Artificial
  CRISPR gRNA sequence
atttattcattcattcattc

SEQ ID NO: 26821 - DNA, 20 bp, Artificial
  CRISPR gRNA sequence
tttattcattcattcattca

SEQ ID NO: 26822 - DNA, 20 bp, Artificial
  CRISPR gRNA sequence
attcattcattcattcattc

SEQ ID NO: 26823 - DNA, 20 bp, Artificial
  CRISPR gRNA sequence
ttcattcattcattcattca

SEQ ID NO: 26824 - DNA, 20 bp, Artificial
  CRISPR gRNA sequence
attcattcattcattcactt

SEQ ID NO: 26825 - DNA, 20 bp, Artificial
  CRISPR gRNA sequence
attcattcattcacttattt

SEQ ID NO: 26826 - DNA, 20 bp, Artificial
  CRISPR gRNA sequence
attcattcacttatttgatt

SEQ ID NO: 26827 - DNA, 20 bp, Artificial
  CRISPR gRNA sequence
attcacttatttgattatgc

SEQ ID NO: 26828 - DNA, 20 bp, Artificial
  CRISPR gRNA sequence
acttatttgattatgccatc

SEQ ID NO: 26829 - DNA, 20 bp, Artificial
  CRISPR gRNA sequence
atttgattatgccatcattt

SEQ ID NO: 26830 - DNA, 20 bp, Artificial
  CRISPR gRNA sequence
tttgattatgccatcatttc

SEQ ID NO: 26831 - DNA, 20 bp, Artificial
  CRISPR gRNA sequence
gattatgccatcatttcacc

SEQ ID NO: 26832 - DNA, 20 bp, Artificial
  CRISPR gRNA sequence
attatgccatcatttcacca

SEQ ID NO: 26833 - DNA, 20 bp, Artificial
  CRISPR gRNA sequence
tgccatcatttcaccattca

SEQ ID NO: 26834 - DNA, 20 bp, Artificial
  CRISPR gRNA sequence
caccattcactccaccactc

SEQ ID NO: 26835 - DNA, 20 bp, Artificial
  CRISPR gRNA sequence
accattcactccaccactcc

SEQ ID NO: 26836 - DNA, 20 bp, Artificial
  CRISPR gRNA sequence
actccaccactccctcaaat

SEQ ID NO: 26837 - DNA, 20 bp, Artificial
  CRISPR gRNA sequence
caccactccctcaaataata

SEQ ID NO: 26838 - DNA, 20 bp, Artificial
  CRISPR gRNA sequence
cctcaaataatatttattgc

SEQ ID NO: 26839 - DNA, 20 bp, Artificial
  CRISPR gRNA sequence
aaataatatttattgccctt

SEQ ID NO: 26840 - DNA, 20 bp, Artificial
  CRISPR gRNA sequence
attgcccttcaataagcctg

SEQ ID NO: 26841 - DNA, 20 bp, Artificial
  CRISPR gRNA sequence
ttgcccttcaataagcctgc

SEQ ID NO: 26842 - DNA, 20 bp, Artificial
  CRISPR gRNA sequence
cccttcaataagcctgcact

SEQ ID NO: 26843 - DNA, 20 bp, Artificial
  CRISPR gRNA sequence
caataagcctgcactgggtg

SEQ ID NO: 26844 - DNA, 20 bp, Artificial
  CRISPR gRNA sequence
aataagcctgcactgggtgt

SEQ ID NO: 26845 - DNA, 20 bp, Artificial
  CRISPR gRNA sequence
cactgggtgttaacacttca

SEQ ID NO: 26846 - DNA, 20 bp, Artificial
  CRISPR gRNA sequence
ggtgttaacacttcattgtc

SEQ ID NO: 26847 - DNA, 20 bp, Artificial
  CRISPR gRNA sequence
acacttcattgtcaggctga

SEQ ID NO: 26848 - DNA, 20 bp, Artificial
  CRISPR gRNA sequence
cattgtcaggctgagagaat

SEQ ID NO: 26849 - DNA, 20 bp, Artificial
  CRISPR gRNA sequence
attgtcaggctgagagaatg

SEQ ID NO: 26850 - DNA, 20 bp, Artificial
  CRISPR gRNA sequence
tcaggctgagagaatgaatg

SEQ ID NO: 26851 - DNA, 20 bp, Artificial
  CRISPR gRNA sequence
agagaatgaatgaggggcaa

SEQ ID NO: 26852 - DNA, 20 bp, Artificial
  CRISPR gRNA sequence
atgaggatgggagcaatgga

SEQ ID NO: 26853 - DNA, 20 bp, Artificial
  CRISPR gRNA sequence
ctaaattactaaatgcttac

SEQ ID NO: 26854 - DNA, 20 bp, Artificial
  CRISPR gRNA sequence
aattactaaatgcttactct

SEQ ID NO: 26855 - DNA, 20 bp, Artificial
  CRISPR gRNA sequence
ctaaatgcttactctcacat

SEQ ID NO: 26856 - DNA, 20 bp, Artificial
  CRISPR gRNA sequence
aatgcttactctcacatact

SEQ ID NO: 26857 - DNA, 20 bp, Artificial
  CRISPR gRNA sequence
actctcacatactggtctaa

SEQ ID NO: 26858 - DNA, 20 bp, Artificial
  CRISPR gRNA sequence
ctctcacatactggtctaag

SEQ ID NO: 26859 - DNA, 20 bp, Artificial
  CRISPR gRNA sequence
tcacatactggtctaagcat

SEQ ID NO: 26860 - DNA, 20 bp, Artificial
  CRISPR gRNA sequence
acatactggtctaagcatgt

SEQ ID NO: 26861 - DNA, 20 bp, Artificial
  CRISPR gRNA sequence
gtctaagcatgttaggtatg

SEQ ID NO: 26862 - DNA, 20 bp, Artificial
  CRISPR gRNA sequence
agcatgttaggtatgctaaa

SEQ ID NO: 26863 - DNA, 20 bp, Artificial
  CRISPR gRNA sequence
ggtatgctaaatcattaaca

SEQ ID NO: 26864 - DNA, 20 bp, Artificial
  CRISPR gRNA sequence
aatcattaacatctcacaca

SEQ ID NO: 26865 - DNA, 20 bp, Artificial
  CRISPR gRNA sequence
acatctcacacaatcccaat

SEQ ID NO: 26866 - DNA, 20 bp, Artificial
  CRISPR gRNA sequence
acacaatcccaatattatcc

SEQ ID NO: 26867 - DNA, 20 bp, Artificial
  CRISPR gRNA sequence
tccccattttccagatgagg

SEQ ID NO: 26868 - DNA, 20 bp, Artificial
  CRISPR gRNA sequence
tccagatgaggctactgagg

SEQ ID NO: 26869 - DNA, 20 bp, Artificial
  CRISPR gRNA sequence
ccagatgaggctactgaggc

SEQ ID NO: 26870 - DNA, 20 bp, Artificial
  CRISPR gRNA sequence
cagatgaggctactgaggca

SEQ ID NO: 26871 - DNA, 20 bp, Artificial
  CRISPR gRNA sequence
ctgaggcatggtgggatgta

SEQ ID NO: 26872 - DNA, 20 bp, Artificial
  CRISPR gRNA sequence
aggcatggtgggatgtatag

SEQ ID NO: 26873 - DNA, 20 bp, Artificial
  CRISPR gRNA sequence
agaattgctccagcaagtgg

SEQ ID NO: 26874 - DNA, 20 bp, Artificial
  CRISPR gRNA sequence
ctccagcaagtggtagaacc

SEQ ID NO: 26875 - DNA, 20 bp, Artificial
  CRISPR gRNA sequence
cagcaagtggtagaaccggg

SEQ ID NO: 26876 - DNA, 20 bp, Artificial
  CRISPR gRNA sequence
gaacccagacacgtgggctc

SEQ ID NO: 26877 - DNA, 20 bp, Artificial
  CRISPR gRNA sequence
aacccagacacgtgggctcc

SEQ ID NO: 26878 - DNA, 20 bp, Artificial
  CRISPR gRNA sequence
cactgtcttaactcttaaca

SEQ ID NO: 26879 - DNA, 20 bp, Artificial
  CRISPR gRNA sequence
tcttaactcttaacactccc

SEQ ID NO: 26880 - DNA, 20 bp, Artificial
  CRISPR gRNA sequence
aactcttaacactccctccc

SEQ ID NO: 26881 - DNA, 20 bp, Artificial
  CRISPR gRNA sequence
actcttaacactccctccca

SEQ ID NO: 26882 - DNA, 20 bp, Artificial
  CRISPR gRNA sequence
ttaacactccctcccatgac

SEQ ID NO: 26883 - DNA, 20 bp, Artificial
  CRISPR gRNA sequence
aacactccctcccatgacct

SEQ ID NO: 26884 - DNA, 20 bp, Artificial
  CRISPR gRNA sequence
acactccctcccatgacctc

SEQ ID NO: 26885 - DNA, 20 bp, Artificial
  CRISPR gRNA sequence
cctcccatgacctccccatg

SEQ ID NO: 26886 - DNA, 20 bp, Artificial
  CRISPR gRNA sequence
ccatgacctccccatggtga

SEQ ID NO: 26887 - DNA, 20 bp, Artificial
  CRISPR gRNA sequence
cccatggtgagtgagtagtg

SEQ ID NO: 26888 - DNA, 20 bp, Artificial
  CRISPR gRNA sequence
agtgagtaaatgaaggaatg

SEQ ID NO: 26889 - DNA, 20 bp, Artificial
  CRISPR gRNA sequence
gtgagtaaatgaaggaatga

SEQ ID NO: 26890 - DNA, 20 bp, Artificial
  CRISPR gRNA sequence
atgcctgtaatcccagcact

SEQ ID NO: 26891 - DNA, 20 bp, Artificial
  CRISPR gRNA sequence
tgcctgtaatcccagcactt

SEQ ID NO: 26892 - DNA, 20 bp, Artificial
  CRISPR gRNA sequence
taatcccagcactttgggag

SEQ ID NO: 26893 - DNA, 20 bp, Artificial
  CRISPR gRNA sequence
tgggaggccaaggcaggtgg

SEQ ID NO: 26894 - DNA, 20 bp, Artificial
  CRISPR gRNA sequence
gggaggccaaggcaggtgga

SEQ ID NO: 26895 - DNA, 20 bp, Artificial
  CRISPR gRNA sequence
ggaggccaaggcaggtggat

SEQ ID NO: 26896 - DNA, 20 bp, Artificial
  CRISPR gRNA sequence
aggtcaggagttcgagacca

SEQ ID NO: 26897 - DNA, 20 bp, Artificial
  CRISPR gRNA sequence
gagaccagcctggccaacat

SEQ ID NO: 26898 - DNA, 20 bp, Artificial
  CRISPR gRNA sequence
gccaacatagtgaaaccccg

SEQ ID NO: 26899 - DNA, 20 bp, Artificial
  CRISPR gRNA sequence
cattaaaaaatacaaaaatt

SEQ ID NO: 26900 - DNA, 20 bp, Artificial
  CRISPR gRNA sequence
aaaaatacaaaaattagcca

SEQ ID NO: 26901 - DNA, 20 bp, Artificial
  CRISPR gRNA sequence
gccagacgtggtagtgggtg

SEQ ID NO: 26902 - DNA, 20 bp, Artificial
  CRISPR gRNA sequence
taatcccagctacttggcag

SEQ ID NO: 26903 - DNA, 20 bp, Artificial
  CRISPR gRNA sequence
cttggcaggccgaggcagga

SEQ ID NO: 26904 - DNA, 20 bp, Artificial
  CRISPR gRNA sequence
ggcaggccgaggcaggagaa

SEQ ID NO: 26905 - DNA, 20 bp, Artificial
  CRISPR gRNA sequence
gcaggccgaggcaggagaat

SEQ ID NO: 26906 - DNA, 20 bp, Artificial
  CRISPR gRNA sequence
aacccaggaggtggaggttg

SEQ ID NO: 26907 - DNA, 20 bp, Artificial
  CRISPR gRNA sequence
ccgtgagctgagattgcgcc

SEQ ID NO: 26908 - DNA, 20 bp, Artificial
  CRISPR gRNA sequence
agattgcgccagtgcactcc

SEQ ID NO: 26909 - DNA, 20 bp, Artificial
  CRISPR gRNA sequence
cgccagtgcactccagcctg

SEQ ID NO: 26910 - DNA, 20 bp, Artificial
  CRISPR gRNA sequence
cagcctggggcacagggcag

SEQ ID NO: 26911 - DNA, 20 bp, Artificial
  CRISPR gRNA sequence
gggcacagggcaggatccat

SEQ ID NO: 26912 - DNA, 20 bp, Artificial
  CRISPR gRNA sequence
aaaaaaaaaaaagagagaaa

SEQ ID NO: 26913 - DNA, 20 bp, Artificial
  CRISPR gRNA sequence
aaaggagtggacacttaaac

SEQ ID NO: 26914 - DNA, 20 bp, Artificial
  CRISPR gRNA sequence
aaacaagagagacgatgagt

SEQ ID NO: 26915 - DNA, 20 bp, Artificial
  CRISPR gRNA sequence
aacaagagagacgatgagtg

SEQ ID NO: 26916 - DNA, 20 bp, Artificial
  CRISPR gRNA sequence
atgaatgagtggtgggtgac

SEQ ID NO: 26917 - DNA, 20 bp, Artificial
  CRISPR gRNA sequence
aatgaagcaaatgatgaaga

SEQ ID NO: 26918 - DNA, 20 bp, Artificial
  CRISPR gRNA sequence
tatgggggccagatgtggtg

SEQ ID NO: 26919 - DNA, 20 bp, Artificial
  CRISPR gRNA sequence
acacctgtaatcccagcact

SEQ ID NO: 26920 - DNA, 20 bp, Artificial
  CRISPR gRNA sequence
taatcccagcactttgggag

SEQ ID NO: 26921 - DNA, 20 bp, Artificial
  CRISPR gRNA sequence
tgggaggccaaggcggaacg

SEQ ID NO: 26922 - DNA, 20 bp, Artificial
  CRISPR gRNA sequence
gggaggccaaggcggaacga

SEQ ID NO: 26923 - DNA, 20 bp, Artificial
  CRISPR gRNA sequence
ggaggccaaggcggaacgat

SEQ ID NO: 26924 - DNA, 20 bp, Artificial
  CRISPR gRNA sequence
cttgagcccaggagctcaag

SEQ ID NO: 26925 - DNA, 20 bp, Artificial
  CRISPR gRNA sequence
gagcccaggagctcaagacc

SEQ ID NO: 26926 - DNA, 20 bp, Artificial
  CRISPR gRNA sequence
agcccaggagctcaagacca

SEQ ID NO: 26927 - DNA, 20 bp, Artificial
  CRISPR gRNA sequence
aagaccagcctgggcaaaat

SEQ ID NO: 26928 - DNA, 20 bp, Artificial
  CRISPR gRNA sequence
ggcaaaatagtgagaactta

SEQ ID NO: 26929 - DNA, 20 bp, Artificial
  CRISPR gRNA sequence
atctccacaaaaaaacaaaa

SEQ ID NO: 26930 - DNA, 20 bp, Artificial
  CRISPR gRNA sequence
tctccacaaaaaaacaaaaa

SEQ ID NO: 26931 - DNA, 20 bp, Artificial
  CRISPR gRNA sequence
cacaaaaaaacaaaaaagaa

SEQ ID NO: 26932 - DNA, 20 bp, Artificial
  CRISPR gRNA sequence
gccaggcatggcagtgggcg

SEQ ID NO: 26933 - DNA, 20 bp, Artificial
  CRISPR gRNA sequence
tagtcccagctactcaggag

SEQ ID NO: 26934 - DNA, 20 bp, Artificial
  CRISPR gRNA sequence
ctcaggaggctgaggtggga

SEQ ID NO: 26935 - DNA, 20 bp, Artificial
  CRISPR gRNA sequence
aggaggctgaggtgggagga

SEQ ID NO: 26936 - DNA, 20 bp, Artificial
  CRISPR gRNA sequence
aggtgggaggattgcttgag

SEQ ID NO: 26937 - DNA, 20 bp, Artificial
  CRISPR gRNA sequence
cttgagcctgtgaggttgaa

SEQ ID NO: 26938 - DNA, 20 bp, Artificial
  CRISPR gRNA sequence
gagcctgtgaggttgaagct

SEQ ID NO: 26939 - DNA, 20 bp, Artificial
  CRISPR gRNA sequence
agcctgtgaggttgaagctg

SEQ ID NO: 26940 - DNA, 20 bp, Artificial
  CRISPR gRNA sequence
tgaggttgaagctgtggtgg

SEQ ID NO: 26941 - DNA, 20 bp, Artificial
  CRISPR gRNA sequence
aagctgtggtggaccatgat

SEQ ID NO: 26942 - DNA, 20 bp, Artificial
  CRISPR gRNA sequence
tggtggaccatgattgtgcc

SEQ ID NO: 26943 - DNA, 20 bp, Artificial
  CRISPR gRNA sequence
tgccattgcacgccagcctg

SEQ ID NO: 26944 - DNA, 20 bp, Artificial
  CRISPR gRNA sequence
cacgccagcctgggcgacat

SEQ ID NO: 26945 - DNA, 20 bp, Artificial
  CRISPR gRNA sequence
ggcgacatagtgagacccca

SEQ ID NO: 26946 - DNA, 20 bp, Artificial
  CRISPR gRNA sequence
tacaaaaaaatcaaaaaatt

SEQ ID NO: 26947 - DNA, 20 bp, Artificial
  CRISPR gRNA sequence
caaaaaaatcaaaaaattat

SEQ ID NO: 26948 - DNA, 20 bp, Artificial
  CRISPR gRNA sequence
tctgggcatggtgtcacatg

SEQ ID NO: 26949 - DNA, 20 bp, Artificial
  CRISPR gRNA sequence
ggcatggtgtcacatgtctg

SEQ ID NO: 26950 - DNA, 20 bp, Artificial
  CRISPR gRNA sequence
tggtcccagctacttgggag

SEQ ID NO: 26951 - DNA, 20 bp, Artificial
  CRISPR gRNA sequence
cttgggaggtggagtcagga

SEQ ID NO: 26952 - DNA, 20 bp, Artificial
  CRISPR gRNA sequence
gggaggtggagtcaggagga

SEQ ID NO: 26953 - DNA, 20 bp, Artificial
  CRISPR gRNA sequence
ggaggtggagtcaggaggat

SEQ ID NO: 26954 - DNA, 20 bp, Artificial
  CRISPR gRNA sequence
aggttgcagcgagctgtgat

SEQ ID NO: 26955 - DNA, 20 bp, Artificial
  CRISPR gRNA sequence
cagcgagctgtgatcacacc

SEQ ID NO: 26956 - DNA, 20 bp, Artificial
  CRISPR gRNA sequence
tgatcacaccactgcattcc

SEQ ID NO: 26957 - DNA, 20 bp, Artificial
  CRISPR gRNA sequence
cattccagcctgggcaaaaa

SEQ ID NO: 26958 - DNA, 20 bp, Artificial
  CRISPR gRNA sequence
cagcctgggcaaaaaagcca

SEQ ID NO: 26959 - DNA, 20 bp, Artificial
  CRISPR gRNA sequence
ggcaaaaaagccagaccctg

SEQ ID NO: 26960 - DNA, 20 bp, Artificial
  CRISPR gRNA sequence
tctcaaaacaaaacaaaaca

SEQ ID NO: 26961 - DNA, 20 bp, Artificial
  CRISPR gRNA sequence
aaaacaaaacaaaacaaaca

SEQ ID NO: 26962 - DNA, 20 bp, Artificial
  CRISPR gRNA sequence
tgtggggaacagatgtaaat

SEQ ID NO: 26963 - DNA, 20 bp, Artificial
  CRISPR gRNA sequence
gccttgtggtggctggccct

SEQ ID NO: 26964 - DNA, 20 bp, Artificial
  CRISPR gRNA sequence
gtggtggctggccctggccc

SEQ ID NO: 26965 - DNA, 20 bp, Artificial
  CRISPR gRNA sequence
tggtggctggccctggccct

SEQ ID NO: 26966 - DNA, 20 bp, Artificial
  CRISPR gRNA sequence
gccctggccctgcctctcac

SEQ ID NO: 26967 - DNA, 20 bp, Artificial
  CRISPR gRNA sequence
gccctgcctctcacataccc

SEQ ID NO: 26968 - DNA, 20 bp, Artificial
  CRISPR gRNA sequence
cctctcacatacccccaccc

SEQ ID NO: 26969 - DNA, 20 bp, Artificial
  CRISPR gRNA sequence
tcacatacccccaccctgac

SEQ ID NO: 26970 - DNA, 20 bp, Artificial
  CRISPR gRNA sequence
acatacccccaccctgacac

SEQ ID NO: 26971 - DNA, 20 bp, Artificial
  CRISPR gRNA sequence
acacgcccctggcctttgca

SEQ ID NO: 26972 - DNA, 20 bp, Artificial
  CRISPR gRNA sequence
gcctttgcagagccggtgga

SEQ ID NO: 26973 - DNA, 20 bp, Artificial
  CRISPR gRNA sequence
tgcagagccggtggagcagt

SEQ ID NO: 26974 - DNA, 20 bp, Artificial
  CRISPR gRNA sequence
gcagagccggtggagcagtt

SEQ ID NO: 26975 - DNA, 20 bp, Artificial
  CRISPR gRNA sequence
cagagccggtggagcagttc

SEQ ID NO: 26976 - DNA, 20 bp, Artificial
  CRISPR gRNA sequence
taccgctcactgcaggacac

SEQ ID NO: 26977 - DNA, 20 bp, Artificial
  CRISPR gRNA sequence
ccgctcactgcaggacacgt

SEQ ID NO: 26978 - DNA, 20 bp, Artificial
  CRISPR gRNA sequence
actgcaggacacgtatggtg

SEQ ID NO: 26979 - DNA, 20 bp, Artificial
  CRISPR gRNA sequence
caggacacgtatggtgccga

SEQ ID NO: 26980 - DNA, 20 bp, Artificial
  CRISPR gRNA sequence
gtggaggtggatctggtgca

SEQ ID NO: 26981 - DNA, 20 bp, Artificial
  CRISPR gRNA sequence
gtgcaggccaggctggagag

SEQ ID NO: 26982 - DNA, 20 bp, Artificial
  CRISPR gRNA sequence
gagaggagcagcagcaagag

SEQ ID NO: 26983 - DNA, 20 bp, Artificial
  CRISPR gRNA sequence
gagcgggaactggccacccc

SEQ ID NO: 26984 - DNA, 20 bp, Artificial
  CRISPR gRNA sequence
gccaccccggactgggcaga

SEQ ID NO: 26985 - DNA, 20 bp, Artificial
  CRISPR gRNA sequence
ggcagaacggcagctggccc

SEQ ID NO: 26986 - DNA, 20 bp, Artificial
  CRISPR gRNA sequence
gcccaaggaggcctggctga

SEQ ID NO: 26987 - DNA, 20 bp, Artificial
  CRISPR gRNA sequence
gctgaggtgctgttggctgc

SEQ ID NO: 26988 - DNA, 20 bp, Artificial
  CRISPR gRNA sequence
aggtgctgttggctgccaag

SEQ ID NO: 26989 - DNA, 20 bp, Artificial
  CRISPR gRNA sequence
ttggctgccaaggagcaccg

SEQ ID NO: 26990 - DNA, 20 bp, Artificial
  CRISPR gRNA sequence
gctgccaaggagcaccggcg

SEQ ID NO: 26991 - DNA, 20 bp, Artificial
  CRISPR gRNA sequence
ccaaggagcaccggcggccg

SEQ ID NO: 26992 - DNA, 20 bp, Artificial
  CRISPR gRNA sequence
ctgtgctgggcaaagctggt

SEQ ID NO: 26993 - DNA, 20 bp, Artificial
  CRISPR gRNA sequence
tgctgggcaaagctggtcag

SEQ ID NO: 26994 - DNA, 20 bp, Artificial
  CRISPR gRNA sequence
ggcaaagctggtcagggcaa

SEQ ID NO: 26995 - DNA, 20 bp, Artificial
  CRISPR gRNA sequence
gtcagggcaagagctattgg

SEQ ID NO: 26996 - DNA, 20 bp, Artificial
  CRISPR gRNA sequence
ttgggctggggcagtgagcc

SEQ ID NO: 26997 - DNA, 20 bp, Artificial
  CRISPR gRNA sequence
ggctggggcagtgagccggg

SEQ ID NO: 26998 - DNA, 20 bp, Artificial
  CRISPR gRNA sequence
gggcagtgagccgggcctgg

SEQ ID NO: 26999 - DNA, 20 bp, Artificial
  CRISPR gRNA sequence
ggcttgtggccggcttcccc

SEQ ID NO: 27000 - DNA, 20 bp, Artificial
  CRISPR gRNA sequence
gtggccggcttccccagtac

SEQ ID NO: 27001 - DNA, 20 bp, Artificial
  CRISPR gRNA sequence
tggccggcttccccagtacg

SEQ ID NO: 27002 - DNA, 20 bp, Artificial
  CRISPR gRNA sequence
ccccagtacgactttgtctt

SEQ ID NO: 27003 - DNA, 20 bp, Artificial
  CRISPR gRNA sequence
cccagtacgactttgtcttc

SEQ ID NO: 27004 - DNA, 20 bp, Artificial
  CRISPR gRNA sequence
tgtcttctctgtcccctgcc

SEQ ID NO: 27005 - DNA, 20 bp, Artificial
  CRISPR gRNA sequence
gtcttctctgtcccctgcca

SEQ ID NO: 27006 - DNA, 20 bp, Artificial
  CRISPR gRNA sequence
tcttctctgtcccctgccat

SEQ ID NO: 27007 - DNA, 20 bp, Artificial
  CRISPR gRNA sequence
ctctgtcccctgccattgct

SEQ ID NO: 27008 - DNA, 20 bp, Artificial
  CRISPR gRNA sequence
tctgtcccctgccattgctt

SEQ ID NO: 27009 - DNA, 20 bp, Artificial
  CRISPR gRNA sequence
tgtcccctgccattgcttga

SEQ ID NO: 27010 - DNA, 20 bp, Artificial
  CRISPR gRNA sequence
tcccctgccattgcttgaac

SEQ ID NO: 27011 - DNA, 20 bp, Artificial
  CRISPR gRNA sequence
ccattgcttgaaccgtccgg

SEQ ID NO: 27012 - DNA, 20 bp, Artificial
  CRISPR gRNA sequence
cttgaaccgtccgggggatg

SEQ ID NO: 27013 - DNA, 20 bp, Artificial
  CRISPR gRNA sequence
gaaccgtccgggggatgcct

SEQ ID NO: 27014 - DNA, 20 bp, Artificial
  CRISPR gRNA sequence
aaccgtccgggggatgccta

SEQ ID NO: 27015 - DNA, 20 bp, Artificial
  CRISPR gRNA sequence
tggcctgcaggatctgctct

SEQ ID NO: 27016 - DNA, 20 bp, Artificial
  CRISPR gRNA sequence
caggatctgctcttctccct

SEQ ID NO: 27017 - DNA, 20 bp, Artificial
  CRISPR gRNA sequence
ctcttctccctgggcccaca

SEQ ID NO: 27018 - DNA, 20 bp, Artificial
  CRISPR gRNA sequence
ttctccctgggcccacagcc

SEQ ID NO: 27019 - DNA, 20 bp, Artificial
  CRISPR gRNA sequence
ctccctgggcccacagccac

SEQ ID NO: 27020 - DNA, 20 bp, Artificial
  CRISPR gRNA sequence
tccctgggcccacagccact

SEQ ID NO: 27021 - DNA, 20 bp, Artificial
  CRISPR gRNA sequence
cctgggcccacagccactcg

SEQ ID NO: 27022 - DNA, 20 bp, Artificial
  CRISPR gRNA sequence
ggcccacagccactcgtggc

SEQ ID NO: 27023 - DNA, 20 bp, Artificial
  CRISPR gRNA sequence
gtggcggccgatgaggtttt

SEQ ID NO: 27024 - DNA, 20 bp, Artificial
  CRISPR gRNA sequence
tcagccacatcttgaagaga

SEQ ID NO: 27025 - DNA, 20 bp, Artificial
  CRISPR gRNA sequence
cagccacatcttgaagagac

SEQ ID NO: 27026 - DNA, 20 bp, Artificial
  CRISPR gRNA sequence
agccacatcttgaagagacc

SEQ ID NO: 27027 - DNA, 20 bp, Artificial
  CRISPR gRNA sequence
gaagagacctgaccgcgttc

SEQ ID NO: 27028 - DNA, 20 bp, Artificial
  CRISPR gRNA sequence
aagagacctgaccgcgttct

SEQ ID NO: 27029 - DNA, 20 bp, Artificial
  CRISPR gRNA sequence
accgcgttctgctcatccta

SEQ ID NO: 27030 - DNA, 20 bp, Artificial
  CRISPR gRNA sequence
tgctcatcctagacggcttc

SEQ ID NO: 27031 - DNA, 20 bp, Artificial
  CRISPR gRNA sequence
ctcatcctagacggcttcga

SEQ ID NO: 27032 - DNA, 20 bp, Artificial
  CRISPR gRNA sequence
atcctagacggcttcgagga

SEQ ID NO: 27033 - DNA, 20 bp, Artificial
  CRISPR gRNA sequence
gacggcttcgaggagctgga

SEQ ID NO: 27034 - DNA, 20 bp, Artificial
  CRISPR gRNA sequence
cgaggagctggaagcgcaag

SEQ ID NO: 27035 - DNA, 20 bp, Artificial
  CRISPR gRNA sequence
gaggagctggaagcgcaaga

SEQ ID NO: 27036 - DNA, 20 bp, Artificial
  CRISPR gRNA sequence
gaagcgcaagatggcttcct

SEQ ID NO: 27037 - DNA, 20 bp, Artificial
  CRISPR gRNA sequence
cctgcacagcacgtgcggac

SEQ ID NO: 27038 - DNA, 20 bp, Artificial
  CRISPR gRNA sequence
ctgcacagcacgtgcggacc

SEQ ID NO: 27039 - DNA, 20 bp, Artificial
  CRISPR gRNA sequence
cacagcacgtgcggaccggc

SEQ ID NO: 27040 - DNA, 20 bp, Artificial
  CRISPR gRNA sequence
ctccctccgggggctgctgg

SEQ ID NO: 27041 - DNA, 20 bp, Artificial
  CRISPR gRNA sequence
cctccgggggctgctggccg

SEQ ID NO: 27042 - DNA, 20 bp, Artificial
  CRISPR gRNA sequence
cgggggctgctggccggcct

SEQ ID NO: 27043 - DNA, 20 bp, Artificial
  CRISPR gRNA sequence
ctggccggccttttccagaa

SEQ ID NO: 27044 - DNA, 20 bp, Artificial
  CRISPR gRNA sequence
gccggccttttccagaagaa

SEQ ID NO: 27045 - DNA, 20 bp, Artificial
  CRISPR gRNA sequence
ttccagaagaagctgctccg

SEQ ID NO: 27046 - DNA, 20 bp, Artificial
  CRISPR gRNA sequence
tccagaagaagctgctccga

SEQ ID NO: 27047 - DNA, 20 bp, Artificial
  CRISPR gRNA sequence
ccagaagaagctgctccgag

SEQ ID NO: 27048 - DNA, 20 bp, Artificial
  CRISPR gRNA sequence
cagaagaagctgctccgagg

SEQ ID NO: 27049 - DNA, 20 bp, Artificial
  CRISPR gRNA sequence
ctccgaggttgcaccctcct

SEQ ID NO: 27050 - DNA, 20 bp, Artificial
  CRISPR gRNA sequence
cgaggttgcaccctcctcct

SEQ ID NO: 27051 - DNA, 20 bp, Artificial
  CRISPR gRNA sequence
caccctcctcctcacagccc

SEQ ID NO: 27052 - DNA, 20 bp, Artificial
  CRISPR gRNA sequence
ctcctcacagcccggccccg

SEQ ID NO: 27053 - DNA, 20 bp, Artificial
  CRISPR gRNA sequence
ctcacagcccggccccgggg

SEQ ID NO: 27054 - DNA, 20 bp, Artificial
  CRISPR gRNA sequence
acagcccggccccggggccg

SEQ ID NO: 27055 - DNA, 20 bp, Artificial
  CRISPR gRNA sequence
gtccagagcctgagcaaggc

SEQ ID NO: 27056 - DNA, 20 bp, Artificial
  CRISPR gRNA sequence
agcaaggccgacgccctatt

SEQ ID NO: 27057 - DNA, 20 bp, Artificial
  CRISPR gRNA sequence
tttgagctgtccggcttctc

SEQ ID NO: 27058 - DNA, 20 bp, Artificial
  CRISPR gRNA sequence
gagctgtccggcttctccat

SEQ ID NO: 27059 - DNA, 20 bp, Artificial
  CRISPR gRNA sequence
agctgtccggcttctccatg

SEQ ID NO: 27060 - DNA, 20 bp, Artificial
  CRISPR gRNA sequence
tccggcttctccatggagca

SEQ ID NO: 27061 - DNA, 20 bp, Artificial
  CRISPR gRNA sequence
ctccatggagcaggcccagg

SEQ ID NO: 27062 - DNA, 20 bp, Artificial
  CRISPR gRNA sequence
tccatggagcaggcccaggc

SEQ ID NO: 27063 - DNA, 20 bp, Artificial
  CRISPR gRNA sequence
catggagcaggcccaggcat

SEQ ID NO: 27064 - DNA, 20 bp, Artificial
  CRISPR gRNA sequence
ctttgagagctcagggatga

SEQ ID NO: 27065 - DNA, 20 bp, Artificial
  CRISPR gRNA sequence
tgagagctcagggatgacag

SEQ ID NO: 27066 - DNA, 20 bp, Artificial
  CRISPR gRNA sequence
gagagctcagggatgacaga

SEQ ID NO: 27067 - DNA, 20 bp, Artificial
  CRISPR gRNA sequence
agagctcagggatgacagag

SEQ ID NO: 27068 - DNA, 20 bp, Artificial
  CRISPR gRNA sequence
agggatgacagagcaccaag

SEQ ID NO: 27069 - DNA, 20 bp, Artificial
  CRISPR gRNA sequence
acgctcctccgggaccggcc

SEQ ID NO: 27070 - DNA, 20 bp, Artificial
  CRISPR gRNA sequence
ctccgggaccggccacttct

SEQ ID NO: 27071 - DNA, 20 bp, Artificial
  CRISPR gRNA sequence
cgggaccggccacttcttct

SEQ ID NO: 27072 - DNA, 20 bp, Artificial
  CRISPR gRNA sequence
cttctcagtcacagccacag

SEQ ID NO: 27073 - DNA, 20 bp, Artificial
  CRISPR gRNA sequence
ttctcagtcacagccacagc

SEQ ID NO: 27074 - DNA, 20 bp, Artificial
  CRISPR gRNA sequence
ctcagtcacagccacagccc

SEQ ID NO: 27075 - DNA, 20 bp, Artificial
  CRISPR gRNA sequence
tcagtcacagccacagccct

SEQ ID NO: 27076 - DNA, 20 bp, Artificial
  CRISPR gRNA sequence
agtcacagccacagccctac

SEQ ID NO: 27077 - DNA, 20 bp, Artificial
  CRISPR gRNA sequence
ctttgtgccgggcagtgtgc

SEQ ID NO: 27078 - DNA, 20 bp, Artificial
  CRISPR gRNA sequence
tgtgccgggcagtgtgccag

SEQ ID NO: 27079 - DNA, 20 bp, Artificial
  CRISPR gRNA sequence
gtgccgggcagtgtgccagc

SEQ ID NO: 27080 - DNA, 20 bp, Artificial
  CRISPR gRNA sequence
tgccgggcagtgtgccagct

SEQ ID NO: 27081 - DNA, 20 bp, Artificial
  CRISPR gRNA sequence
tcagaggccctgctggagct

SEQ ID NO: 27082 - DNA, 20 bp, Artificial
  CRISPR gRNA sequence
agaggccctgctggagcttg

SEQ ID NO: 27083 - DNA, 20 bp, Artificial
  CRISPR gRNA sequence
ctggagcttggggaggacgc

SEQ ID NO: 27084 - DNA, 20 bp, Artificial
  CRISPR gRNA sequence
gagcttggggaggacgccaa

SEQ ID NO: 27085 - DNA, 20 bp, Artificial
  CRISPR gRNA sequence
ggggaggacgccaagctgcc

SEQ ID NO: 27086 - DNA, 20 bp, Artificial
  CRISPR gRNA sequence
gggaggacgccaagctgccc

SEQ ID NO: 27087 - DNA, 20 bp, Artificial
  CRISPR gRNA sequence
ccctccacgctcacgggact

SEQ ID NO: 27088 - DNA, 20 bp, Artificial
  CRISPR gRNA sequence
cacgctcacgggactctatg

SEQ ID NO: 27089 - DNA, 20 bp, Artificial
  CRISPR gRNA sequence
acgggactctatgtcggcct

SEQ ID NO: 27090 - DNA, 20 bp, Artificial
  CRISPR gRNA sequence
tatgtcggcctgctgggccg

SEQ ID NO: 27091 - DNA, 20 bp, Artificial
  CRISPR gRNA sequence
tgtcggcctgctgggccgtg

SEQ ID NO: 27092 - DNA, 20 bp, Artificial
  CRISPR gRNA sequence
ctgggccgtgcagccctcga

SEQ ID NO: 27093 - DNA, 20 bp, Artificial
  CRISPR gRNA sequence
ggccgtgcagccctcgacag

SEQ ID NO: 27094 - DNA, 20 bp, Artificial
  CRISPR gRNA sequence
gacagcccccccggggccct

SEQ ID NO: 27095 - DNA, 20 bp, Artificial
  CRISPR gRNA sequence
gcagagctggccaagctggc

SEQ ID NO: 27096 - DNA, 20 bp, Artificial
  CRISPR gRNA sequence
gccaagctggcctgggagct

SEQ ID NO: 27097 - DNA, 20 bp, Artificial
  CRISPR gRNA sequence
gcctgggagctgggccgcag

SEQ ID NO: 27098 - DNA, 20 bp, Artificial
  CRISPR gRNA sequence
ggagctgggccgcagacatc

SEQ ID NO: 27099 - DNA, 20 bp, Artificial
  CRISPR gRNA sequence
ggccgcagacatcaaagtac

SEQ ID NO: 27100 - DNA, 20 bp, Artificial
  CRISPR gRNA sequence
caggaggaccagttcccatc

SEQ ID NO: 27101 - DNA, 20 bp, Artificial
  CRISPR gRNA sequence
ccatccgcagacgtgaggac

SEQ ID NO: 27102 - DNA, 20 bp, Artificial
  CRISPR gRNA sequence
ggcgatggccaaaggcttag

SEQ ID NO: 27103 - DNA, 20 bp, Artificial
  CRISPR gRNA sequence
agtccaacacccaccgcggg

SEQ ID NO: 27104 - DNA, 20 bp, Artificial
  CRISPR gRNA sequence
gtccaacacccaccgcgggc

SEQ ID NO: 27105 - DNA, 20 bp, Artificial
  CRISPR gRNA sequence
gccttccccagcttcctcct

SEQ ID NO: 27106 - DNA, 20 bp, Artificial
  CRISPR gRNA sequence
ccccagcttcctcctgcaat

SEQ ID NO: 27107 - DNA, 20 bp, Artificial
  CRISPR gRNA sequence
cccagcttcctcctgcaatg

SEQ ID NO: 27108 - DNA, 20 bp, Artificial
  CRISPR gRNA sequence
cctcctgcaatgcttcctgg

SEQ ID NO: 27109 - DNA, 20 bp, Artificial
  CRISPR gRNA sequence
ctcctgcaatgcttcctggg

SEQ ID NO: 27110 - DNA, 20 bp, Artificial
  CRISPR gRNA sequence
ctgcaatgcttcctgggggc

SEQ ID NO: 27111 - DNA, 20 bp, Artificial
  CRISPR gRNA sequence
caatgcttcctgggggccct

SEQ ID NO: 27112 - DNA, 20 bp, Artificial
  CRISPR gRNA sequence
cctgggggccctgtggctgg

SEQ ID NO: 27113 - DNA, 20 bp, Artificial
  CRISPR gRNA sequence
ctgggggccctgtggctggc

SEQ ID NO: 27114 - DNA, 20 bp, Artificial
  CRISPR gRNA sequence
ggggccctgtggctggctct

SEQ ID NO: 27115 - DNA, 20 bp, Artificial
  CRISPR gRNA sequence
tggctggctctgagtggcga

SEQ ID NO: 27116 - DNA, 20 bp, Artificial
  CRISPR gRNA sequence
gctctgagtggcgaaatcaa

SEQ ID NO: 27117 - DNA, 20 bp, Artificial
  CRISPR gRNA sequence
tgagtggcgaaatcaaggac

SEQ ID NO: 27118 - DNA, 20 bp, Artificial
  CRISPR gRNA sequence
agtggcgaaatcaaggacaa

SEQ ID NO: 27119 - DNA, 20 bp, Artificial
  CRISPR gRNA sequence
ccgcagtacctagcattgac

SEQ ID NO: 27120 - DNA, 20 bp, Artificial
  CRISPR gRNA sequence
gcattgaccccaaggaagaa

SEQ ID NO: 27121 - DNA, 20 bp, Artificial
  CRISPR gRNA sequence
accccaaggaagaagaggcc

SEQ ID NO: 27122 - DNA, 20 bp, Artificial
  CRISPR gRNA sequence
tgacaactggctggagggcg

SEQ ID NO: 27123 - DNA, 20 bp, Artificial
  CRISPR gRNA sequence
gctggagggcgtgccacgct

SEQ ID NO: 27124 - DNA, 20 bp, Artificial
  CRISPR gRNA sequence
gagggcgtgccacgctttct

SEQ ID NO: 27125 - DNA, 20 bp, Artificial
  CRISPR gRNA sequence
tctggctgggctgatcttcc

SEQ ID NO: 27126 - DNA, 20 bp, Artificial
  CRISPR gRNA sequence
ctggctgggctgatcttcca

SEQ ID NO: 27127 - DNA, 20 bp, Artificial
  CRISPR gRNA sequence
tggctgggctgatcttccag

SEQ ID NO: 27128 - DNA, 20 bp, Artificial
  CRISPR gRNA sequence
gctgggctgatcttccagcc

SEQ ID NO: 27129 - DNA, 20 bp, Artificial
  CRISPR gRNA sequence
ggctgatcttccagcctccc

SEQ ID NO: 27130 - DNA, 20 bp, Artificial
  CRISPR gRNA sequence
atcttccagcctcccgcccg

SEQ ID NO: 27131 - DNA, 20 bp, Artificial
  CRISPR gRNA sequence
ccagcctcccgcccgctgcc

SEQ ID NO: 27132 - DNA, 20 bp, Artificial
  CRISPR gRNA sequence
cagcctcccgcccgctgcct

SEQ ID NO: 27133 - DNA, 20 bp, Artificial
  CRISPR gRNA sequence
ccgcccgctgcctgggagcc

SEQ ID NO: 27134 - DNA, 20 bp, Artificial
  CRISPR gRNA sequence
cctgggagccctactcgggc

SEQ ID NO: 27135 - DNA, 20 bp, Artificial
  CRISPR gRNA sequence
ggagccctactcgggccatc

SEQ ID NO: 27136 - DNA, 20 bp, Artificial
  CRISPR gRNA sequence
ctcgggccatcggcggctgc

SEQ ID NO: 27137 - DNA, 20 bp, Artificial
  CRISPR gRNA sequence
gggccatcggcggctgcctc

SEQ ID NO: 27138 - DNA, 20 bp, Artificial
  CRISPR gRNA sequence
cctcggtggacaggaagcag

SEQ ID NO: 27139 - DNA, 20 bp, Artificial
  CRISPR gRNA sequence
ggtggacaggaagcagaagg

SEQ ID NO: 27140 - DNA, 20 bp, Artificial
  CRISPR gRNA sequence
gcgaggtacctgaagcggct

SEQ ID NO: 27141 - DNA, 20 bp, Artificial
  CRISPR gRNA sequence
cgaggtacctgaagcggctg

SEQ ID NO: 27142 - DNA, 20 bp, Artificial
  CRISPR gRNA sequence
aagcggctgcagccggggac

SEQ ID NO: 27143 - DNA, 20 bp, Artificial
  CRISPR gRNA sequence
cagccggggacactgcgggc

SEQ ID NO: 27144 - DNA, 20 bp, Artificial
  CRISPR gRNA sequence
cgggcgcggcagctgctgga

SEQ ID NO: 27145 - DNA, 20 bp, Artificial
  CRISPR gRNA sequence
ctggagctgctgcactgcgc

SEQ ID NO: 27146 - DNA, 20 bp, Artificial
  CRISPR gRNA sequence
gagctgctgcactgcgccca

SEQ ID NO: 27147 - DNA, 20 bp, Artificial
  CRISPR gRNA sequence
ctgcactgcgcccacgaggc

SEQ ID NO: 27148 - DNA, 20 bp, Artificial
  CRISPR gRNA sequence
cactgcgcccacgaggccga

SEQ ID NO: 27149 - DNA, 20 bp, Artificial
  CRISPR gRNA sequence
cgcccacgaggccgaggagg

SEQ ID NO: 27150 - DNA, 20 bp, Artificial
  CRISPR gRNA sequence
gaatttggcagcacgtggta

SEQ ID NO: 27151 - DNA, 20 bp, Artificial
  CRISPR gRNA sequence
ggcagcacgtggtacaggag

SEQ ID NO: 27152 - DNA, 20 bp, Artificial
  CRISPR gRNA sequence
gcagcacgtggtacaggagc

SEQ ID NO: 27153 - DNA, 20 bp, Artificial
  CRISPR gRNA sequence
cccggccgcctctcttttct

SEQ ID NO: 27154 - DNA, 20 bp, Artificial
  CRISPR gRNA sequence
tcttttctgggcacccgcct

SEQ ID NO: 27155 - DNA, 20 bp, Artificial
  CRISPR gRNA sequence
ttttctgggcacccgcctca

SEQ ID NO: 27156 - DNA, 20 bp, Artificial
  CRISPR gRNA sequence
ttctgggcacccgcctcacg

SEQ ID NO: 27157 - DNA, 20 bp, Artificial
  CRISPR gRNA sequence
tctgggcacccgcctcacgc

SEQ ID NO: 27158 - DNA, 20 bp, Artificial
  CRISPR gRNA sequence
ctgggcacccgcctcacgcc

SEQ ID NO: 27159 - DNA, 20 bp, Artificial
  CRISPR gRNA sequence
tgggcacccgcctcacgcct

SEQ ID NO: 27160 - DNA, 20 bp, Artificial
  CRISPR gRNA sequence
ggcacccgcctcacgcctcc

SEQ ID NO: 27161 - DNA, 20 bp, Artificial
  CRISPR gRNA sequence
acgcctcctgatgcacatgt

SEQ ID NO: 27162 - DNA, 20 bp, Artificial
  CRISPR gRNA sequence
ctgatgcacatgtactgggc

SEQ ID NO: 27163 - DNA, 20 bp, Artificial
  CRISPR gRNA sequence
atgcacatgtactgggcaag

SEQ ID NO: 27164 - DNA, 20 bp, Artificial
  CRISPR gRNA sequence
ggcaaggccttggaggcggc

SEQ ID NO: 27165 - DNA, 20 bp, Artificial
  CRISPR gRNA sequence
ggaggcggcgggccaagact

SEQ ID NO: 27166 - DNA, 20 bp, Artificial
  CRISPR gRNA sequence
gaggcggcgggccaagactt

SEQ ID NO: 27167 - DNA, 20 bp, Artificial
  CRISPR gRNA sequence
ctccctggacctccgcagca

SEQ ID NO: 27168 - DNA, 20 bp, Artificial
  CRISPR gRNA sequence
tccctggacctccgcagcac

SEQ ID NO: 27169 - DNA, 20 bp, Artificial
  CRISPR gRNA sequence
cctggacctccgcagcactg

SEQ ID NO: 27170 - DNA, 20 bp, Artificial
  CRISPR gRNA sequence
gacctccgcagcactggcat

SEQ ID NO: 27171 - DNA, 20 bp, Artificial
  CRISPR gRNA sequence
cgcagcactggcatttgccc

SEQ ID NO: 27172 - DNA, 20 bp, Artificial
  CRISPR gRNA sequence
gcatttgcccctctggattg

SEQ ID NO: 27173 - DNA, 20 bp, Artificial
  CRISPR gRNA sequence
gcccctctggattggggagc

SEQ ID NO: 27174 - DNA, 20 bp, Artificial
  CRISPR gRNA sequence
cccctctggattggggagcc

SEQ ID NO: 27175 - DNA, 20 bp, Artificial
  CRISPR gRNA sequence
tggattggggagcctcgtgg

SEQ ID NO: 27176 - DNA, 20 bp, Artificial
  CRISPR gRNA sequence
gattggggagcctcgtggga

SEQ ID NO: 27177 - DNA, 20 bp, Artificial
  CRISPR gRNA sequence
gggagcctcgtgggactcag

SEQ ID NO: 27178 - DNA, 20 bp, Artificial
  CRISPR gRNA sequence
gtgggactcagctgtgtcac

SEQ ID NO: 27179 - DNA, 20 bp, Artificial
  CRISPR gRNA sequence
agctgtgtcacccgtttcag

SEQ ID NO: 27180 - DNA, 20 bp, Artificial
  CRISPR gRNA sequence
tgtcacccgtttcaggtggg

SEQ ID NO: 27181 - DNA, 20 bp, Artificial
  CRISPR gRNA sequence
caggtggggtgaggggcttg

SEQ ID NO: 27182 - DNA, 20 bp, Artificial
  CRISPR gRNA sequence
aggtggggtgaggggcttgg

SEQ ID NO: 27183 - DNA, 20 bp, Artificial
  CRISPR gRNA sequence
ggggaagagacatccttgtg

SEQ ID NO: 27184 - DNA, 20 bp, Artificial
  CRISPR gRNA sequence
gggaagagacatccttgtgt

SEQ ID NO: 27185 - DNA, 20 bp, Artificial
  CRISPR gRNA sequence
gtgttgggcattaactgcgg

SEQ ID NO: 27186 - DNA, 20 bp, Artificial
  CRISPR gRNA sequence
tgttgggcattaactgcggt

SEQ ID NO: 27187 - DNA, 20 bp, Artificial
  CRISPR gRNA sequence
ggcattaactgcggtcttgg

SEQ ID NO: 27188 - DNA, 20 bp, Artificial
  CRISPR gRNA sequence
actgcggtcttggtgccaag

SEQ ID NO: 27189 - DNA, 20 bp, Artificial
  CRISPR gRNA sequence
cggtcttggtgccaagccca

SEQ ID NO: 27190 - DNA, 20 bp, Artificial
  CRISPR gRNA sequence
ggtgccaagcccagtgctct

SEQ ID NO: 27191 - DNA, 20 bp, Artificial
  CRISPR gRNA sequence
gtgccaagcccagtgctctg

SEQ ID NO: 27192 - DNA, 20 bp, Artificial
  CRISPR gRNA sequence
tgtggggtctcttttagtat

SEQ ID NO: 27193 - DNA, 20 bp, Artificial
  CRISPR gRNA sequence
tggggtctcttttagtatgc

SEQ ID NO: 27194 - DNA, 20 bp, Artificial
  CRISPR gRNA sequence
ttttagtatgcagagcagcc

SEQ ID NO: 27195 - DNA, 20 bp, Artificial
  CRISPR gRNA sequence
ttagtatgcagagcagccgg

SEQ ID NO: 27196 - DNA, 20 bp, Artificial
  CRISPR gRNA sequence
tagtatgcagagcagccggg

SEQ ID NO: 27197 - DNA, 20 bp, Artificial
  CRISPR gRNA sequence
agtatgcagagcagccgggt

SEQ ID NO: 27198 - DNA, 20 bp, Artificial
  CRISPR gRNA sequence
gtatgcagagcagccgggtg

SEQ ID NO: 27199 - DNA, 20 bp, Artificial
  CRISPR gRNA sequence
tctccatttttaagatgagg

SEQ ID NO: 27200 - DNA, 20 bp, Artificial
  CRISPR gRNA sequence
tccatttttaagatgaggat

SEQ ID NO: 27201 - DNA, 20 bp, Artificial
  CRISPR gRNA sequence
catttttaagatgaggatgt

SEQ ID NO: 27202 - DNA, 20 bp, Artificial
  CRISPR gRNA sequence
ttaagatgaggatgttgagg

SEQ ID NO: 27203 - DNA, 20 bp, Artificial
  CRISPR gRNA sequence
taagatgaggatgttgaggc

SEQ ID NO: 27204 - DNA, 20 bp, Artificial
  CRISPR gRNA sequence
aagatgaggatgttgaggct

SEQ ID NO: 27205 - DNA, 20 bp, Artificial
  CRISPR gRNA sequence
agatgaggatgttgaggctc

SEQ ID NO: 27206 - DNA, 20 bp, Artificial
  CRISPR gRNA sequence
aggctcagagaggggcagcc

SEQ ID NO: 27207 - DNA, 20 bp, Artificial
  CRISPR gRNA sequence
agagaggggcagccacttgc

SEQ ID NO: 27208 - DNA, 20 bp, Artificial
  CRISPR gRNA sequence
gccacacagcaagtgagagg

SEQ ID NO: 27209 - DNA, 20 bp, Artificial
  CRISPR gRNA sequence
ccacacagcaagtgagaggc

SEQ ID NO: 27210 - DNA, 20 bp, Artificial
  CRISPR gRNA sequence
tcccagtcaatatttgaagg

SEQ ID NO: 27211 - DNA, 20 bp, Artificial
  CRISPR gRNA sequence
ccagtcaatatttgaaggcc

SEQ ID NO: 27212 - DNA, 20 bp, Artificial
  CRISPR gRNA sequence
gaaggcccgccatgtgccag

SEQ ID NO: 27213 - DNA, 20 bp, Artificial
  CRISPR gRNA sequence
aaggcccgccatgtgccagt

SEQ ID NO: 27214 - DNA, 20 bp, Artificial
  CRISPR gRNA sequence
gggtatgtctagaatctgag

SEQ ID NO: 27215 - DNA, 20 bp, Artificial
  CRISPR gRNA sequence
gaatctgagactgacctggg

SEQ ID NO: 27216 - DNA, 20 bp, Artificial
  CRISPR gRNA sequence
agactgacctgggctcaaat

SEQ ID NO: 27217 - DNA, 20 bp, Artificial
  CRISPR gRNA sequence
acctgggctcaaatttgttt

SEQ ID NO: 27218 - DNA, 20 bp, Artificial
  CRISPR gRNA sequence
ggctcaaatttgttttattc

SEQ ID NO: 27219 - DNA, 20 bp, Artificial
  CRISPR gRNA sequence
aaatttgttttattctttcc

SEQ ID NO: 27220 - DNA, 20 bp, Artificial
  CRISPR gRNA sequence
gttttattctttccaccccc

SEQ ID NO: 27221 - DNA, 20 bp, Artificial
  CRISPR gRNA sequence
ttttattctttccaccccct

SEQ ID NO: 27222 - DNA, 20 bp, Artificial
  CRISPR gRNA sequence
tattctttccaccccctgag

SEQ ID NO: 27223 - DNA, 20 bp, Artificial
  CRISPR gRNA sequence
attctttccaccccctgagc

SEQ ID NO: 27224 - DNA, 20 bp, Artificial
  CRISPR gRNA sequence
ttctttccaccccctgagca

SEQ ID NO: 27225 - DNA, 20 bp, Artificial
  CRISPR gRNA sequence
tttccaccccctgagcacgc

SEQ ID NO: 27226 - DNA, 20 bp, Artificial
  CRISPR gRNA sequence
tccaccccctgagcacgcca

SEQ ID NO: 27227 - DNA, 20 bp, Artificial
  CRISPR gRNA sequence
ccaccccctgagcacgccac

SEQ ID NO: 27228 - DNA, 20 bp, Artificial
  CRISPR gRNA sequence
caccccctgagcacgccacc

SEQ ID NO: 27229 - DNA, 20 bp, Artificial
  CRISPR gRNA sequence
agcacgccaccgttttctta

SEQ ID NO: 27230 - DNA, 20 bp, Artificial
  CRISPR gRNA sequence
tcttatgctaagagtaaagc

SEQ ID NO: 27231 - DNA, 20 bp, Artificial
  CRISPR gRNA sequence
cttatgctaagagtaaagcc

SEQ ID NO: 27232 - DNA, 20 bp, Artificial
  CRISPR gRNA sequence
ttatgctaagagtaaagcca

SEQ ID NO: 27233 - DNA, 20 bp, Artificial
  CRISPR gRNA sequence
atgctaagagtaaagccatg

SEQ ID NO: 27234 - DNA, 20 bp, Artificial
  CRISPR gRNA sequence
tgctaagagtaaagccatgg

SEQ ID NO: 27235 - DNA, 20 bp, Artificial
  CRISPR gRNA sequence
agagtaaagccatggcctcc

SEQ ID NO: 27236 - DNA, 20 bp, Artificial
  CRISPR gRNA sequence
cccttggactctctgcctcc

SEQ ID NO: 27237 - DNA, 20 bp, Artificial
  CRISPR gRNA sequence
ggactctctgcctccattct

SEQ ID NO: 27238 - DNA, 20 bp, Artificial
  CRISPR gRNA sequence
gactctctgcctccattctc

SEQ ID NO: 27239 - DNA, 20 bp, Artificial
  CRISPR gRNA sequence
tctgcctccattctctcctc

SEQ ID NO: 27240 - DNA, 20 bp, Artificial
  CRISPR gRNA sequence
tgcctccattctctcctctt

SEQ ID NO: 27241 - DNA, 20 bp, Artificial
  CRISPR gRNA sequence
cctccattctctcctcttcc

SEQ ID NO: 27242 - DNA, 20 bp, Artificial
  CRISPR gRNA sequence
cattctctcctcttccactc

SEQ ID NO: 27243 - DNA, 20 bp, Artificial
  CRISPR gRNA sequence
tctcctcttccactccattt

SEQ ID NO: 27244 - DNA, 20 bp, Artificial
  CRISPR gRNA sequence
tcctcttccactccattttg

SEQ ID NO: 27245 - DNA, 20 bp, Artificial
  CRISPR gRNA sequence
ctcttccactccattttgta

SEQ ID NO: 27246 - DNA, 20 bp, Artificial
  CRISPR gRNA sequence
ttccactccattttgtattc

SEQ ID NO: 27247 - DNA, 20 bp, Artificial
  CRISPR gRNA sequence
ccactccattttgtattcag

SEQ ID NO: 27248 - DNA, 20 bp, Artificial
  CRISPR gRNA sequence
cactccattttgtattcagc

SEQ ID NO: 27249 - DNA, 20 bp, Artificial
  CRISPR gRNA sequence
cattttgtattcagcaacca

SEQ ID NO: 27250 - DNA, 20 bp, Artificial
  CRISPR gRNA sequence
tgtattcagcaaccagacca

SEQ ID NO: 27251 - DNA, 20 bp, Artificial
  CRISPR gRNA sequence
gtattcagcaaccagaccaa

SEQ ID NO: 27252 - DNA, 20 bp, Artificial
  CRISPR gRNA sequence
tattcagcaaccagaccaat

SEQ ID NO: 27253 - DNA, 20 bp, Artificial
  CRISPR gRNA sequence
agcaaccagaccaatcttct

SEQ ID NO: 27254 - DNA, 20 bp, Artificial
  CRISPR gRNA sequence
ctcagaacttgaatctgatt

SEQ ID NO: 27255 - DNA, 20 bp, Artificial
  CRISPR gRNA sequence
tcagaacttgaatctgattg

SEQ ID NO: 27256 - DNA, 20 bp, Artificial
  CRISPR gRNA sequence
agaacttgaatctgattgta

SEQ ID NO: 27257 - DNA, 20 bp, Artificial
  CRISPR gRNA sequence
gaatctgattgtatcccatc

SEQ ID NO: 27258 - DNA, 20 bp, Artificial
  CRISPR gRNA sequence
aatctgattgtatcccatcc

SEQ ID NO: 27259 - DNA, 20 bp, Artificial
  CRISPR gRNA sequence
attgtatcccatccctgctt

SEQ ID NO: 27260 - DNA, 20 bp, Artificial
  CRISPR gRNA sequence
tatcccatccctgcttacaa

SEQ ID NO: 27261 - DNA, 20 bp, Artificial
  CRISPR gRNA sequence
cttacaatccttcagggaca

SEQ ID NO: 27262 - DNA, 20 bp, Artificial
  CRISPR gRNA sequence
acaatccttcagggacactc

SEQ ID NO: 27263 - DNA, 20 bp, Artificial
  CRISPR gRNA sequence
caatccttcagggacactcc

SEQ ID NO: 27264 - DNA, 20 bp, Artificial
  CRISPR gRNA sequence
cagggacactccaccactgt

SEQ ID NO: 27265 - DNA, 20 bp, Artificial
  CRISPR gRNA sequence
agggacactccaccactgtc

SEQ ID NO: 27266 - DNA, 20 bp, Artificial
  CRISPR gRNA sequence
caccactgtcaggatgaagg

SEQ ID NO: 27267 - DNA, 20 bp, Artificial
  CRISPR gRNA sequence
tcaggatgaaggctaaattc

SEQ ID NO: 27268 - DNA, 20 bp, Artificial
  CRISPR gRNA sequence
aattccttaatttggtttca

SEQ ID NO: 27269 - DNA, 20 bp, Artificial
  CRISPR gRNA sequence
cttaatttggtttcattaag

SEQ ID NO: 27270 - DNA, 20 bp, Artificial
  CRISPR gRNA sequence
aatttggtttcattaagtcg

SEQ ID NO: 27271 - DNA, 20 bp, Artificial
  CRISPR gRNA sequence
atttggtttcattaagtcgg

SEQ ID NO: 27272 - DNA, 20 bp, Artificial
  CRISPR gRNA sequence
ggtttcattaagtcggtctg

SEQ ID NO: 27273 - DNA, 20 bp, Artificial
  CRISPR gRNA sequence
gtttcattaagtcggtctgc

SEQ ID NO: 27274 - DNA, 20 bp, Artificial
  CRISPR gRNA sequence
cattaagtcggtctgcaatc

SEQ ID NO: 27275 - DNA, 20 bp, Artificial
  CRISPR gRNA sequence
attaagtcggtctgcaatct

SEQ ID NO: 27276 - DNA, 20 bp, Artificial
  CRISPR gRNA sequence
agtcggtctgcaatctgctt

SEQ ID NO: 27277 - DNA, 20 bp, Artificial
  CRISPR gRNA sequence
caatctgcttgagcatttca

SEQ ID NO: 27278 - DNA, 20 bp, Artificial
  CRISPR gRNA sequence
cttgagcatttcagcttaat

SEQ ID NO: 27279 - DNA, 20 bp, Artificial
  CRISPR gRNA sequence
gagcatttcagcttaatcgc

SEQ ID NO: 27280 - DNA, 20 bp, Artificial
  CRISPR gRNA sequence
agcatttcagcttaatcgcc

SEQ ID NO: 27281 - DNA, 20 bp, Artificial
  CRISPR gRNA sequence
cagcttaatcgccagaggat

SEQ ID NO: 27282 - DNA, 20 bp, Artificial
  CRISPR gRNA sequence
agcttaatcgccagaggatt

SEQ ID NO: 27283 - DNA, 20 bp, Artificial
  CRISPR gRNA sequence
aatcgccagaggattgcttc

SEQ ID NO: 27284 - DNA, 20 bp, Artificial
  CRISPR gRNA sequence
atcgccagaggattgcttcc

SEQ ID NO: 27285 - DNA, 20 bp, Artificial
  CRISPR gRNA sequence
cttccatatttccccctaaa

SEQ ID NO: 27286 - DNA, 20 bp, Artificial
  CRISPR gRNA sequence
ccatatttccccctaaacat

SEQ ID NO: 27287 - DNA, 20 bp, Artificial
  CRISPR gRNA sequence
catatttccccctaaacata

SEQ ID NO: 27288 - DNA, 20 bp, Artificial
  CRISPR gRNA sequence
ccccctaaacatactttacc

SEQ ID NO: 27289 - DNA, 20 bp, Artificial
  CRISPR gRNA sequence
cccctaaacatactttaccc

SEQ ID NO: 27290 - DNA, 20 bp, Artificial
  CRISPR gRNA sequence
aacatactttacccaagctg

SEQ ID NO: 27291 - DNA, 20 bp, Artificial
  CRISPR gRNA sequence
tacccaagctgtaaggtcct

SEQ ID NO: 27292 - DNA, 20 bp, Artificial
  CRISPR gRNA sequence
acccaagctgtaaggtccta

SEQ ID NO: 27293 - DNA, 20 bp, Artificial
  CRISPR gRNA sequence
cccaagctgtaaggtcctac

SEQ ID NO: 27294 - DNA, 20 bp, Artificial
  CRISPR gRNA sequence
taaggtcctacataattgtg

SEQ ID NO: 27295 - DNA, 20 bp, Artificial
  CRISPR gRNA sequence
cataattgtgccaataattt

SEQ ID NO: 27296 - DNA, 20 bp, Artificial
  CRISPR gRNA sequence
tgccaataatttagcagtga

SEQ ID NO: 27297 - DNA, 20 bp, Artificial
  CRISPR gRNA sequence
agcagtgagcttcctggtag

SEQ ID NO: 27298 - DNA, 20 bp, Artificial
  CRISPR gRNA sequence
gcagtgagcttcctggtagc

SEQ ID NO: 27299 - DNA, 20 bp, Artificial
  CRISPR gRNA sequence
cctggtagccgaagcaaaaa

SEQ ID NO: 27300 - DNA, 20 bp, Artificial
  CRISPR gRNA sequence
ctggtagccgaagcaaaaag

SEQ ID NO: 27301 - DNA, 20 bp, Artificial
  CRISPR gRNA sequence
gtagccgaagcaaaaaggga

SEQ ID NO: 27302 - DNA, 20 bp, Artificial
  CRISPR gRNA sequence
tgtgagttgtgagaaagtag

SEQ ID NO: 27303 - DNA, 20 bp, Artificial
  CRISPR gRNA sequence
tgagaaagtaggaatcaata

SEQ ID NO: 27304 - DNA, 20 bp, Artificial
  CRISPR gRNA sequence
gagtggtcatggaaggcttt

SEQ ID NO: 27305 - DNA, 20 bp, Artificial
  CRISPR gRNA sequence
tctgggaaaggtagaggttg

SEQ ID NO: 27306 - DNA, 20 bp, Artificial
  CRISPR gRNA sequence
ctgggaaaggtagaggttga

SEQ ID NO: 27307 - DNA, 20 bp, Artificial
  CRISPR gRNA sequence
tgggaaaggtagaggttgag

SEQ ID NO: 27308 - DNA, 20 bp, Artificial
  CRISPR gRNA sequence
ggaaaggtagaggttgagct

SEQ ID NO: 27309 - DNA, 20 bp, Artificial
  CRISPR gRNA sequence
agctaaggaaagaaagtatt

SEQ ID NO: 27310 - DNA, 20 bp, Artificial
  CRISPR gRNA sequence
aggaaagaaagtattttaat

SEQ ID NO: 27311 - DNA, 20 bp, Artificial
  CRISPR gRNA sequence
taataggtaggaggaccctt

SEQ ID NO: 27312 - DNA, 20 bp, Artificial
  CRISPR gRNA sequence
aataggtaggaggacccttc

SEQ ID NO: 27313 - DNA, 20 bp, Artificial
  CRISPR gRNA sequence
ataggtaggaggacccttca

SEQ ID NO: 27314 - DNA, 20 bp, Artificial
  CRISPR gRNA sequence
catggagctgcccttccatt

SEQ ID NO: 27315 - DNA, 20 bp, Artificial
  CRISPR gRNA sequence
atggagctgcccttccatta

SEQ ID NO: 27316 - DNA, 20 bp, Artificial
  CRISPR gRNA sequence
cccttccattaaggtctagc

SEQ ID NO: 27317 - DNA, 20 bp, Artificial
  CRISPR gRNA sequence
ccattaaggtctagcctggt

SEQ ID NO: 27318 - DNA, 20 bp, Artificial
  CRISPR gRNA sequence
cattaaggtctagcctggtc

SEQ ID NO: 27319 - DNA, 20 bp, Artificial
  CRISPR gRNA sequence
aggtctagcctggtcaccgt

SEQ ID NO: 27320 - DNA, 20 bp, Artificial
  CRISPR gRNA sequence
gcctggtcaccgtgcctggg

SEQ ID NO: 27321 - DNA, 20 bp, Artificial
  CRISPR gRNA sequence
gtcaccgtgcctgggtctga

SEQ ID NO: 27322 - DNA, 20 bp, Artificial
  CRISPR gRNA sequence
ggtctgaggccctccctcca

SEQ ID NO: 27323 - DNA, 20 bp, Artificial
  CRISPR gRNA sequence
aggccctccctccacagggc

SEQ ID NO: 27324 - DNA, 20 bp, Artificial
  CRISPR gRNA sequence
cctccacagggctgccttga

SEQ ID NO: 27325 - DNA, 20 bp, Artificial
  CRISPR gRNA sequence
cacagggctgccttgagcga

SEQ ID NO: 27326 - DNA, 20 bp, Artificial
  CRISPR gRNA sequence
ccttgagcgacacggtggcg

SEQ ID NO: 27327 - DNA, 20 bp, Artificial
  CRISPR gRNA sequence
gagcgacacggtggcgctgt

SEQ ID NO: 27328 - DNA, 20 bp, Artificial
  CRISPR gRNA sequence
agcgacacggtggcgctgtg

SEQ ID NO: 27329 - DNA, 20 bp, Artificial
  CRISPR gRNA sequence
tgggagtccctgcagcagca

SEQ ID NO: 27330 - DNA, 20 bp, Artificial
  CRISPR gRNA sequence
cagcagcatggggagaccaa

SEQ ID NO: 27331 - DNA, 20 bp, Artificial
  CRISPR gRNA sequence
cttcaggcagcagaggagaa

SEQ ID NO: 27332 - DNA, 20 bp, Artificial
  CRISPR gRNA sequence
caggcagcagaggagaagtt

SEQ ID NO: 27333 - DNA, 20 bp, Artificial
  CRISPR gRNA sequence
aggcagcagaggagaagttc

SEQ ID NO: 27334 - DNA, 20 bp, Artificial
  CRISPR gRNA sequence
accatcgagcctttcaaagc

SEQ ID NO: 27335 - DNA, 20 bp, Artificial
  CRISPR gRNA sequence
tcaaagccaagtccctgaag

SEQ ID NO: 27336 - DNA, 20 bp, Artificial
  CRISPR gRNA sequence
caaagccaagtccctgaagg

SEQ ID NO: 27337 - DNA, 20 bp, Artificial
  CRISPR gRNA sequence
aaagccaagtccctgaagga

SEQ ID NO: 27338 - DNA, 20 bp, Artificial
  CRISPR gRNA sequence
aaggatgtggaagacctggg

SEQ ID NO: 27339 - DNA, 20 bp, Artificial
  CRISPR gRNA sequence
ggaaagcttgtgcagactca

SEQ ID NO: 27340 - DNA, 20 bp, Artificial
  CRISPR gRNA sequence
gtgcagactcagaggtgaga

SEQ ID NO: 27341 - DNA, 20 bp, Artificial
  CRISPR gRNA sequence
tgcagactcagaggtgagag

SEQ ID NO: 27342 - DNA, 20 bp, Artificial
  CRISPR gRNA sequence
agaggtgagaggagaggcgg

SEQ ID NO: 27343 - DNA, 20 bp, Artificial
  CRISPR gRNA sequence
acgccatgcaggttgaggac

SEQ ID NO: 27344 - DNA, 20 bp, Artificial
  CRISPR gRNA sequence
aggacatgtaggacccattc

SEQ ID NO: 27345 - DNA, 20 bp, Artificial
  CRISPR gRNA sequence
tcaagtttgtcatgggcatt

SEQ ID NO: 27346 - DNA, 20 bp, Artificial
  CRISPR gRNA sequence
aagtttgtcatgggcatttc

SEQ ID NO: 27347 - DNA, 20 bp, Artificial
  CRISPR gRNA sequence
gtcatgggcatttccagtgc

SEQ ID NO: 27348 - DNA, 20 bp, Artificial
  CRISPR gRNA sequence
tcatgggcatttccagtgcc

SEQ ID NO: 27349 - DNA, 20 bp, Artificial
  CRISPR gRNA sequence
ccagtgccccctgtcctctg

SEQ ID NO: 27350 - DNA, 20 bp, Artificial
  CRISPR gRNA sequence
cagtgccccctgtcctctgg

SEQ ID NO: 27351 - DNA, 20 bp, Artificial
  CRISPR gRNA sequence
tcctctgggacaccccatgc

SEQ ID NO: 27352 - DNA, 20 bp, Artificial
  CRISPR gRNA sequence
tgggacaccccatgccctct

SEQ ID NO: 27353 - DNA, 20 bp, Artificial
  CRISPR gRNA sequence
ggacaccccatgccctcttt

SEQ ID NO: 27354 - DNA, 20 bp, Artificial
  CRISPR gRNA sequence
tttctgggcaatggctaacc

SEQ ID NO: 27355 - DNA, 20 bp, Artificial
  CRISPR gRNA sequence
tctgggcaatggctaaccag

SEQ ID NO: 27356 - DNA, 20 bp, Artificial
  CRISPR gRNA sequence
ctgggcaatggctaaccaga

SEQ ID NO: 27357 - DNA, 20 bp, Artificial
  CRISPR gRNA sequence
tgggcaatggctaaccagag

SEQ ID NO: 27358 - DNA, 20 bp, Artificial
  CRISPR gRNA sequence
ggcaatggctaaccagagtc

SEQ ID NO: 27359 - DNA, 20 bp, Artificial
  CRISPR gRNA sequence
accagagtctctcactgcac

SEQ ID NO: 27360 - DNA, 20 bp, Artificial
  CRISPR gRNA sequence
tcactgcactcgctgcccag

SEQ ID NO: 27361 - DNA, 20 bp, Artificial
  CRISPR gRNA sequence
actgcactcgctgcccaggc

SEQ ID NO: 27362 - DNA, 20 bp, Artificial
  CRISPR gRNA sequence
cactcgctgcccaggcggag

SEQ ID NO: 27363 - DNA, 20 bp, Artificial
  CRISPR gRNA sequence
gctgcccaggcggagcctct

SEQ ID NO: 27364 - DNA, 20 bp, Artificial
  CRISPR gRNA sequence
cccaggcggagcctctagaa

SEQ ID NO: 27365 - DNA, 20 bp, Artificial
  CRISPR gRNA sequence
tagaattgaaaactttgctg

SEQ ID NO: 27366 - DNA, 20 bp, Artificial
  CRISPR gRNA sequence
gaattgaaaactttgctgca

SEQ ID NO: 27367 - DNA, 20 bp, Artificial
  CRISPR gRNA sequence
aaaactttgctgcattcaaa

SEQ ID NO: 27368 - DNA, 20 bp, Artificial
  CRISPR gRNA sequence
tgctgcattcaaaacctgcc

SEQ ID NO: 27369 - DNA, 20 bp, Artificial
  CRISPR gRNA sequence
gctgcattcaaaacctgcca

SEQ ID NO: 27370 - DNA, 20 bp, Artificial
  CRISPR gRNA sequence
ctgcattcaaaacctgccat

SEQ ID NO: 27371 - DNA, 20 bp, Artificial
  CRISPR gRNA sequence
cattcaaaacctgccatcat

SEQ ID NO: 27372 - DNA, 20 bp, Artificial
  CRISPR gRNA sequence
aaaacctgccatcatgtgcc

SEQ ID NO: 27373 - DNA, 20 bp, Artificial
  CRISPR gRNA sequence
ccatcatgtgcccaagtctt

SEQ ID NO: 27374 - DNA, 20 bp, Artificial
  CRISPR gRNA sequence
agctaaagccatggagaacc

SEQ ID NO: 27375 - DNA, 20 bp, Artificial
  CRISPR gRNA sequence
gctaaagccatggagaacct

SEQ ID NO: 27376 - DNA, 20 bp, Artificial
  CRISPR gRNA sequence
aagccatggagaacctctcc

SEQ ID NO: 27377 - DNA, 20 bp, Artificial
  CRISPR gRNA sequence
tccccttctaggagttaaca

SEQ ID NO: 27378 - DNA, 20 bp, Artificial
  CRISPR gRNA sequence
cccttctaggagttaacaag

SEQ ID NO: 27379 - DNA, 20 bp, Artificial
  CRISPR gRNA sequence
ctaggagttaacaaggatgc

SEQ ID NO: 27380 - DNA, 20 bp, Artificial
  CRISPR gRNA sequence
taggagttaacaaggatgcc

SEQ ID NO: 27381 - DNA, 20 bp, Artificial
  CRISPR gRNA sequence
ggagttaacaaggatgcctt

SEQ ID NO: 27382 - DNA, 20 bp, Artificial
  CRISPR gRNA sequence
acaaggatgccttgtgcacc

SEQ ID NO: 27383 - DNA, 20 bp, Artificial
  CRISPR gRNA sequence
gtgcacctagtaacagaagt

SEQ ID NO: 27384 - DNA, 20 bp, Artificial
  CRISPR gRNA sequence
tgcacctagtaacagaagtg

SEQ ID NO: 27385 - DNA, 20 bp, Artificial
  CRISPR gRNA sequence
gtaacagaagtgacacctac

SEQ ID NO: 27386 - DNA, 20 bp, Artificial
  CRISPR gRNA sequence
ctgccaccctttgaggcatt

SEQ ID NO: 27387 - DNA, 20 bp, Artificial
  CRISPR gRNA sequence
ccaccctttgaggcatttag

SEQ ID NO: 27388 - DNA, 20 bp, Artificial
  CRISPR gRNA sequence
tgaggcatttaggacaactg

SEQ ID NO: 27389 - DNA, 20 bp, Artificial
  CRISPR gRNA sequence
gaggcatttaggacaactgt

SEQ ID NO: 27390 - DNA, 20 bp, Artificial
  CRISPR gRNA sequence
aggcatttaggacaactgtt

SEQ ID NO: 27391 - DNA, 20 bp, Artificial
  CRISPR gRNA sequence
aggacaactgttgtcccaaa

SEQ ID NO: 27392 - DNA, 20 bp, Artificial
  CRISPR gRNA sequence
ggacaactgttgtcccaaat

SEQ ID NO: 27393 - DNA, 20 bp, Artificial
  CRISPR gRNA sequence
ttgtcccaaatttatagacg

SEQ ID NO: 27394 - DNA, 20 bp, Artificial
  CRISPR gRNA sequence
tcccaaatttatagacggca

SEQ ID NO: 27395 - DNA, 20 bp, Artificial
  CRISPR gRNA sequence
atagacggcagagctaaggt

SEQ ID NO: 27396 - DNA, 20 bp, Artificial
  CRISPR gRNA sequence
tagacggcagagctaaggtc

SEQ ID NO: 27397 - DNA, 20 bp, Artificial
  CRISPR gRNA sequence
aggtccagaaggcagacaaa

SEQ ID NO: 27398 - DNA, 20 bp, Artificial
  CRISPR gRNA sequence
gattacagaacaagttaact

SEQ ID NO: 27399 - DNA, 20 bp, Artificial
  CRISPR gRNA sequence
attacagaacaagttaactg

SEQ ID NO: 27400 - DNA, 20 bp, Artificial
  CRISPR gRNA sequence
cagaacaagttaactgtctt

SEQ ID NO: 27401 - DNA, 20 bp, Artificial
  CRISPR gRNA sequence
actgtctttcattcattcct

SEQ ID NO: 27402 - DNA, 20 bp, Artificial
  CRISPR gRNA sequence
tctttcattcattccttcat

SEQ ID NO: 27403 - DNA, 20 bp, Artificial
  CRISPR gRNA sequence
tcattcattccttcatcaca

SEQ ID NO: 27404 - DNA, 20 bp, Artificial
  CRISPR gRNA sequence
cattcattccttcatcacac

SEQ ID NO: 27405 - DNA, 20 bp, Artificial
  CRISPR gRNA sequence
attcattccttcatcacaca

SEQ ID NO: 27406 - DNA, 20 bp, Artificial
  CRISPR gRNA sequence
attccttcatcacacattgt

SEQ ID NO: 27407 - DNA, 20 bp, Artificial
  CRISPR gRNA sequence
cttcatcacacattgtttga

SEQ ID NO: 27408 - DNA, 20 bp, Artificial
  CRISPR gRNA sequence
catcacacattgtttgagcg

SEQ ID NO: 27409 - DNA, 20 bp, Artificial
  CRISPR gRNA sequence
atcacacattgtttgagcgc

SEQ ID NO: 27410 - DNA, 20 bp, Artificial
  CRISPR gRNA sequence
tttgagcgcctcttaagtgc

SEQ ID NO: 27411 - DNA, 20 bp, Artificial
  CRISPR gRNA sequence
gagcgcctcttaagtgctgt

SEQ ID NO: 27412 - DNA, 20 bp, Artificial
  CRISPR gRNA sequence
agcgcctcttaagtgctgtc

SEQ ID NO: 27413 - DNA, 20 bp, Artificial
  CRISPR gRNA sequence
ttaagtgctgtctgggatag

SEQ ID NO: 27414 - DNA, 20 bp, Artificial
  CRISPR gRNA sequence
aagtgctgtctgggataggt

SEQ ID NO: 27415 - DNA, 20 bp, Artificial
  CRISPR gRNA sequence
agtgctgtctgggataggta

SEQ ID NO: 27416 - DNA, 20 bp, Artificial
  CRISPR gRNA sequence
tctgggataggtactggtaa

SEQ ID NO: 27417 - DNA, 20 bp, Artificial
  CRISPR gRNA sequence
ggataggtactggtaagtgc

SEQ ID NO: 27418 - DNA, 20 bp, Artificial
  CRISPR gRNA sequence
gtaagtgcctaatctgaggc

SEQ ID NO: 27419 - DNA, 20 bp, Artificial
  CRISPR gRNA sequence
atctgaggctcatttccatg

SEQ ID NO: 27420 - DNA, 20 bp, Artificial
  CRISPR gRNA sequence
aggctcatttccatgaaaga

SEQ ID NO: 27421 - DNA, 20 bp, Artificial
  CRISPR gRNA sequence
atttccatgaaagatacagt

SEQ ID NO: 27422 - DNA, 20 bp, Artificial
  CRISPR gRNA sequence
ccatgaaagatacagtcctg

SEQ ID NO: 27423 - DNA, 20 bp, Artificial
  CRISPR gRNA sequence
catgaaagatacagtcctga

SEQ ID NO: 27424 - DNA, 20 bp, Artificial
  CRISPR gRNA sequence
agatcttttatttttatttt

SEQ ID NO: 27425 - DNA, 20 bp, Artificial
  CRISPR gRNA sequence
ttatttttatttttattatt

SEQ ID NO: 27426 - DNA, 20 bp, Artificial
  CRISPR gRNA sequence
tatttttatttttattattt

SEQ ID NO: 27427 - DNA, 20 bp, Artificial
  CRISPR gRNA sequence
atttttatttttattatttc

SEQ ID NO: 27428 - DNA, 20 bp, Artificial
  CRISPR gRNA sequence
tttttatttttattatttct

SEQ ID NO: 27429 - DNA, 20 bp, Artificial
  CRISPR gRNA sequence
ttatttttattatttcttaa

SEQ ID NO: 27430 - DNA, 20 bp, Artificial
  CRISPR gRNA sequence
tatttttattatttcttaaa

SEQ ID NO: 27431 - DNA, 20 bp, Artificial
  CRISPR gRNA sequence
atttttattatttcttaaag

SEQ ID NO: 27432 - DNA, 20 bp, Artificial
  CRISPR gRNA sequence
tttttattatttcttaaaga

SEQ ID NO: 27433 - DNA, 20 bp, Artificial
  CRISPR gRNA sequence
ttattatttcttaaagacag

SEQ ID NO: 27434 - DNA, 20 bp, Artificial
  CRISPR gRNA sequence
tattatttcttaaagacagg

SEQ ID NO: 27435 - DNA, 20 bp, Artificial
  CRISPR gRNA sequence
attatttcttaaagacaggg

SEQ ID NO: 27436 - DNA, 20 bp, Artificial
  CRISPR gRNA sequence
ttatttcttaaagacagggt

SEQ ID NO: 27437 - DNA, 20 bp, Artificial
  CRISPR gRNA sequence
tttcttaaagacagggtctc

SEQ ID NO: 27438 - DNA, 20 bp, Artificial
  CRISPR gRNA sequence
cttaaagacagggtctcgct

SEQ ID NO: 27439 - DNA, 20 bp, Artificial
  CRISPR gRNA sequence
ttaaagacagggtctcgctg

SEQ ID NO: 27440 - DNA, 20 bp, Artificial
  CRISPR gRNA sequence
aaagacagggtctcgctgtg

SEQ ID NO: 27441 - DNA, 20 bp, Artificial
  CRISPR gRNA sequence
aagacagggtctcgctgtgt

SEQ ID NO: 27442 - DNA, 20 bp, Artificial
  CRISPR gRNA sequence
gctgtgtctaccaggctaga

SEQ ID NO: 27443 - DNA, 20 bp, Artificial
  CRISPR gRNA sequence
tgtctaccaggctagaatac

SEQ ID NO: 27444 - DNA, 20 bp, Artificial
  CRISPR gRNA sequence
ccaggctagaatacagtagt

SEQ ID NO: 27445 - DNA, 20 bp, Artificial
  CRISPR gRNA sequence
gaatacagtagtgcgatcat

SEQ ID NO: 27446 - DNA, 20 bp, Artificial
  CRISPR gRNA sequence
actgtagcttcggaactcct

SEQ ID NO: 27447 - DNA, 20 bp, Artificial
  CRISPR gRNA sequence
ctgtagcttcggaactcctg

SEQ ID NO: 27448 - DNA, 20 bp, Artificial
  CRISPR gRNA sequence
tagcttcggaactcctgagc

SEQ ID NO: 27449 - DNA, 20 bp, Artificial
  CRISPR gRNA sequence
cggaactcctgagctcaagc

SEQ ID NO: 27450 - DNA, 20 bp, Artificial
  CRISPR gRNA sequence
ggaactcctgagctcaagcg

SEQ ID NO: 27451 - DNA, 20 bp, Artificial
  CRISPR gRNA sequence
ctgagctcaagcgatcctcc

SEQ ID NO: 27452 - DNA, 20 bp, Artificial
  CRISPR gRNA sequence
agctcaagcgatcctcctgc

SEQ ID NO: 27453 - DNA, 20 bp, Artificial
  CRISPR gRNA sequence
aagcgatcctcctgcctcag

SEQ ID NO: 27454 - DNA, 20 bp, Artificial
  CRISPR gRNA sequence
ctgcctcagcctcccaagta

SEQ ID NO: 27455 - DNA, 20 bp, Artificial
  CRISPR gRNA sequence
cctcagcctcccaagtagct

SEQ ID NO: 27456 - DNA, 20 bp, Artificial
  CRISPR gRNA sequence
agcctcccaagtagctggga

SEQ ID NO: 27457 - DNA, 20 bp, Artificial
  CRISPR gRNA sequence
ccaagtagctgggattatag

SEQ ID NO: 27458 - DNA, 20 bp, Artificial
  CRISPR gRNA sequence
ggattataggtgcacgtcat

SEQ ID NO: 27459 - DNA, 20 bp, Artificial
  CRISPR gRNA sequence
taggtgcacgtcatcacacc

SEQ ID NO: 27460 - DNA, 20 bp, Artificial
  CRISPR gRNA sequence
tttaagtttttgtagacaca

SEQ ID NO: 27461 - DNA, 20 bp, Artificial
  CRISPR gRNA sequence
ttaagtttttgtagacacag

SEQ ID NO: 27462 - DNA, 20 bp, Artificial
  CRISPR gRNA sequence
taagtttttgtagacacagg

SEQ ID NO: 27463 - DNA, 20 bp, Artificial
  CRISPR gRNA sequence
aagtttttgtagacacaggg

SEQ ID NO: 27464 - DNA, 20 bp, Artificial
  CRISPR gRNA sequence
agtttttgtagacacaggga

SEQ ID NO: 27465 - DNA, 20 bp, Artificial
  CRISPR gRNA sequence
ttgtagacacagggatcttg

SEQ ID NO: 27466 - DNA, 20 bp, Artificial
  CRISPR gRNA sequence
tgtagacacagggatcttgc

SEQ ID NO: 27467 - DNA, 20 bp, Artificial
  CRISPR gRNA sequence
gtagacacagggatcttgct

SEQ ID NO: 27468 - DNA, 20 bp, Artificial
  CRISPR gRNA sequence
tagacacagggatcttgcta

SEQ ID NO: 27469 - DNA, 20 bp, Artificial
  CRISPR gRNA sequence
gctatgttgcccaggctggt

SEQ ID NO: 27470 - DNA, 20 bp, Artificial
  CRISPR gRNA sequence
ctatgttgcccaggctggtc

SEQ ID NO: 27471 - DNA, 20 bp, Artificial
  CRISPR gRNA sequence
tgttgcccaggctggtcttg

SEQ ID NO: 27472 - DNA, 20 bp, Artificial
  CRISPR gRNA sequence
cccaggctggtcttgaactc

SEQ ID NO: 27473 - DNA, 20 bp, Artificial
  CRISPR gRNA sequence
gtcttgaactcctggcctca

SEQ ID NO: 27474 - DNA, 20 bp, Artificial
  CRISPR gRNA sequence
gaactcctggcctcaagcaa

SEQ ID NO: 27475 - DNA, 20 bp, Artificial
  CRISPR gRNA sequence
aactcctggcctcaagcaat

SEQ ID NO: 27476 - DNA, 20 bp, Artificial
  CRISPR gRNA sequence
ctggcctcaagcaatcctcc

SEQ ID NO: 27477 - DNA, 20 bp, Artificial
  CRISPR gRNA sequence
gcctcaagcaatcctcctgc

SEQ ID NO: 27478 - DNA, 20 bp, Artificial
  CRISPR gRNA sequence
aagcaatcctcctgcctcag

SEQ ID NO: 27479 - DNA, 20 bp, Artificial
  CRISPR gRNA sequence
ctgcctcagcctcccaaagt

SEQ ID NO: 27480 - DNA, 20 bp, Artificial
  CRISPR gRNA sequence
cctcagcctcccaaagtgct

SEQ ID NO: 27481 - DNA, 20 bp, Artificial
  CRISPR gRNA sequence
agcctcccaaagtgctggga

SEQ ID NO: 27482 - DNA, 20 bp, Artificial
  CRISPR gRNA sequence
ccaaagtgctgggactacag

SEQ ID NO: 27483 - DNA, 20 bp, Artificial
  CRISPR gRNA sequence
ggactacagtcacgaggcac

SEQ ID NO: 27484 - DNA, 20 bp, Artificial
  CRISPR gRNA sequence
cagtcacgaggcaccgcacc

SEQ ID NO: 27485 - DNA, 20 bp, Artificial
  CRISPR gRNA sequence
tttttttaagagggggacaa

SEQ ID NO: 27486 - DNA, 20 bp, Artificial
  CRISPR gRNA sequence
ttttttaagagggggacaac

SEQ ID NO: 27487 - DNA, 20 bp, Artificial
  CRISPR gRNA sequence
tttttaagagggggacaaca

SEQ ID NO: 27488 - DNA, 20 bp, Artificial
  CRISPR gRNA sequence
ttttaagagggggacaacag

SEQ ID NO: 27489 - DNA, 20 bp, Artificial
  CRISPR gRNA sequence
tttaagagggggacaacagt

SEQ ID NO: 27490 - DNA, 20 bp, Artificial
  CRISPR gRNA sequence
ttaagagggggacaacagtt

SEQ ID NO: 27491 - DNA, 20 bp, Artificial
  CRISPR gRNA sequence
taagagggggacaacagttg

SEQ ID NO: 27492 - DNA, 20 bp, Artificial
  CRISPR gRNA sequence
aagagggggacaacagttgc

SEQ ID NO: 27493 - DNA, 20 bp, Artificial
  CRISPR gRNA sequence
agagggggacaacagttgcc

SEQ ID NO: 27494 - DNA, 20 bp, Artificial
  CRISPR gRNA sequence
ccccaaggaaagcaatcccc

SEQ ID NO: 27495 - DNA, 20 bp, Artificial
  CRISPR gRNA sequence
gggaatttggggcactgggg

SEQ ID NO: 27496 - DNA, 20 bp, Artificial
  CRISPR gRNA sequence
ggggcactggggcagccatc

SEQ ID NO: 27497 - DNA, 20 bp, Artificial
  CRISPR gRNA sequence
gggcactggggcagccatca

SEQ ID NO: 27498 - DNA, 20 bp, Artificial
  CRISPR gRNA sequence
gggcagccatcatgggaccc

SEQ ID NO: 27499 - DNA, 20 bp, Artificial
  CRISPR gRNA sequence
agtgacagcagtgcctgctc

SEQ ID NO: 27500 - DNA, 20 bp, Artificial
  CRISPR gRNA sequence
ctccccctaacattgcctgt

SEQ ID NO: 27501 - DNA, 20 bp, Artificial
  CRISPR gRNA sequence
cccctaacattgcctgttct

SEQ ID NO: 27502 - DNA, 20 bp, Artificial
  CRISPR gRNA sequence
acattgcctgttctctccag

SEQ ID NO: 27503 - DNA, 20 bp, Artificial
  CRISPR gRNA sequence
cctgttctctccaggacgag

SEQ ID NO: 27504 - DNA, 20 bp, Artificial
  CRISPR gRNA sequence
ttctctccaggacgagaagt

SEQ ID NO: 27505 - DNA, 20 bp, Artificial
  CRISPR gRNA sequence
tctccaggacgagaagttcc

SEQ ID NO: 27506 - DNA, 20 bp, Artificial
  CRISPR gRNA sequence
tccaggacgagaagttcctc

SEQ ID NO: 27507 - DNA, 20 bp, Artificial
  CRISPR gRNA sequence
caggacgagaagttcctcgg

SEQ ID NO: 27508 - DNA, 20 bp, Artificial
  CRISPR gRNA sequence
ctcggaagacacagctgggg

SEQ ID NO: 27509 - DNA, 20 bp, Artificial
  CRISPR gRNA sequence
ggaagacacagctggggagc

SEQ ID NO: 27510 - DNA, 20 bp, Artificial
  CRISPR gRNA sequence
gggagctccctgctgttcgg

SEQ ID NO: 27511 - DNA, 20 bp, Artificial
  CRISPR gRNA sequence
cctgctgttcgggacctaaa

SEQ ID NO: 27512 - DNA, 20 bp, Artificial
  CRISPR gRNA sequence
ctgttcgggacctaaagaaa

SEQ ID NO: 27513 - DNA, 20 bp, Artificial
  CRISPR gRNA sequence
ttcgggacctaaagaaactg

SEQ ID NO: 27514 - DNA, 20 bp, Artificial
  CRISPR gRNA sequence
gggacctaaagaaactggag

SEQ ID NO: 27515 - DNA, 20 bp, Artificial
  CRISPR gRNA sequence
aagaaactggagtttgcgta

SEQ ID NO: 27516 - DNA, 20 bp, Artificial
  CRISPR gRNA sequence
gagtttgcgtaagcaaaggg

SEQ ID NO: 27517 - DNA, 20 bp, Artificial
  CRISPR gRNA sequence
gcgtaagcaaaggggtggat

SEQ ID NO: 27518 - DNA, 20 bp, Artificial
  CRISPR gRNA sequence
cgtaagcaaaggggtggatt

SEQ ID NO: 27519 - DNA, 20 bp, Artificial
  CRISPR gRNA sequence
tcttgtgggtctgcgcaagg

SEQ ID NO: 27520 - DNA, 20 bp, Artificial
  CRISPR gRNA sequence
gtgggtctgcgcaaggtttc

SEQ ID NO: 27521 - DNA, 20 bp, Artificial
  CRISPR gRNA sequence
tgggtctgcgcaaggtttcc

SEQ ID NO: 27522 - DNA, 20 bp, Artificial
  CRISPR gRNA sequence
cgcaaggtttcccctgcagc

SEQ ID NO: 27523 - DNA, 20 bp, Artificial
  CRISPR gRNA sequence
cccctgcagcattagctggg

SEQ ID NO: 27524 - DNA, 20 bp, Artificial
  CRISPR gRNA sequence
ccctgcagcattagctgggc

SEQ ID NO: 27525 - DNA, 20 bp, Artificial
  CRISPR gRNA sequence
cagcattagctgggcttgta

SEQ ID NO: 27526 - DNA, 20 bp, Artificial
  CRISPR gRNA sequence
gctgggcttgtaccacctga

SEQ ID NO: 27527 - DNA, 20 bp, Artificial
  CRISPR gRNA sequence
ggcttgtaccacctgaatgg

SEQ ID NO: 27528 - DNA, 20 bp, Artificial
  CRISPR gRNA sequence
gtaccacctgaatggagata

SEQ ID NO: 27529 - DNA, 20 bp, Artificial
  CRISPR gRNA sequence
taccacctgaatggagatag

SEQ ID NO: 27530 - DNA, 20 bp, Artificial
  CRISPR gRNA sequence
aatggagatagatctccaga

SEQ ID NO: 27531 - DNA, 20 bp, Artificial
  CRISPR gRNA sequence
cagaatcattcttaccctct

SEQ ID NO: 27532 - DNA, 20 bp, Artificial
  CRISPR gRNA sequence
ttaccctcttgcccaccact

SEQ ID NO: 27533 - DNA, 20 bp, Artificial
  CRISPR gRNA sequence
accctcttgcccaccacttt

SEQ ID NO: 27534 - DNA, 20 bp, Artificial
  CRISPR gRNA sequence
ccctcttgcccaccactttg

SEQ ID NO: 27535 - DNA, 20 bp, Artificial
  CRISPR gRNA sequence
ttgcccaccactttggaaat

SEQ ID NO: 27536 - DNA, 20 bp, Artificial
  CRISPR gRNA sequence
gcccaccactttggaaatag

SEQ ID NO: 27537 - DNA, 20 bp, Artificial
  CRISPR gRNA sequence
cccaccactttggaaatagc

SEQ ID NO: 27538 - DNA, 20 bp, Artificial
  CRISPR gRNA sequence
tggaaatagcttccagcagc

SEQ ID NO: 27539 - DNA, 20 bp, Artificial
  CRISPR gRNA sequence
ggaaatagcttccagcagct

SEQ ID NO: 27540 - DNA, 20 bp, Artificial
  CRISPR gRNA sequence
gaaatagcttccagcagctg

SEQ ID NO: 27541 - DNA, 20 bp, Artificial
  CRISPR gRNA sequence
ccagcagctggaaagtgacc

SEQ ID NO: 27542 - DNA, 20 bp, Artificial
  CRISPR gRNA sequence
cagcagctggaaagtgacca

SEQ ID NO: 27543 - DNA, 20 bp, Artificial
  CRISPR gRNA sequence
gaaagtgaccagtgtgggca

SEQ ID NO: 27544 - DNA, 20 bp, Artificial
  CRISPR gRNA sequence
gaggttctcagatttgaagc

SEQ ID NO: 27545 - DNA, 20 bp, Artificial
  CRISPR gRNA sequence
tcagatttgaagctaatgga

SEQ ID NO: 27546 - DNA, 20 bp, Artificial
  CRISPR gRNA sequence
agatttgaagctaatggacc

SEQ ID NO: 27547 - DNA, 20 bp, Artificial
  CRISPR gRNA sequence
gaagctaatggacccgtttg

SEQ ID NO: 27548 - DNA, 20 bp, Artificial
  CRISPR gRNA sequence
aagctaatggacccgtttgc

SEQ ID NO: 27549 - DNA, 20 bp, Artificial
  CRISPR gRNA sequence
atggacccgtttgctggtta

SEQ ID NO: 27550 - DNA, 20 bp, Artificial
  CRISPR gRNA sequence
gctggttaacatggtcattc

SEQ ID NO: 27551 - DNA, 20 bp, Artificial
  CRISPR gRNA sequence
ctggttaacatggtcattcc

SEQ ID NO: 27552 - DNA, 20 bp, Artificial
  CRISPR gRNA sequence
gttaacatggtcattcccat

SEQ ID NO: 27553 - DNA, 20 bp, Artificial
  CRISPR gRNA sequence
acatggtcattcccatcact

SEQ ID NO: 27554 - DNA, 20 bp, Artificial
  CRISPR gRNA sequence
ccatcactcattcaacagag

SEQ ID NO: 27555 - DNA, 20 bp, Artificial
  CRISPR gRNA sequence
attcaacagaggtattgagc

SEQ ID NO: 27556 - DNA, 20 bp, Artificial
  CRISPR gRNA sequence
aacagaggtattgagcactt

SEQ ID NO: 27557 - DNA, 20 bp, Artificial
  CRISPR gRNA sequence
agcacttgaatgactgaggc

SEQ ID NO: 27558 - DNA, 20 bp, Artificial
  CRISPR gRNA sequence
gaatgactgaggctgctgtc

SEQ ID NO: 27559 - DNA, 20 bp, Artificial
  CRISPR gRNA sequence
aatgactgaggctgctgtcc

SEQ ID NO: 27560 - DNA, 20 bp, Artificial
  CRISPR gRNA sequence
aggctgctgtcctcatgagc

SEQ ID NO: 27561 - DNA, 20 bp, Artificial
  CRISPR gRNA sequence
ctgtcctcatgagctgacag

SEQ ID NO: 27562 - DNA, 20 bp, Artificial
  CRISPR gRNA sequence
tcctcatgagctgacagtct

SEQ ID NO: 27563 - DNA, 20 bp, Artificial
  CRISPR gRNA sequence
atgagctgacagtctaatca

SEQ ID NO: 27564 - DNA, 20 bp, Artificial
  CRISPR gRNA sequence
acagtctaatcaactcccct

SEQ ID NO: 27565 - DNA, 20 bp, Artificial
  CRISPR gRNA sequence
atcaactcccctctggagga

SEQ ID NO: 27566 - DNA, 20 bp, Artificial
  CRISPR gRNA sequence
ccctctggaggaggtcaggg

SEQ ID NO: 27567 - DNA, 20 bp, Artificial
  CRISPR gRNA sequence
tggaggaggtcagggggact

SEQ ID NO: 27568 - DNA, 20 bp, Artificial
  CRISPR gRNA sequence
gaggaggtcagggggacttc

SEQ ID NO: 27569 - DNA, 20 bp, Artificial
  CRISPR gRNA sequence
cctggaggaggtgatatctg

SEQ ID NO: 27570 - DNA, 20 bp, Artificial
  CRISPR gRNA sequence
ctggaggaggtgatatctgc

SEQ ID NO: 27571 - DNA, 20 bp, Artificial
  CRISPR gRNA sequence
gaggaggtgatatctgcact

SEQ ID NO: 27572 - DNA, 20 bp, Artificial
  CRISPR gRNA sequence
cactgaagcttcagtgagga

SEQ ID NO: 27573 - DNA, 20 bp, Artificial
  CRISPR gRNA sequence
aagcttcagtgaggataagg

SEQ ID NO: 27574 - DNA, 20 bp, Artificial
  CRISPR gRNA sequence
cagtgaggataaggaatgag

SEQ ID NO: 27575 - DNA, 20 bp, Artificial
  CRISPR gRNA sequence
agtgaggataaggaatgagc

SEQ ID NO: 27576 - DNA, 20 bp, Artificial
  CRISPR gRNA sequence
agtggggagaggggagtaag

SEQ ID NO: 27577 - DNA, 20 bp, Artificial
  CRISPR gRNA sequence
tccaggaattgtaatttcgc

SEQ ID NO: 27578 - DNA, 20 bp, Artificial
  CRISPR gRNA sequence
ccaggaattgtaatttcgcc

SEQ ID NO: 27579 - DNA, 20 bp, Artificial
  CRISPR gRNA sequence
caggaattgtaatttcgcca

SEQ ID NO: 27580 - DNA, 20 bp, Artificial
  CRISPR gRNA sequence
taatttcgccagggatcaga

SEQ ID NO: 27581 - DNA, 20 bp, Artificial
  CRISPR gRNA sequence
cgccagggatcagaaaaggc

SEQ ID NO: 27582 - DNA, 20 bp, Artificial
  CRISPR gRNA sequence
gccagggatcagaaaaggcc

SEQ ID NO: 27583 - DNA, 20 bp, Artificial
  CRISPR gRNA sequence
ccataggaggatgccactat

SEQ ID NO: 27584 - DNA, 20 bp, Artificial
  CRISPR gRNA sequence
cataggaggatgccactatg

SEQ ID NO: 27585 - DNA, 20 bp, Artificial
  CRISPR gRNA sequence
tgactatggagtccttttcc

SEQ ID NO: 27586 - DNA, 20 bp, Artificial
  CRISPR gRNA sequence
tggagtccttttccctcctg

SEQ ID NO: 27587 - DNA, 20 bp, Artificial
  CRISPR gRNA sequence
ttccctcctgtggccaggaa

SEQ ID NO: 27588 - DNA, 20 bp, Artificial
  CRISPR gRNA sequence
tccctcctgtggccaggaac

SEQ ID NO: 27589 - DNA, 20 bp, Artificial
  CRISPR gRNA sequence
ccctcctgtggccaggaact

SEQ ID NO: 27590 - DNA, 20 bp, Artificial
  CRISPR gRNA sequence
cctcctgtggccaggaactg

SEQ ID NO: 27591 - DNA, 20 bp, Artificial
  CRISPR gRNA sequence
ctgtggccaggaactgcaca

SEQ ID NO: 27592 - DNA, 20 bp, Artificial
  CRISPR gRNA sequence
tggccaggaactgcacaacg

SEQ ID NO: 27593 - DNA, 20 bp, Artificial
  CRISPR gRNA sequence
cacaacgtcccttgtgcctg

SEQ ID NO: 27594 - DNA, 20 bp, Artificial
  CRISPR gRNA sequence
gtgcctgagcttgtttactt

SEQ ID NO: 27595 - DNA, 20 bp, Artificial
  CRISPR gRNA sequence
tgcctgagcttgtttacttc

SEQ ID NO: 27596 - DNA, 20 bp, Artificial
  CRISPR gRNA sequence
agcttgtttacttccacagc

SEQ ID NO: 27597 - DNA, 20 bp, Artificial
  CRISPR gRNA sequence
gtttacttccacagccaagg

SEQ ID NO: 27598 - DNA, 20 bp, Artificial
  CRISPR gRNA sequence
tttacttccacagccaaggg

SEQ ID NO: 27599 - DNA, 20 bp, Artificial
  CRISPR gRNA sequence
acttccacagccaagggatg

SEQ ID NO: 27600 - DNA, 20 bp, Artificial
  CRISPR gRNA sequence
cttccacagccaagggatgg

SEQ ID NO: 27601 - DNA, 20 bp, Artificial
  CRISPR gRNA sequence
ccacagccaagggatggcct

SEQ ID NO: 27602 - DNA, 20 bp, Artificial
  CRISPR gRNA sequence
cacagccaagggatggcctc

SEQ ID NO: 27603 - DNA, 20 bp, Artificial
  CRISPR gRNA sequence
cccagggagaatctttcccc

SEQ ID NO: 27604 - DNA, 20 bp, Artificial
  CRISPR gRNA sequence
tcccccattttgaaattccc

SEQ ID NO: 27605 - DNA, 20 bp, Artificial
  CRISPR gRNA sequence
cccccattttgaaattccca

SEQ ID NO: 27606 - DNA, 20 bp, Artificial
  CRISPR gRNA sequence
ccccattttgaaattcccag

SEQ ID NO: 27607 - DNA, 20 bp, Artificial
  CRISPR gRNA sequence
tgaaattcccaggagctttt

SEQ ID NO: 27608 - DNA, 20 bp, Artificial
  CRISPR gRNA sequence
gaaattcccaggagcttttg

SEQ ID NO: 27609 - DNA, 20 bp, Artificial
  CRISPR gRNA sequence
aaattcccaggagcttttga

SEQ ID NO: 27610 - DNA, 20 bp, Artificial
  CRISPR gRNA sequence
ccaggagcttttgatgtgca

SEQ ID NO: 27611 - DNA, 20 bp, Artificial
  CRISPR gRNA sequence
ttgatgtgcagctaggatga

SEQ ID NO: 27612 - DNA, 20 bp, Artificial
  CRISPR gRNA sequence
tgatgtgcagctaggatgaa

SEQ ID NO: 27613 - DNA, 20 bp, Artificial
  CRISPR gRNA sequence
gatgtgcagctaggatgaaa

SEQ ID NO: 27614 - DNA, 20 bp, Artificial
  CRISPR gRNA sequence
atgtgcagctaggatgaaaa

SEQ ID NO: 27615 - DNA, 20 bp, Artificial
  CRISPR gRNA sequence
ggatgaaaaagcaaccctac

SEQ ID NO: 27616 - DNA, 20 bp, Artificial
  CRISPR gRNA sequence
cttgcctgggactatcctgg

SEQ ID NO: 27617 - DNA, 20 bp, Artificial
  CRISPR gRNA sequence
gcctgggactatcctggttt

SEQ ID NO: 27618 - DNA, 20 bp, Artificial
  CRISPR gRNA sequence
cctgggactatcctggtttg

SEQ ID NO: 27619 - DNA, 20 bp, Artificial
  CRISPR gRNA sequence
ggactatcctggtttgaaaa

SEQ ID NO: 27620 - DNA, 20 bp, Artificial
  CRISPR gRNA sequence
tcctggtttgaaaactgaaa

SEQ ID NO: 27621 - DNA, 20 bp, Artificial
  CRISPR gRNA sequence
gtttgaaaactgaaagtctt

SEQ ID NO: 27622 - DNA, 20 bp, Artificial
  CRISPR gRNA sequence
gaaaactgaaagtcttgcat

SEQ ID NO: 27623 - DNA, 20 bp, Artificial
  CRISPR gRNA sequence
aaaactgaaagtcttgcatc

SEQ ID NO: 27624 - DNA, 20 bp, Artificial
  CRISPR gRNA sequence
aaagtcttgcatcccaagaa

SEQ ID NO: 27625 - DNA, 20 bp, Artificial
  CRISPR gRNA sequence
gcatcccaagaagcccctta

SEQ ID NO: 27626 - DNA, 20 bp, Artificial
  CRISPR gRNA sequence
catcccaagaagccccttag

SEQ ID NO: 27627 - DNA, 20 bp, Artificial
  CRISPR gRNA sequence
agtcccaggcaaactgggac

SEQ ID NO: 27628 - DNA, 20 bp, Artificial
  CRISPR gRNA sequence
gtcccaggcaaactgggaca

SEQ ID NO: 27629 - DNA, 20 bp, Artificial
  CRISPR gRNA sequence
ggacagttggttgctctatg

SEQ ID NO: 27630 - DNA, 20 bp, Artificial
  CRISPR gRNA sequence
gttgctctatgtgtggccag

SEQ ID NO: 27631 - DNA, 20 bp, Artificial
  CRISPR gRNA sequence
ctctatgtgtggccagggct

SEQ ID NO: 27632 - DNA, 20 bp, Artificial
  CRISPR gRNA sequence
tatgtgtggccagggctggg

SEQ ID NO: 27633 - DNA, 20 bp, Artificial
  CRISPR gRNA sequence
tgtgtggccagggctggggg

SEQ ID NO: 27634 - DNA, 20 bp, Artificial
  CRISPR gRNA sequence
ggggccacaccctaggcagt

SEQ ID NO: 27635 - DNA, 20 bp, Artificial
  CRISPR gRNA sequence
ggcagtgttgctggggtgac

SEQ ID NO: 27636 - DNA, 20 bp, Artificial
  CRISPR gRNA sequence
ctggggtgacagaaatggag

SEQ ID NO: 27637 - DNA, 20 bp, Artificial
  CRISPR gRNA sequence
gggtgacagaaatggagacc

SEQ ID NO: 27638 - DNA, 20 bp, Artificial
  CRISPR gRNA sequence
ggcaaggctctagggagtcc

SEQ ID NO: 27639 - DNA, 20 bp, Artificial
  CRISPR gRNA sequence
tagggagtccagttgtgtct

SEQ ID NO: 27640 - DNA, 20 bp, Artificial
  CRISPR gRNA sequence
gggagtccagttgtgtctgg

SEQ ID NO: 27641 - DNA, 20 bp, Artificial
  CRISPR gRNA sequence
tgtctgggtcactgaggagg

SEQ ID NO: 27642 - DNA, 20 bp, Artificial
  CRISPR gRNA sequence
ggtcactgaggaggggcagc

SEQ ID NO: 27643 - DNA, 20 bp, Artificial
  CRISPR gRNA sequence
aggaggggcagcccaccata

SEQ ID NO: 27644 - DNA, 20 bp, Artificial
  CRISPR gRNA sequence
ttatatttagatctgtcaga

SEQ ID NO: 27645 - DNA, 20 bp, Artificial
  CRISPR gRNA sequence
tatttagatctgtcagaata

SEQ ID NO: 27646 - DNA, 20 bp, Artificial
  CRISPR gRNA sequence
agatctgtcagaatatagct

SEQ ID NO: 27647 - DNA, 20 bp, Artificial
  CRISPR gRNA sequence
gatctgtcagaatatagctt

SEQ ID NO: 27648 - DNA, 20 bp, Artificial
  CRISPR gRNA sequence
tcagaatatagcttttcttt

SEQ ID NO: 27649 - DNA, 20 bp, Artificial
  CRISPR gRNA sequence
ttctttctttctttcctttc

SEQ ID NO: 27650 - DNA, 20 bp, Artificial
  CRISPR gRNA sequence
tctttctttctttcctttct

SEQ ID NO: 27651 - DNA, 20 bp, Artificial
  CRISPR gRNA sequence
ctttctttctttcctttctt

SEQ ID NO: 27652 - DNA, 20 bp, Artificial
  CRISPR gRNA sequence
tttctttctttcctttcttc

SEQ ID NO: 27653 - DNA, 20 bp, Artificial
  CRISPR gRNA sequence
tctttctttcctttcttctc

SEQ ID NO: 27654 - DNA, 20 bp, Artificial
  CRISPR gRNA sequence
ctttctttcctttcttctct

SEQ ID NO: 27655 - DNA, 20 bp, Artificial
  CRISPR gRNA sequence
tttctttcctttcttctctc

SEQ ID NO: 27656 - DNA, 20 bp, Artificial
  CRISPR gRNA sequence
tctttcctttcttctctctt

SEQ ID NO: 27657 - DNA, 20 bp, Artificial
  CRISPR gRNA sequence
ctttcctttcttctctcttt

SEQ ID NO: 27658 - DNA, 20 bp, Artificial
  CRISPR gRNA sequence
tttcctttcttctctctttc

SEQ ID NO: 27659 - DNA, 20 bp, Artificial
  CRISPR gRNA sequence
tcctttcttctctctttctt

SEQ ID NO: 27660 - DNA, 20 bp, Artificial
  CRISPR gRNA sequence
cctttcttctctctttcttt

SEQ ID NO: 27661 - DNA, 20 bp, Artificial
  CRISPR gRNA sequence
ctttcttctctctttctttt

SEQ ID NO: 27662 - DNA, 20 bp, Artificial
  CRISPR gRNA sequence
tcttctctctttctttttct

SEQ ID NO: 27663 - DNA, 20 bp, Artificial
  CRISPR gRNA sequence
cttctctctttctttttctt

SEQ ID NO: 27664 - DNA, 20 bp, Artificial
  CRISPR gRNA sequence
ttctctctttctttttcttt

SEQ ID NO: 27665 - DNA, 20 bp, Artificial
  CRISPR gRNA sequence
ctctctttctttttctttct

SEQ ID NO: 27666 - DNA, 20 bp, Artificial
  CRISPR gRNA sequence
tctctttctttttctttctt

SEQ ID NO: 27667 - DNA, 20 bp, Artificial
  CRISPR gRNA sequence
tctttctttttctttctttc

SEQ ID NO: 27668 - DNA, 20 bp, Artificial
  CRISPR gRNA sequence
tttctttttctttctttctt

SEQ ID NO: 27669 - DNA, 20 bp, Artificial
  CRISPR gRNA sequence
tctttttctttctttcttct

SEQ ID NO: 27670 - DNA, 20 bp, Artificial
  CRISPR gRNA sequence
ctttttctttctttcttctt

SEQ ID NO: 27671 - DNA, 20 bp, Artificial
  CRISPR gRNA sequence
tttttctttctttcttcttt

SEQ ID NO: 27672 - DNA, 20 bp, Artificial
  CRISPR gRNA sequence
tttctttctttcttctttct

SEQ ID NO: 27673 - DNA, 20 bp, Artificial
  CRISPR gRNA sequence
ttctttctttcttctttctt

SEQ ID NO: 27674 - DNA, 20 bp, Artificial
  CRISPR gRNA sequence
tctttctttcttctttcttt

SEQ ID NO: 27675 - DNA, 20 bp, Artificial
  CRISPR gRNA sequence
ctttctttcttctttctttc

SEQ ID NO: 27676 - DNA, 20 bp, Artificial
  CRISPR gRNA sequence
tttctttcttctttctttct

SEQ ID NO: 27677 - DNA, 20 bp, Artificial
  CRISPR gRNA sequence
tctttcttctttctttcttt

SEQ ID NO: 27678 - DNA, 20 bp, Artificial
  CRISPR gRNA sequence
ctttcttctttctttctttc

SEQ ID NO: 27679 - DNA, 20 bp, Artificial
  CRISPR gRNA sequence
tttcttctttctttctttct

SEQ ID NO: 27680 - DNA, 20 bp, Artificial
  CRISPR gRNA sequence
tcttctttctttctttctct

SEQ ID NO: 27681 - DNA, 20 bp, Artificial
  CRISPR gRNA sequence
cttctttctttctttctctc

SEQ ID NO: 27682 - DNA, 20 bp, Artificial
  CRISPR gRNA sequence
ttctttctttctttctctct

SEQ ID NO: 27683 - DNA, 20 bp, Artificial
  CRISPR gRNA sequence
ctttctttctttctctcttt

SEQ ID NO: 27684 - DNA, 20 bp, Artificial
  CRISPR gRNA sequence
tttctttctttctctctttc

SEQ ID NO: 27685 - DNA, 20 bp, Artificial
  CRISPR gRNA sequence
tctttctttctctctttctt

SEQ ID NO: 27686 - DNA, 20 bp, Artificial
  CRISPR gRNA sequence
ctttctttctctctttcttt

SEQ ID NO: 27687 - DNA, 20 bp, Artificial
  CRISPR gRNA sequence
tttctttctctctttctttc

SEQ ID NO: 27688 - DNA, 20 bp, Artificial
  CRISPR gRNA sequence
tctttctctctttctttcct

SEQ ID NO: 27689 - DNA, 20 bp, Artificial
  CRISPR gRNA sequence
ctttctctctttctttcctc

SEQ ID NO: 27690 - DNA, 20 bp, Artificial
  CRISPR gRNA sequence
tttctctctttctttcctct

SEQ ID NO: 27691 - DNA, 20 bp, Artificial
  CRISPR gRNA sequence
tctctctttctttcctcttt

SEQ ID NO: 27692 - DNA, 20 bp, Artificial
  CRISPR gRNA sequence
ctctctttctttcctctttc

SEQ ID NO: 27693 - DNA, 20 bp, Artificial
  CRISPR gRNA sequence
tctctttctttcctctttct

SEQ ID NO: 27694 - DNA, 20 bp, Artificial
  CRISPR gRNA sequence
tctttctttcctctttcttt

SEQ ID NO: 27695 - DNA, 20 bp, Artificial
  CRISPR gRNA sequence
tttctttcctctttctttcc

SEQ ID NO: 27696 - DNA, 20 bp, Artificial
  CRISPR gRNA sequence
tctttcctctttctttcctt

SEQ ID NO: 27697 - DNA, 20 bp, Artificial
  CRISPR gRNA sequence
ctttcctctttctttccttt

SEQ ID NO: 27698 - DNA, 20 bp, Artificial
  CRISPR gRNA sequence
tttcctctttctttcctttc

SEQ ID NO: 27699 - DNA, 20 bp, Artificial
  CRISPR gRNA sequence
tcctctttctttcctttccc

SEQ ID NO: 27700 - DNA, 20 bp, Artificial
  CRISPR gRNA sequence
cctctttctttcctttccct

SEQ ID NO: 27701 - DNA, 20 bp, Artificial
  CRISPR gRNA sequence
ctctttctttcctttccctt

SEQ ID NO: 27702 - DNA, 20 bp, Artificial
  CRISPR gRNA sequence
tttctttcctttcccttcct

SEQ ID NO: 27703 - DNA, 20 bp, Artificial
  CRISPR gRNA sequence
tctttcctttcccttccttt

SEQ ID NO: 27704 - DNA, 20 bp, Artificial
  CRISPR gRNA sequence
ctttcctttcccttcctttt

SEQ ID NO: 27705 - DNA, 20 bp, Artificial
  CRISPR gRNA sequence
tttcctttcccttccttttc

SEQ ID NO: 27706 - DNA, 20 bp, Artificial
  CRISPR gRNA sequence
tcctttcccttccttttctt

SEQ ID NO: 27707 - DNA, 20 bp, Artificial
  CRISPR gRNA sequence
cctttcccttccttttcttt

SEQ ID NO: 27708 - DNA, 20 bp, Artificial
  CRISPR gRNA sequence
ctttcccttccttttctttc

SEQ ID NO: 27709 - DNA, 20 bp, Artificial
  CRISPR gRNA sequence
tcccttccttttctttcctt

SEQ ID NO: 27710 - DNA, 20 bp, Artificial
  CRISPR gRNA sequence
cccttccttttctttccttc

SEQ ID NO: 27711 - DNA, 20 bp, Artificial
  CRISPR gRNA sequence
ccttccttttctttccttcc

SEQ ID NO: 27712 - DNA, 20 bp, Artificial
  CRISPR gRNA sequence
ccttttctttccttccctcc

SEQ ID NO: 27713 - DNA, 20 bp, Artificial
  CRISPR gRNA sequence
cttttctttccttccctccc

SEQ ID NO: 27714 - DNA, 20 bp, Artificial
  CRISPR gRNA sequence
ttctttccttccctccctcc

SEQ ID NO: 27715 - DNA, 20 bp, Artificial
  CRISPR gRNA sequence
tctttccttccctccctccc

SEQ ID NO: 27716 - DNA, 20 bp, Artificial
  CRISPR gRNA sequence
ctttccttccctccctccct

SEQ ID NO: 27717 - DNA, 20 bp, Artificial
  CRISPR gRNA sequence
tttccttccctccctccctc

SEQ ID NO: 27718 - DNA, 20 bp, Artificial
  CRISPR gRNA sequence
tccttccctccctccctcct

SEQ ID NO: 27719 - DNA, 20 bp, Artificial
  CRISPR gRNA sequence
ccttccctccctccctcctt

SEQ ID NO: 27720 - DNA, 20 bp, Artificial
  CRISPR gRNA sequence
cttccctccctccctccttc

SEQ ID NO: 27721 - DNA, 20 bp, Artificial
  CRISPR gRNA sequence
ccctccctccctccttcctt

SEQ ID NO: 27722 - DNA, 20 bp, Artificial
  CRISPR gRNA sequence
cctccctccctccttccttc

SEQ ID NO: 27723 - DNA, 20 bp, Artificial
  CRISPR gRNA sequence
cctccctccttccttccttc

SEQ ID NO: 27724 - DNA, 20 bp, Artificial
  CRISPR gRNA sequence
cctccttccttccttccctc

SEQ ID NO: 27725 - DNA, 20 bp, Artificial
  CRISPR gRNA sequence
cttccttccttccctccctc

SEQ ID NO: 27726 - DNA, 20 bp, Artificial
  CRISPR gRNA sequence
ccttccttccctccctccct

SEQ ID NO: 27727 - DNA, 20 bp, Artificial
  CRISPR gRNA sequence
cttccttccctccctccctt

SEQ ID NO: 27728 - DNA, 20 bp, Artificial
  CRISPR gRNA sequence
ccttccctccctcccttctt

SEQ ID NO: 27729 - DNA, 20 bp, Artificial
  CRISPR gRNA sequence
cttccctccctcccttcttc

SEQ ID NO: 27730 - DNA, 20 bp, Artificial
  CRISPR gRNA sequence
ccctccctcccttcttcccc

SEQ ID NO: 27731 - DNA, 20 bp, Artificial
  CRISPR gRNA sequence
cctccctcccttcttccccc

SEQ ID NO: 27732 - DNA, 20 bp, Artificial
  CRISPR gRNA sequence
cctcccttcttccccctttt

SEQ ID NO: 27733 - DNA, 20 bp, Artificial
  CRISPR gRNA sequence
ccttcttcccccttttcttc

SEQ ID NO: 27734 - DNA, 20 bp, Artificial
  CRISPR gRNA sequence
cttcccccttttcttctttt

SEQ ID NO: 27735 - DNA, 20 bp, Artificial
  CRISPR gRNA sequence
ttcccccttttcttcttttt

SEQ ID NO: 27736 - DNA, 20 bp, Artificial
  CRISPR gRNA sequence
cccccttttcttctttttct

SEQ ID NO: 27737 - DNA, 20 bp, Artificial
  CRISPR gRNA sequence
ccccttttcttctttttctt

SEQ ID NO: 27738 - DNA, 20 bp, Artificial
  CRISPR gRNA sequence
ttcttctttttctttctctc

SEQ ID NO: 27739 - DNA, 20 bp, Artificial
  CRISPR gRNA sequence
tcttctttttctttctctct

SEQ ID NO: 27740 - DNA, 20 bp, Artificial
  CRISPR gRNA sequence
cttctttttctttctctctg

SEQ ID NO: 27741 - DNA, 20 bp, Artificial
  CRISPR gRNA sequence
ttctttttctttctctctgt

SEQ ID NO: 27742 - DNA, 20 bp, Artificial
  CRISPR gRNA sequence
ctttttctttctctctgttt

SEQ ID NO: 27743 - DNA, 20 bp, Artificial
  CRISPR gRNA sequence
tttttctttctctctgtttc

SEQ ID NO: 27744 - DNA, 20 bp, Artificial
  CRISPR gRNA sequence
tttctttctctctgtttctt

SEQ ID NO: 27745 - DNA, 20 bp, Artificial
  CRISPR gRNA sequence
ttctttctctctgtttcttt

SEQ ID NO: 27746 - DNA, 20 bp, Artificial
  CRISPR gRNA sequence
tctttctctctgtttctttc

SEQ ID NO: 27747 - DNA, 20 bp, Artificial
  CRISPR gRNA sequence
ctttctctctgtttctttct

SEQ ID NO: 27748 - DNA, 20 bp, Artificial
  CRISPR gRNA sequence
tttctctctgtttctttctt

SEQ ID NO: 27749 - DNA, 20 bp, Artificial
  CRISPR gRNA sequence
tctctctgtttctttctttc

SEQ ID NO: 27750 - DNA, 20 bp, Artificial
  CRISPR gRNA sequence
ctctctgtttctttctttct

SEQ ID NO: 27751 - DNA, 20 bp, Artificial
  CRISPR gRNA sequence
tctctgtttctttctttctt

SEQ ID NO: 27752 - DNA, 20 bp, Artificial
  CRISPR gRNA sequence
tctgtttctttctttctttc

SEQ ID NO: 27753 - DNA, 20 bp, Artificial
  CRISPR gRNA sequence
tgtttctttctttctttctc

SEQ ID NO: 27754 - DNA, 20 bp, Artificial
  CRISPR gRNA sequence
tttctttctttctttctctc

SEQ ID NO: 27755 - DNA, 20 bp, Artificial
  CRISPR gRNA sequence
ctttctttctttctctctct

SEQ ID NO: 27756 - DNA, 20 bp, Artificial
  CRISPR gRNA sequence
tttctttctttctctctctc

SEQ ID NO: 27757 - DNA, 20 bp, Artificial
  CRISPR gRNA sequence
tctttctttctctctctctc

SEQ ID NO: 27758 - DNA, 20 bp, Artificial
  CRISPR gRNA sequence
ctttctttctctctctctct

SEQ ID NO: 27759 - DNA, 20 bp, Artificial
  CRISPR gRNA sequence
tttctttctctctctctctc

SEQ ID NO: 27760 - DNA, 20 bp, Artificial
  CRISPR gRNA sequence
tctttctctctctctctccc

SEQ ID NO: 27761 - DNA, 20 bp, Artificial
  CRISPR gRNA sequence
ctttctctctctctctccct

SEQ ID NO: 27762 - DNA, 20 bp, Artificial
  CRISPR gRNA sequence
tttctctctctctctccctt

SEQ ID NO: 27763 - DNA, 20 bp, Artificial
  CRISPR gRNA sequence
tctctctctctctcccttcc

SEQ ID NO: 27764 - DNA, 20 bp, Artificial
  CRISPR gRNA sequence
ctctctctctctcccttcct

SEQ ID NO: 27765 - DNA, 20 bp, Artificial
  CRISPR gRNA sequence
tctctctctctcccttcctt

SEQ ID NO: 27766 - DNA, 20 bp, Artificial
  CRISPR gRNA sequence
tctctctctcccttccttcc

SEQ ID NO: 27767 - DNA, 20 bp, Artificial
  CRISPR gRNA sequence
tctctctcccttccttcctc

SEQ ID NO: 27768 - DNA, 20 bp, Artificial
  CRISPR gRNA sequence
tctctcccttccttcctccc

SEQ ID NO: 27769 - DNA, 20 bp, Artificial
  CRISPR gRNA sequence
tctcccttccttcctccctc

SEQ ID NO: 27770 - DNA, 20 bp, Artificial
  CRISPR gRNA sequence
tcccttccttcctccctccc

SEQ ID NO: 27771 - DNA, 20 bp, Artificial
  CRISPR gRNA sequence
ccttccttcctccctcccta

SEQ ID NO: 27772 - DNA, 20 bp, Artificial
  CRISPR gRNA sequence
ccttcctccctccctatctc

SEQ ID NO: 27773 - DNA, 20 bp, Artificial
  CRISPR gRNA sequence
cttcctccctccctatctct

SEQ ID NO: 27774 - DNA, 20 bp, Artificial
  CRISPR gRNA sequence
cctccctccctatctctctc

SEQ ID NO: 27775 - DNA, 20 bp, Artificial
  CRISPR gRNA sequence
ctccctccctatctctctct

SEQ ID NO: 27776 - DNA, 20 bp, Artificial
  CRISPR gRNA sequence
cctccctatctctctctttc

SEQ ID NO: 27777 - DNA, 20 bp, Artificial
  CRISPR gRNA sequence
cctatctctctctttctttc

SEQ ID NO: 27778 - DNA, 20 bp, Artificial
  CRISPR gRNA sequence
tctctctctttctttctttc

SEQ ID NO: 27779 - DNA, 20 bp, Artificial
  CRISPR gRNA sequence
tctctttctttctttctttc

SEQ ID NO: 27780 - DNA, 20 bp, Artificial
  CRISPR gRNA sequence
tctttctttctttctttcct

SEQ ID NO: 27781 - DNA, 20 bp, Artificial
  CRISPR gRNA sequence
tttctttctttctttccttc

SEQ ID NO: 27782 - DNA, 20 bp, Artificial
  CRISPR gRNA sequence
tctttctttctttccttctt

SEQ ID NO: 27783 - DNA, 20 bp, Artificial
  CRISPR gRNA sequence
ctttctttctttccttcttt

SEQ ID NO: 27784 - DNA, 20 bp, Artificial
  CRISPR gRNA sequence
tttctttctttccttctttt

SEQ ID NO: 27785 - DNA, 20 bp, Artificial
  CRISPR gRNA sequence
tctttctttccttcttttct

SEQ ID NO: 27786 - DNA, 20 bp, Artificial
  CRISPR gRNA sequence
ctttctttccttcttttctt

SEQ ID NO: 27787 - DNA, 20 bp, Artificial
  CRISPR gRNA sequence
tttctttccttcttttcttt

SEQ ID NO: 27788 - DNA, 20 bp, Artificial
  CRISPR gRNA sequence
tctttccttcttttctttct

SEQ ID NO: 27789 - DNA, 20 bp, Artificial
  CRISPR gRNA sequence
ctttccttcttttctttctt

SEQ ID NO: 27790 - DNA, 20 bp, Artificial
  CRISPR gRNA sequence
tttccttcttttctttcttt

SEQ ID NO: 27791 - DNA, 20 bp, Artificial
  CRISPR gRNA sequence
tccttcttttctttctttcc

SEQ ID NO: 27792 - DNA, 20 bp, Artificial
  CRISPR gRNA sequence
ccttcttttctttctttcct

SEQ ID NO: 27793 - DNA, 20 bp, Artificial
  CRISPR gRNA sequence
cttcttttctttctttcctt

SEQ ID NO: 27794 - DNA, 20 bp, Artificial
  CRISPR gRNA sequence
cttttctttctttcctttct

SEQ ID NO: 27795 - DNA, 20 bp, Artificial
  CRISPR gRNA sequence
ttttctttctttcctttctc

SEQ ID NO: 27796 - DNA, 20 bp, Artificial
  CRISPR gRNA sequence
ttctttctttcctttctctc

SEQ ID NO: 27797 - DNA, 20 bp, Artificial
  CRISPR gRNA sequence
tctttctttcctttctctcc

SEQ ID NO: 27798 - DNA, 20 bp, Artificial
  CRISPR gRNA sequence
ctttctttcctttctctcct

SEQ ID NO: 27799 - DNA, 20 bp, Artificial
  CRISPR gRNA sequence
tttctttcctttctctcctt

SEQ ID NO: 27800 - DNA, 20 bp, Artificial
  CRISPR gRNA sequence
tctttcctttctctcctttc

SEQ ID NO: 27801 - DNA, 20 bp, Artificial
  CRISPR gRNA sequence
ctttcctttctctcctttct

SEQ ID NO: 27802 - DNA, 20 bp, Artificial
  CRISPR gRNA sequence
tttcctttctctcctttctc

SEQ ID NO: 27803 - DNA, 20 bp, Artificial
  CRISPR gRNA sequence
tcctttctctcctttctctt

SEQ ID NO: 27804 - DNA, 20 bp, Artificial
  CRISPR gRNA sequence
cctttctctcctttctcttt

SEQ ID NO: 27805 - DNA, 20 bp, Artificial
  CRISPR gRNA sequence
ctttctctcctttctctttc

SEQ ID NO: 27806 - DNA, 20 bp, Artificial
  CRISPR gRNA sequence
tctctcctttctctttcttt

SEQ ID NO: 27807 - DNA, 20 bp, Artificial
  CRISPR gRNA sequence
ctctcctttctctttctttc

SEQ ID NO: 27808 - DNA, 20 bp, Artificial
  CRISPR gRNA sequence
tctcctttctctttctttct

SEQ ID NO: 27809 - DNA, 20 bp, Artificial
  CRISPR gRNA sequence
tcctttctctttctttcttt

SEQ ID NO: 27810 - DNA, 20 bp, Artificial
  CRISPR gRNA sequence
ctttctctttctttctttcc

SEQ ID NO: 27811 - DNA, 20 bp, Artificial
  CRISPR gRNA sequence
tctctttctttctttccatt

SEQ ID NO: 27812 - DNA, 20 bp, Artificial
  CRISPR gRNA sequence
ctctttctttctttccattc

SEQ ID NO: 27813 - DNA, 20 bp, Artificial
  CRISPR gRNA sequence
tctttctttctttccattct

SEQ ID NO: 27814 - DNA, 20 bp, Artificial
  CRISPR gRNA sequence
tttctttctttccattctct

SEQ ID NO: 27815 - DNA, 20 bp, Artificial
  CRISPR gRNA sequence
tctttctttccattctcttt

SEQ ID NO: 27816 - DNA, 20 bp, Artificial
  CRISPR gRNA sequence
ctttctttccattctctttc

SEQ ID NO: 27817 - DNA, 20 bp, Artificial
  CRISPR gRNA sequence
tttctttccattctctttct

SEQ ID NO: 27818 - DNA, 20 bp, Artificial
  CRISPR gRNA sequence
tctttccattctctttcttt

SEQ ID NO: 27819 - DNA, 20 bp, Artificial
  CRISPR gRNA sequence
ctttccattctctttctttc

SEQ ID NO: 27820 - DNA, 20 bp, Artificial
  CRISPR gRNA sequence
tttccattctctttctttct

SEQ ID NO: 27821 - DNA, 20 bp, Artificial
  CRISPR gRNA sequence
tccattctctttctttctct

SEQ ID NO: 27822 - DNA, 20 bp, Artificial
  CRISPR gRNA sequence
ccattctctttctttctctt

SEQ ID NO: 27823 - DNA, 20 bp, Artificial
  CRISPR gRNA sequence
cattctctttctttctcttt

SEQ ID NO: 27824 - DNA, 20 bp, Artificial
  CRISPR gRNA sequence
tctttctttctctttccttc

SEQ ID NO: 27825 - DNA, 20 bp, Artificial
  CRISPR gRNA sequence
tttctttctctttccttccc

SEQ ID NO: 27826 - DNA, 20 bp, Artificial
  CRISPR gRNA sequence
tctttctctttccttccctc

SEQ ID NO: 27827 - DNA, 20 bp, Artificial
  CRISPR gRNA sequence
ctttctctttccttccctcc

SEQ ID NO: 27828 - DNA, 20 bp, Artificial
  CRISPR gRNA sequence
tttctctttccttccctccc

SEQ ID NO: 27829 - DNA, 20 bp, Artificial
  CRISPR gRNA sequence
tctctttccttccctccctt

SEQ ID NO: 27830 - DNA, 20 bp, Artificial
  CRISPR gRNA sequence
ctctttccttccctcccttc

SEQ ID NO: 27831 - DNA, 20 bp, Artificial
  CRISPR gRNA sequence
tctttccttccctcccttcc

SEQ ID NO: 27832 - DNA, 20 bp, Artificial
  CRISPR gRNA sequence
tttccttccctcccttcctt

SEQ ID NO: 27833 - DNA, 20 bp, Artificial
  CRISPR gRNA sequence
tccttccctcccttccttct

SEQ ID NO: 27834 - DNA, 20 bp, Artificial
  CRISPR gRNA sequence
ccttccctcccttccttctc

SEQ ID NO: 27835 - DNA, 20 bp, Artificial
  CRISPR gRNA sequence
cttccctcccttccttctct

SEQ ID NO: 27836 - DNA, 20 bp, Artificial
  CRISPR gRNA sequence
ccctcccttccttctcttcc

SEQ ID NO: 27837 - DNA, 20 bp, Artificial
  CRISPR gRNA sequence
cctcccttccttctcttcct

SEQ ID NO: 27838 - DNA, 20 bp, Artificial
  CRISPR gRNA sequence
ccttccttctcttccttcct

SEQ ID NO: 27839 - DNA, 20 bp, Artificial
  CRISPR gRNA sequence
ccttctcttccttccttctt

SEQ ID NO: 27840 - DNA, 20 bp, Artificial
  CRISPR gRNA sequence
cttctcttccttccttcttt

SEQ ID NO: 27841 - DNA, 20 bp, Artificial
  CRISPR gRNA sequence
ctcttccttccttctttttc

SEQ ID NO: 27842 - DNA, 20 bp, Artificial
  CRISPR gRNA sequence
tcttccttccttctttttcc

SEQ ID NO: 27843 - DNA, 20 bp, Artificial
  CRISPR gRNA sequence
ttccttccttctttttcctt

SEQ ID NO: 27844 - DNA, 20 bp, Artificial
  CRISPR gRNA sequence
ccttccttctttttcctttc

SEQ ID NO: 27845 - DNA, 20 bp, Artificial
  CRISPR gRNA sequence
cttccttctttttcctttcc

SEQ ID NO: 27846 - DNA, 20 bp, Artificial
  CRISPR gRNA sequence
ccttctttttcctttccttt

SEQ ID NO: 27847 - DNA, 20 bp, Artificial
  CRISPR gRNA sequence
cttctttttcctttcctttt

SEQ ID NO: 27848 - DNA, 20 bp, Artificial
  CRISPR gRNA sequence
ctttttcctttccttttctt

SEQ ID NO: 27849 - DNA, 20 bp, Artificial
  CRISPR gRNA sequence
tttttcctttccttttcttt

SEQ ID NO: 27850 - DNA, 20 bp, Artificial
  CRISPR gRNA sequence
tttcctttccttttctttcc

SEQ ID NO: 27851 - DNA, 20 bp, Artificial
  CRISPR gRNA sequence
ttcctttccttttctttcct

SEQ ID NO: 27852 - DNA, 20 bp, Artificial
  CRISPR gRNA sequence
tcctttccttttctttcctt

SEQ ID NO: 27853 - DNA, 20 bp, Artificial
  CRISPR gRNA sequence
cctttccttttctttccttt

SEQ ID NO: 27854 - DNA, 20 bp, Artificial
  CRISPR gRNA sequence
ctttccttttctttcctttt

SEQ ID NO: 27855 - DNA, 20 bp, Artificial
  CRISPR gRNA sequence
tccttttctttccttttctt

SEQ ID NO: 27856 - DNA, 20 bp, Artificial
  CRISPR gRNA sequence
ccttttctttccttttcttt

SEQ ID NO: 27857 - DNA, 20 bp, Artificial
  CRISPR gRNA sequence
cttttctttccttttctttt

SEQ ID NO: 27858 - DNA, 20 bp, Artificial
  CRISPR gRNA sequence
ttctttccttttcttttctt

SEQ ID NO: 27859 - DNA, 20 bp, Artificial
  CRISPR gRNA sequence
tctttccttttcttttcttt

SEQ ID NO: 27860 - DNA, 20 bp, Artificial
  CRISPR gRNA sequence
ctttccttttcttttctttc

SEQ ID NO: 27861 - DNA, 20 bp, Artificial
  CRISPR gRNA sequence
tttccttttcttttctttct

SEQ ID NO: 27862 - DNA, 20 bp, Artificial
  CRISPR gRNA sequence
tccttttcttttctttcttg

SEQ ID NO: 27863 - DNA, 20 bp, Artificial
  CRISPR gRNA sequence
ccttttcttttctttcttga

SEQ ID NO: 27864 - DNA, 20 bp, Artificial
  CRISPR gRNA sequence
cttttcttttctttcttgag

SEQ ID NO: 27865 - DNA, 20 bp, Artificial
  CRISPR gRNA sequence
ttcttttctttcttgaggca

SEQ ID NO: 27866 - DNA, 20 bp, Artificial
  CRISPR gRNA sequence
tcttttctttcttgaggcag

SEQ ID NO: 27867 - DNA, 20 bp, Artificial
  CRISPR gRNA sequence
cttttctttcttgaggcaga

SEQ ID NO: 27868 - DNA, 20 bp, Artificial
  CRISPR gRNA sequence
ttttctttcttgaggcagag

SEQ ID NO: 27869 - DNA, 20 bp, Artificial
  CRISPR gRNA sequence
ttctttcttgaggcagagtc

SEQ ID NO: 27870 - DNA, 20 bp, Artificial
  CRISPR gRNA sequence
tctttcttgaggcagagtct

SEQ ID NO: 27871 - DNA, 20 bp, Artificial
  CRISPR gRNA sequence
ctttcttgaggcagagtctt

SEQ ID NO: 27872 - DNA, 20 bp, Artificial
  CRISPR gRNA sequence
tttcttgaggcagagtctta

SEQ ID NO: 27873 - DNA, 20 bp, Artificial
  CRISPR gRNA sequence
tcttgaggcagagtcttact

SEQ ID NO: 27874 - DNA, 20 bp, Artificial
  CRISPR gRNA sequence
cttgaggcagagtcttactc

SEQ ID NO: 27875 - DNA, 20 bp, Artificial
  CRISPR gRNA sequence
ttgaggcagagtcttactct

SEQ ID NO: 27876 - DNA, 20 bp, Artificial
  CRISPR gRNA sequence
gaggcagagtcttactctgt

SEQ ID NO: 27877 - DNA, 20 bp, Artificial
  CRISPR gRNA sequence
aggcagagtcttactctgtc

SEQ ID NO: 27878 - DNA, 20 bp, Artificial
  CRISPR gRNA sequence
actctgtccctcaggctgga

SEQ ID NO: 27879 - DNA, 20 bp, Artificial
  CRISPR gRNA sequence
ctctgtccctcaggctggag

SEQ ID NO: 27880 - DNA, 20 bp, Artificial
  CRISPR gRNA sequence
tgtccctcaggctggagttc

SEQ ID NO: 27881 - DNA, 20 bp, Artificial
  CRISPR gRNA sequence
tccctcaggctggagttcag

SEQ ID NO: 27882 - DNA, 20 bp, Artificial
  CRISPR gRNA sequence
aggctggagttcagtggcac

SEQ ID NO: 27883 - DNA, 20 bp, Artificial
  CRISPR gRNA sequence
gagttcagtggcacaatcac

SEQ ID NO: 27884 - DNA, 20 bp, Artificial
  CRISPR gRNA sequence
agtggcacaatcacagctca

SEQ ID NO: 27885 - DNA, 20 bp, Artificial
  CRISPR gRNA sequence
accacagcctcaacctccct

SEQ ID NO: 27886 - DNA, 20 bp, Artificial
  CRISPR gRNA sequence
aacctccctaggctcaagtg

SEQ ID NO: 27887 - DNA, 20 bp, Artificial
  CRISPR gRNA sequence
cctaggctcaagtgatcctc

SEQ ID NO: 27888 - DNA, 20 bp, Artificial
  CRISPR gRNA sequence
ggctcaagtgatcctcccac

SEQ ID NO: 27889 - DNA, 20 bp, Artificial
  CRISPR gRNA sequence
aagtgatcctcccacctcag

SEQ ID NO: 27890 - DNA, 20 bp, Artificial
  CRISPR gRNA sequence
ccacctcagcctccctagta

SEQ ID NO: 27891 - DNA, 20 bp, Artificial
  CRISPR gRNA sequence
agcctccctagtagctggga

SEQ ID NO: 27892 - DNA, 20 bp, Artificial
  CRISPR gRNA sequence
cctagtagctgggactacag

SEQ ID NO: 27893 - DNA, 20 bp, Artificial
  CRISPR gRNA sequence
gtagctgggactacaggcat

SEQ ID NO: 27894 - DNA, 20 bp, Artificial
  CRISPR gRNA sequence
ggactacaggcatgccccac

SEQ ID NO: 27895 - DNA, 20 bp, Artificial
  CRISPR gRNA sequence
caggcatgccccacctgact

SEQ ID NO: 27896 - DNA, 20 bp, Artificial
  CRISPR gRNA sequence
actaatttttgtattttttg

SEQ ID NO: 27897 - DNA, 20 bp, Artificial
  CRISPR gRNA sequence
atttttgtattttttgtaga

SEQ ID NO: 27898 - DNA, 20 bp, Artificial
  CRISPR gRNA sequence
ttgtattttttgtagagaca

SEQ ID NO: 27899 - DNA, 20 bp, Artificial
  CRISPR gRNA sequence
tgtattttttgtagagacag

SEQ ID NO: 27900 - DNA, 20 bp, Artificial
  CRISPR gRNA sequence
gtattttttgtagagacagg

SEQ ID NO: 27901 - DNA, 20 bp, Artificial
  CRISPR gRNA sequence
tattttttgtagagacagga

SEQ ID NO: 27902 - DNA, 20 bp, Artificial
  CRISPR gRNA sequence
tttgtagagacaggatttca

SEQ ID NO: 27903 - DNA, 20 bp, Artificial
  CRISPR gRNA sequence
ttgtagagacaggatttcac

SEQ ID NO: 27904 - DNA, 20 bp, Artificial
  CRISPR gRNA sequence
tgtagagacaggatttcacc

SEQ ID NO: 27905 - DNA, 20 bp, Artificial
  CRISPR gRNA sequence
gtagagacaggatttcacca

SEQ ID NO: 27906 - DNA, 20 bp, Artificial
  CRISPR gRNA sequence
tagagacaggatttcaccat

SEQ ID NO: 27907 - DNA, 20 bp, Artificial
  CRISPR gRNA sequence
caccatgttgcccagtctgg

SEQ ID NO: 27908 - DNA, 20 bp, Artificial
  CRISPR gRNA sequence
accatgttgcccagtctggt

SEQ ID NO: 27909 - DNA, 20 bp, Artificial
  CRISPR gRNA sequence
cccagtctggtctcgagctc

SEQ ID NO: 27910 - DNA, 20 bp, Artificial
  CRISPR gRNA sequence
gtctcgagctcctgggctca

SEQ ID NO: 27911 - DNA, 20 bp, Artificial
  CRISPR gRNA sequence
gagctcctgggctcaagcaa

SEQ ID NO: 27912 - DNA, 20 bp, Artificial
  CRISPR gRNA sequence
ctgggctcaagcaatcctcc

SEQ ID NO: 27913 - DNA, 20 bp, Artificial
  CRISPR gRNA sequence
ggctcaagcaatcctcccac

SEQ ID NO: 27914 - DNA, 20 bp, Artificial
  CRISPR gRNA sequence
aagcaatcctcccacctcag

SEQ ID NO: 27915 - DNA, 20 bp, Artificial
  CRISPR gRNA sequence
ccacctcagcctcccaaagt

SEQ ID NO: 27916 - DNA, 20 bp, Artificial
  CRISPR gRNA sequence
agcctcccaaagtgctagga

SEQ ID NO: 27917 - DNA, 20 bp, Artificial
  CRISPR gRNA sequence
ccaaagtgctaggattacag

SEQ ID NO: 27918 - DNA, 20 bp, Artificial
  CRISPR gRNA sequence
ggattacaggtgcgagctcc

SEQ ID NO: 27919 - DNA, 20 bp, Artificial
  CRISPR gRNA sequence
caggtgcgagctcccgcacc

SEQ ID NO: 27920 - DNA, 20 bp, Artificial
  CRISPR gRNA sequence
ccgcacctggccagaacagg

SEQ ID NO: 27921 - DNA, 20 bp, Artificial
  CRISPR gRNA sequence
gccagaacaggcttttaaat

SEQ ID NO: 27922 - DNA, 20 bp, Artificial
  CRISPR gRNA sequence
ttaaatttgcagctcacctt

SEQ ID NO: 27923 - DNA, 20 bp, Artificial
  CRISPR gRNA sequence
taaatttgcagctcaccttc

SEQ ID NO: 27924 - DNA, 20 bp, Artificial
  CRISPR gRNA sequence
aaatttgcagctcaccttcc

SEQ ID NO: 27925 - DNA, 20 bp, Artificial
  CRISPR gRNA sequence
aatttgcagctcaccttcca

SEQ ID NO: 27926 - DNA, 20 bp, Artificial
  CRISPR gRNA sequence
gcagctcaccttccatctca

SEQ ID NO: 27927 - DNA, 20 bp, Artificial
  CRISPR gRNA sequence
cagctcaccttccatctcaa

SEQ ID NO: 27928 - DNA, 20 bp, Artificial
  CRISPR gRNA sequence
accttccatctcaattatct

SEQ ID NO: 27929 - DNA, 20 bp, Artificial
  CRISPR gRNA sequence
ccatctcaattatctcaggc

SEQ ID NO: 27930 - DNA, 20 bp, Artificial
  CRISPR gRNA sequence
catctcaattatctcaggcc

SEQ ID NO: 27931 - DNA, 20 bp, Artificial
  CRISPR gRNA sequence
aattatctcaggccaccctc

SEQ ID NO: 27932 - DNA, 20 bp, Artificial
  CRISPR gRNA sequence
tctcaggccaccctcctcta

SEQ ID NO: 27933 - DNA, 20 bp, Artificial
  CRISPR gRNA sequence
aggccaccctcctctacagg

SEQ ID NO: 27934 - DNA, 20 bp, Artificial
  CRISPR gRNA sequence
ctctacaggcattgtcatca

SEQ ID NO: 27935 - DNA, 20 bp, Artificial
  CRISPR gRNA sequence
tacaggcattgtcatcatct

SEQ ID NO: 27936 - DNA, 20 bp, Artificial
  CRISPR gRNA sequence
caggcattgtcatcatctcc

SEQ ID NO: 27937 - DNA, 20 bp, Artificial
  CRISPR gRNA sequence
tcatcatctccccattgtac

SEQ ID NO: 27938 - DNA, 20 bp, Artificial
  CRISPR gRNA sequence
cccattgtacaaatggcaat

SEQ ID NO: 27939 - DNA, 20 bp, Artificial
  CRISPR gRNA sequence
tacaaatggcaatgctgaga

SEQ ID NO: 27940 - DNA, 20 bp, Artificial
  CRISPR gRNA sequence
agaacaagagactttaaatt

SEQ ID NO: 27941 - DNA, 20 bp, Artificial
  CRISPR gRNA sequence
taaattgtttatccaaagtc

SEQ ID NO: 27942 - DNA, 20 bp, Artificial
  CRISPR gRNA sequence
aaattgtttatccaaagtca

SEQ ID NO: 27943 - DNA, 20 bp, Artificial
  CRISPR gRNA sequence
aattgtttatccaaagtcat

SEQ ID NO: 27944 - DNA, 20 bp, Artificial
  CRISPR gRNA sequence
tttatccaaagtcataaagg

SEQ ID NO: 27945 - DNA, 20 bp, Artificial
  CRISPR gRNA sequence
atccaaagtcataaaggtca

SEQ ID NO: 27946 - DNA, 20 bp, Artificial
  CRISPR gRNA sequence
tccaaagtcataaaggtcag

SEQ ID NO: 27947 - DNA, 20 bp, Artificial
  CRISPR gRNA sequence
gccctaagctccttccacag

SEQ ID NO: 27948 - DNA, 20 bp, Artificial
  CRISPR gRNA sequence
agctccttccacagaaaaag

SEQ ID NO: 27949 - DNA, 20 bp, Artificial
  CRISPR gRNA sequence
cttccacagaaaaagctaaa

SEQ ID NO: 27950 - DNA, 20 bp, Artificial
  CRISPR gRNA sequence
ccacagaaaaagctaaatga

SEQ ID NO: 27951 - DNA, 20 bp, Artificial
  CRISPR gRNA sequence
cacagaaaaagctaaatgaa

SEQ ID NO: 27952 - DNA, 20 bp, Artificial
  CRISPR gRNA sequence
aatgaatgtttgttccttgg

SEQ ID NO: 27953 - DNA, 20 bp, Artificial
  CRISPR gRNA sequence
gttccttggtaggggtctag

SEQ ID NO: 27954 - DNA, 20 bp, Artificial
  CRISPR gRNA sequence
ttccttggtaggggtctaga

SEQ ID NO: 27955 - DNA, 20 bp, Artificial
  CRISPR gRNA sequence
cttggtaggggtctagatca

SEQ ID NO: 27956 - DNA, 20 bp, Artificial
  CRISPR gRNA sequence
ggtaggggtctagatcatct

SEQ ID NO: 27957 - DNA, 20 bp, Artificial
  CRISPR gRNA sequence
gtaggggtctagatcatcta

SEQ ID NO: 27958 - DNA, 20 bp, Artificial
  CRISPR gRNA sequence
gatcatctaatgattaggaa

SEQ ID NO: 27959 - DNA, 20 bp, Artificial
  CRISPR gRNA sequence
atgattaggaaggagttgtt

SEQ ID NO: 27960 - DNA, 20 bp, Artificial
  CRISPR gRNA sequence
ggaaggagttgttatgcctg

SEQ ID NO: 27961 - DNA, 20 bp, Artificial
  CRISPR gRNA sequence
ttatgcctgtggtatattcg

SEQ ID NO: 27962 - DNA, 20 bp, Artificial
  CRISPR gRNA sequence
tgcctgtggtatattcggtg

SEQ ID NO: 27963 - DNA, 20 bp, Artificial
  CRISPR gRNA sequence
tggtatattcggtgctgttt

SEQ ID NO: 27964 - DNA, 20 bp, Artificial
  CRISPR gRNA sequence
ggtgctgtttttttttggag

SEQ ID NO: 27965 - DNA, 20 bp, Artificial
  CRISPR gRNA sequence
tttttttttggagatggggt

SEQ ID NO: 27966 - DNA, 20 bp, Artificial
  CRISPR gRNA sequence
ttttttggagatggggtctt

SEQ ID NO: 27967 - DNA, 20 bp, Artificial
  CRISPR gRNA sequence
tttttggagatggggtcttg

SEQ ID NO: 27968 - DNA, 20 bp, Artificial
  CRISPR gRNA sequence
ttttggagatggggtcttgc

SEQ ID NO: 27969 - DNA, 20 bp, Artificial
  CRISPR gRNA sequence
tttggagatggggtcttgct

SEQ ID NO: 27970 - DNA, 20 bp, Artificial
  CRISPR gRNA sequence
ttggagatggggtcttgctc

SEQ ID NO: 27971 - DNA, 20 bp, Artificial
  CRISPR gRNA sequence
tggagatggggtcttgctct

SEQ ID NO: 27972 - DNA, 20 bp, Artificial
  CRISPR gRNA sequence
ggagatggggtcttgctctg

SEQ ID NO: 27973 - DNA, 20 bp, Artificial
  CRISPR gRNA sequence
gagatggggtcttgctctgt

SEQ ID NO: 27974 - DNA, 20 bp, Artificial
  CRISPR gRNA sequence
gctctgtcacccaggctaga

SEQ ID NO: 27975 - DNA, 20 bp, Artificial
  CRISPR gRNA sequence
ctctgtcacccaggctagaa

SEQ ID NO: 27976 - DNA, 20 bp, Artificial
  CRISPR gRNA sequence
tgtcacccaggctagaatgc

SEQ ID NO: 27977 - DNA, 20 bp, Artificial
  CRISPR gRNA sequence
tcacccaggctagaatgcag

SEQ ID NO: 27978 - DNA, 20 bp, Artificial
  CRISPR gRNA sequence
gaatgcagtggtatgatctt

SEQ ID NO: 27979 - DNA, 20 bp, Artificial
  CRISPR gRNA sequence
ggctcactgcaatctccacc

SEQ ID NO: 27980 - DNA, 20 bp, Artificial
  CRISPR gRNA sequence
gctcactgcaatctccacct

SEQ ID NO: 27981 - DNA, 20 bp, Artificial
  CRISPR gRNA sequence
actgcaatctccacctctcg

SEQ ID NO: 27982 - DNA, 20 bp, Artificial
  CRISPR gRNA sequence
caatctccacctctcggttc

SEQ ID NO: 27983 - DNA, 20 bp, Artificial
  CRISPR gRNA sequence
cacctctcggttcaagcaat

SEQ ID NO: 27984 - DNA, 20 bp, Artificial
  CRISPR gRNA sequence
tcggttcaagcaattttcct

SEQ ID NO: 27985 - DNA, 20 bp, Artificial
  CRISPR gRNA sequence
ggttcaagcaattttcctgc

SEQ ID NO: 27986 - DNA, 20 bp, Artificial
  CRISPR gRNA sequence
aagcaattttcctgcctcag

SEQ ID NO: 27987 - DNA, 20 bp, Artificial
  CRISPR gRNA sequence
tcctgcctcagcctcccgag

SEQ ID NO: 27988 - DNA, 20 bp, Artificial
  CRISPR gRNA sequence
cctgcctcagcctcccgagt

SEQ ID NO: 27989 - DNA, 20 bp, Artificial
  CRISPR gRNA sequence
ctgcctcagcctcccgagta

SEQ ID NO: 27990 - DNA, 20 bp, Artificial
  CRISPR gRNA sequence
cctcagcctcccgagtagct

SEQ ID NO: 27991 - DNA, 20 bp, Artificial
  CRISPR gRNA sequence
agcctcccgagtagctggga

SEQ ID NO: 27992 - DNA, 20 bp, Artificial
  CRISPR gRNA sequence
ccgagtagctgggattacag

SEQ ID NO: 27993 - DNA, 20 bp, Artificial
  CRISPR gRNA sequence
ggattacaggtgtacaccac

SEQ ID NO: 27994 - DNA, 20 bp, Artificial
  CRISPR gRNA sequence
caggtgtacaccactacacc

SEQ ID NO: 27995 - DNA, 20 bp, Artificial
  CRISPR gRNA sequence
cacctggctaatttttgtat

SEQ ID NO: 27996 - DNA, 20 bp, Artificial
  CRISPR gRNA sequence
gctaatttttgtatttttag

SEQ ID NO: 27997 - DNA, 20 bp, Artificial
  CRISPR gRNA sequence
atttttgtatttttagtaga

SEQ ID NO: 27998 - DNA, 20 bp, Artificial
  CRISPR gRNA sequence
ttgtatttttagtagagacg

SEQ ID NO: 27999 - DNA, 20 bp, Artificial
  CRISPR gRNA sequence
tgtatttttagtagagacgg

SEQ ID NO: 28000 - DNA, 20 bp, Artificial
  CRISPR gRNA sequence
gtatttttagtagagacggg

SEQ ID NO: 28001 - DNA, 20 bp, Artificial
  CRISPR gRNA sequence
tatttttagtagagacgggc

SEQ ID NO: 28002 - DNA, 20 bp, Artificial
  CRISPR gRNA sequence
ttagtagagacgggctttaa

SEQ ID NO: 28003 - DNA, 20 bp, Artificial
  CRISPR gRNA sequence
tagtagagacgggctttaac

SEQ ID NO: 28004 - DNA, 20 bp, Artificial
  CRISPR gRNA sequence
agtagagacgggctttaacc

SEQ ID NO: 28005 - DNA, 20 bp, Artificial
  CRISPR gRNA sequence
gtagagacgggctttaacca

SEQ ID NO: 28006 - DNA, 20 bp, Artificial
  CRISPR gRNA sequence
taaccatgttggccaggctg

SEQ ID NO: 28007 - DNA, 20 bp, Artificial
  CRISPR gRNA sequence
aaccatgttggccaggctgg

SEQ ID NO: 28008 - DNA, 20 bp, Artificial
  CRISPR gRNA sequence
accatgttggccaggctggt

SEQ ID NO: 28009 - DNA, 20 bp, Artificial
  CRISPR gRNA sequence
gccaggctggtcttgaactc

SEQ ID NO: 28010 - DNA, 20 bp, Artificial
  CRISPR gRNA sequence
gtcttgaactcctggcctca

SEQ ID NO: 28011 - DNA, 20 bp, Artificial
  CRISPR gRNA sequence
gaactcctggcctcagatgt

SEQ ID NO: 28012 - DNA, 20 bp, Artificial
  CRISPR gRNA sequence
aactcctggcctcagatgtt

SEQ ID NO: 28013 - DNA, 20 bp, Artificial
  CRISPR gRNA sequence
ctggcctcagatgttcctcc

SEQ ID NO: 28014 - DNA, 20 bp, Artificial
  CRISPR gRNA sequence
gcctcagatgttcctcccac

SEQ ID NO: 28015 - DNA, 20 bp, Artificial
  CRISPR gRNA sequence
agatgttcctcccacctcag

SEQ ID NO: 28016 - DNA, 20 bp, Artificial
  CRISPR gRNA sequence
ctcccacctcagcctcccaa

SEQ ID NO: 28017 - DNA, 20 bp, Artificial
  CRISPR gRNA sequence
ccacctcagcctcccaaagt

SEQ ID NO: 28018 - DNA, 20 bp, Artificial
  CRISPR gRNA sequence
agcctcccaaagtgctggga

SEQ ID NO: 28019 - DNA, 20 bp, Artificial
  CRISPR gRNA sequence
ccaaagtgctgggattacag

SEQ ID NO: 28020 - DNA, 20 bp, Artificial
  CRISPR gRNA sequence
ggattacaggtgtaagccac

SEQ ID NO: 28021 - DNA, 20 bp, Artificial
  CRISPR gRNA sequence
caggtgtaagccaccatgcc

SEQ ID NO: 28022 - DNA, 20 bp, Artificial
  CRISPR gRNA sequence
ataattcagtgcattttata

SEQ ID NO: 28023 - DNA, 20 bp, Artificial
  CRISPR gRNA sequence
taattcagtgcattttatat

SEQ ID NO: 28024 - DNA, 20 bp, Artificial
  CRISPR gRNA sequence
agtgcattttatatataatc

SEQ ID NO: 28025 - DNA, 20 bp, Artificial
  CRISPR gRNA sequence
tatatataatctcattaatc

SEQ ID NO: 28026 - DNA, 20 bp, Artificial
  CRISPR gRNA sequence
atatataatctcattaatct

SEQ ID NO: 28027 - DNA, 20 bp, Artificial
  CRISPR gRNA sequence
tatataatctcattaatctc

SEQ ID NO: 28028 - DNA, 20 bp, Artificial
  CRISPR gRNA sequence
attaatctcaagagctactg

SEQ ID NO: 28029 - DNA, 20 bp, Artificial
  CRISPR gRNA sequence
atctcaagagctactgtgga

SEQ ID NO: 28030 - DNA, 20 bp, Artificial
  CRISPR gRNA sequence
aagagctactgtggaagaca

SEQ ID NO: 28031 - DNA, 20 bp, Artificial
  CRISPR gRNA sequence
ctgtggaagacagacagtca

SEQ ID NO: 28032 - DNA, 20 bp, Artificial
  CRISPR gRNA sequence
tggaagacagacagtcatca

SEQ ID NO: 28033 - DNA, 20 bp, Artificial
  CRISPR gRNA sequence
ccccattttacagatgagga

SEQ ID NO: 28034 - DNA, 20 bp, Artificial
  CRISPR gRNA sequence
cccattttacagatgaggag

SEQ ID NO: 28035 - DNA, 20 bp, Artificial
  CRISPR gRNA sequence
tacagatgaggagacggagg

SEQ ID NO: 28036 - DNA, 20 bp, Artificial
  CRISPR gRNA sequence
acagatgaggagacggaggc

SEQ ID NO: 28037 - DNA, 20 bp, Artificial
  CRISPR gRNA sequence
cagatgaggagacggaggcc

SEQ ID NO: 28038 - DNA, 20 bp, Artificial
  CRISPR gRNA sequence
gtgaggttaagtgacttgcc

SEQ ID NO: 28039 - DNA, 20 bp, Artificial
  CRISPR gRNA sequence
agtgacttgcccgtggtccc

SEQ ID NO: 28040 - DNA, 20 bp, Artificial
  CRISPR gRNA sequence
gcccgtggtcccccagctgg

SEQ ID NO: 28041 - DNA, 20 bp, Artificial
  CRISPR gRNA sequence
cccgtggtcccccagctggt

SEQ ID NO: 28042 - DNA, 20 bp, Artificial
  CRISPR gRNA sequence
gtcacccacaagctatcagc

SEQ ID NO: 28043 - DNA, 20 bp, Artificial
  CRISPR gRNA sequence
tcagctctccctgatcactg

SEQ ID NO: 28044 - DNA, 20 bp, Artificial
  CRISPR gRNA sequence
tccctgatcactgctcccct

SEQ ID NO: 28045 - DNA, 20 bp, Artificial
  CRISPR gRNA sequence
cctgatcactgctcccctgt

SEQ ID NO: 28046 - DNA, 20 bp, Artificial
  CRISPR gRNA sequence
atcactgctcccctgtgccc

SEQ ID NO: 28047 - DNA, 20 bp, Artificial
  CRISPR gRNA sequence
ctcccctgtgccccagaaaa

SEQ ID NO: 28048 - DNA, 20 bp, Artificial
  CRISPR gRNA sequence
ccctgtgccccagaaaaaag

SEQ ID NO: 28049 - DNA, 20 bp, Artificial
  CRISPR gRNA sequence
tgccccagaaaaaagccagt

SEQ ID NO: 28050 - DNA, 20 bp, Artificial
  CRISPR gRNA sequence
ttgttttgaacagagacaag

SEQ ID NO: 28051 - DNA, 20 bp, Artificial
  CRISPR gRNA sequence
gttttgaacagagacaaggt

SEQ ID NO: 28052 - DNA, 20 bp, Artificial
  CRISPR gRNA sequence
ttttgaacagagacaaggtg

SEQ ID NO: 28053 - DNA, 20 bp, Artificial
  CRISPR gRNA sequence
tgaacagagacaaggtgcta

SEQ ID NO: 28054 - DNA, 20 bp, Artificial
  CRISPR gRNA sequence
gaacagagacaaggtgctaa

SEQ ID NO: 28055 - DNA, 20 bp, Artificial
  CRISPR gRNA sequence
aacagagacaaggtgctaaa

SEQ ID NO: 28056 - DNA, 20 bp, Artificial
  CRISPR gRNA sequence
aatttgtccagaggtaaaaa

SEQ ID NO: 28057 - DNA, 20 bp, Artificial
  CRISPR gRNA sequence
gtccagaggtaaaaatgatg

SEQ ID NO: 28058 - DNA, 20 bp, Artificial
  CRISPR gRNA sequence
tccagaggtaaaaatgatgc

SEQ ID NO: 28059 - DNA, 20 bp, Artificial
  CRISPR gRNA sequence
aaaaggggaaatgtctgaaa

SEQ ID NO: 28060 - DNA, 20 bp, Artificial
  CRISPR gRNA sequence
aaaacaataactgagggccc

SEQ ID NO: 28061 - DNA, 20 bp, Artificial
  CRISPR gRNA sequence
agggccctttctggccttaa

SEQ ID NO: 28062 - DNA, 20 bp, Artificial
  CRISPR gRNA sequence
tctggccttaaattattttc

SEQ ID NO: 28063 - DNA, 20 bp, Artificial
  CRISPR gRNA sequence
ctggccttaaattattttca

SEQ ID NO: 28064 - DNA, 20 bp, Artificial
  CRISPR gRNA sequence
tggccttaaattattttcag

SEQ ID NO: 28065 - DNA, 20 bp, Artificial
  CRISPR gRNA sequence
gccttaaattattttcagct

SEQ ID NO: 28066 - DNA, 20 bp, Artificial
  CRISPR gRNA sequence
aaattattttcagctgaaaa

SEQ ID NO: 28067 - DNA, 20 bp, Artificial
  CRISPR gRNA sequence
aattattttcagctgaaaaa

SEQ ID NO: 28068 - DNA, 20 bp, Artificial
  CRISPR gRNA sequence
ttttcagctgaaaaagcccc

SEQ ID NO: 28069 - DNA, 20 bp, Artificial
  CRISPR gRNA sequence
tcagctgaaaaagcccctag

SEQ ID NO: 28070 - DNA, 20 bp, Artificial
  CRISPR gRNA sequence
cagctgaaaaagcccctagt

SEQ ID NO: 28071 - DNA, 20 bp, Artificial
  CRISPR gRNA sequence
agctgaaaaagcccctagtt

SEQ ID NO: 28072 - DNA, 20 bp, Artificial
  CRISPR gRNA sequence
aaaaagcccctagttcaaga

SEQ ID NO: 28073 - DNA, 20 bp, Artificial
  CRISPR gRNA sequence
gttcaagatcggaactgcgc

SEQ ID NO: 28074 - DNA, 20 bp, Artificial
  CRISPR gRNA sequence
aagatcggaactgcgctctg

SEQ ID NO: 28075 - DNA, 20 bp, Artificial
  CRISPR gRNA sequence
cgctctggggaacagcggcc

SEQ ID NO: 28076 - DNA, 20 bp, Artificial
  CRISPR gRNA sequence
tggggaacagcggccatggg

SEQ ID NO: 28077 - DNA, 20 bp, Artificial
  CRISPR gRNA sequence
gggaacagcggccatggggt

SEQ ID NO: 28078 - DNA, 20 bp, Artificial
  CRISPR gRNA sequence
gagccgggtgatcagccacc

SEQ ID NO: 28079 - DNA, 20 bp, Artificial
  CRISPR gRNA sequence
gagaccggaagcccccgagg

SEQ ID NO: 28080 - DNA, 20 bp, Artificial
  CRISPR gRNA sequence
tgaggaaggaaggaaggaag

SEQ ID NO: 28081 - DNA, 20 bp, Artificial
  CRISPR gRNA sequence
aggaaggaaggaaggaagga

SEQ ID NO: 28082 - DNA, 20 bp, Artificial
  CRISPR gRNA sequence
tttctggcattttctcaggc

SEQ ID NO: 28083 - DNA, 20 bp, Artificial
  CRISPR gRNA sequence
ctggcattttctcaggcttc

SEQ ID NO: 28084 - DNA, 20 bp, Artificial
  CRISPR gRNA sequence
tggcattttctcaggcttct

SEQ ID NO: 28085 - DNA, 20 bp, Artificial
  CRISPR gRNA sequence
gcattttctcaggcttctac

SEQ ID NO: 28086 - DNA, 20 bp, Artificial
  CRISPR gRNA sequence
tctcaggcttctactgtgcc

SEQ ID NO: 28087 - DNA, 20 bp, Artificial
  CRISPR gRNA sequence
ctcaggcttctactgtgccc

SEQ ID NO: 28088 - DNA, 20 bp, Artificial
  CRISPR gRNA sequence
tcaggcttctactgtgccca

SEQ ID NO: 28089 - DNA, 20 bp, Artificial
  CRISPR gRNA sequence
aggcttctactgtgcccagg

SEQ ID NO: 28090 - DNA, 20 bp, Artificial
  CRISPR gRNA sequence
ctactgtgcccaggcaccct

SEQ ID NO: 28091 - DNA, 20 bp, Artificial
  CRISPR gRNA sequence
tactgtgcccaggcaccctg

SEQ ID NO: 28092 - DNA, 20 bp, Artificial
  CRISPR gRNA sequence
ctgtgcccaggcaccctgta

SEQ ID NO: 28093 - DNA, 20 bp, Artificial
  CRISPR gRNA sequence
tgcccaggcaccctgtagac

SEQ ID NO: 28094 - DNA, 20 bp, Artificial
  CRISPR gRNA sequence
tagacctcatctgtctgtca

SEQ ID NO: 28095 - DNA, 20 bp, Artificial
  CRISPR gRNA sequence
atctgtctgtcaaatcaggg

SEQ ID NO: 28096 - DNA, 20 bp, Artificial
  CRISPR gRNA sequence
tctgtcaaatcagggttctt

SEQ ID NO: 28097 - DNA, 20 bp, Artificial
  CRISPR gRNA sequence
tcaaatcagggttcttagcc

SEQ ID NO: 28098 - DNA, 20 bp, Artificial
  CRISPR gRNA sequence
ttagccactcacaaccctac

SEQ ID NO: 28099 - DNA, 20 bp, Artificial
  CRISPR gRNA sequence
agccactcacaaccctacag

SEQ ID NO: 28100 - DNA, 20 bp, Artificial
  CRISPR gRNA sequence
gccactcacaaccctacagg

SEQ ID NO: 28101 - DNA, 20 bp, Artificial
  CRISPR gRNA sequence
acaaccctacagggacttcg

SEQ ID NO: 28102 - DNA, 20 bp, Artificial
  CRISPR gRNA sequence
cagggacttcgtttgtacac

SEQ ID NO: 28103 - DNA, 20 bp, Artificial
  CRISPR gRNA sequence
cgtttgtacacagagtcctt

SEQ ID NO: 28104 - DNA, 20 bp, Artificial
  CRISPR gRNA sequence
gtttgtacacagagtccttc

SEQ ID NO: 28105 - DNA, 20 bp, Artificial
  CRISPR gRNA sequence
gtacacagagtccttcccca

SEQ ID NO: 28106 - DNA, 20 bp, Artificial
  CRISPR gRNA sequence
tacacagagtccttccccag

SEQ ID NO: 28107 - DNA, 20 bp, Artificial
  CRISPR gRNA sequence
ccccagttcagtccccactc

SEQ ID NO: 28108 - DNA, 20 bp, Artificial
  CRISPR gRNA sequence
cccagttcagtccccactca

SEQ ID NO: 28109 - DNA, 20 bp, Artificial
  CRISPR gRNA sequence
agtccccactcacctgttca

SEQ ID NO: 28110 - DNA, 20 bp, Artificial
  CRISPR gRNA sequence
acctgttcacccttatctcc

SEQ ID NO: 28111 - DNA, 20 bp, Artificial
  CRISPR gRNA sequence
ttcacccttatctcctacac

SEQ ID NO: 28112 - DNA, 20 bp, Artificial
  CRISPR gRNA sequence
acccttatctcctacactcg

SEQ ID NO: 28113 - DNA, 20 bp, Artificial
  CRISPR gRNA sequence
atctcctacactcgctgggt

SEQ ID NO: 28114 - DNA, 20 bp, Artificial
  CRISPR gRNA sequence
tctcctacactcgctgggtg

SEQ ID NO: 28115 - DNA, 20 bp, Artificial
  CRISPR gRNA sequence
ctacactcgctgggtgctct

SEQ ID NO: 28116 - DNA, 20 bp, Artificial
  CRISPR gRNA sequence
cactcgctgggtgctctctc

SEQ ID NO: 28117 - DNA, 20 bp, Artificial
  CRISPR gRNA sequence
gctgggtgctctctccattc

SEQ ID NO: 28118 - DNA, 20 bp, Artificial
  CRISPR gRNA sequence
ggtgctctctccattccagc

SEQ ID NO: 28119 - DNA, 20 bp, Artificial
  CRISPR gRNA sequence
tctccattccagccacaggg

SEQ ID NO: 28120 - DNA, 20 bp, Artificial
  CRISPR gRNA sequence
tccattccagccacagggcc

SEQ ID NO: 28121 - DNA, 20 bp, Artificial
  CRISPR gRNA sequence
cattccagccacagggcctc

SEQ ID NO: 28122 - DNA, 20 bp, Artificial
  CRISPR gRNA sequence
cagccacagggcctccttgc

SEQ ID NO: 28123 - DNA, 20 bp, Artificial
  CRISPR gRNA sequence
cttgctggctttcaacctcc

SEQ ID NO: 28124 - DNA, 20 bp, Artificial
  CRISPR gRNA sequence
gctggctttcaacctcctag

SEQ ID NO: 28125 - DNA, 20 bp, Artificial
  CRISPR gRNA sequence
ctggctttcaacctcctagg

SEQ ID NO: 28126 - DNA, 20 bp, Artificial
  CRISPR gRNA sequence
gctttcaacctcctaggcat

SEQ ID NO: 28127 - DNA, 20 bp, Artificial
  CRISPR gRNA sequence
tcaacctcctaggcatgctt

SEQ ID NO: 28128 - DNA, 20 bp, Artificial
  CRISPR gRNA sequence
caacctcctaggcatgcttc

SEQ ID NO: 28129 - DNA, 20 bp, Artificial
  CRISPR gRNA sequence
aacctcctaggcatgcttct

SEQ ID NO: 28130 - DNA, 20 bp, Artificial
  CRISPR gRNA sequence
ctaggcatgcttctgcctcc

SEQ ID NO: 28131 - DNA, 20 bp, Artificial
  CRISPR gRNA sequence
ggcatgcttctgcctccagg

SEQ ID NO: 28132 - DNA, 20 bp, Artificial
  CRISPR gRNA sequence
ctgcctccaggcctttgcac

SEQ ID NO: 28133 - DNA, 20 bp, Artificial
  CRISPR gRNA sequence
tgcctccaggcctttgcacc

SEQ ID NO: 28134 - DNA, 20 bp, Artificial
  CRISPR gRNA sequence
cctccaggcctttgcaccgg

SEQ ID NO: 28135 - DNA, 20 bp, Artificial
  CRISPR gRNA sequence
caggcctttgcaccggctgt

SEQ ID NO: 28136 - DNA, 20 bp, Artificial
  CRISPR gRNA sequence
tgcaccggctgtgccctctg

SEQ ID NO: 28137 - DNA, 20 bp, Artificial
  CRISPR gRNA sequence
gcaccggctgtgccctctgc

SEQ ID NO: 28138 - DNA, 20 bp, Artificial
  CRISPR gRNA sequence
caccggctgtgccctctgcc

SEQ ID NO: 28139 - DNA, 20 bp, Artificial
  CRISPR gRNA sequence
tgccctctgcctggaatact

SEQ ID NO: 28140 - DNA, 20 bp, Artificial
  CRISPR gRNA sequence
tgcctggaatacttctcccc

SEQ ID NO: 28141 - DNA, 20 bp, Artificial
  CRISPR gRNA sequence
cctggaatacttctccccag

SEQ ID NO: 28142 - DNA, 20 bp, Artificial
  CRISPR gRNA sequence
gaatacttctccccagatat

SEQ ID NO: 28143 - DNA, 20 bp, Artificial
  CRISPR gRNA sequence
ctccccagatatctgcatgg

SEQ ID NO: 28144 - DNA, 20 bp, Artificial
  CRISPR gRNA sequence
tccccagatatctgcatggc

SEQ ID NO: 28145 - DNA, 20 bp, Artificial
  CRISPR gRNA sequence
cccagatatctgcatggctc

SEQ ID NO: 28146 - DNA, 20 bp, Artificial
  CRISPR gRNA sequence
catggctcatgccttcacct

SEQ ID NO: 28147 - DNA, 20 bp, Artificial
  CRISPR gRNA sequence
atgccttcacctcctctggt

SEQ ID NO: 28148 - DNA, 20 bp, Artificial
  CRISPR gRNA sequence
cacctcctctggtctttact

SEQ ID NO: 28149 - DNA, 20 bp, Artificial
  CRISPR gRNA sequence
acctcctctggtctttactc

SEQ ID NO: 28150 - DNA, 20 bp, Artificial
  CRISPR gRNA sequence
ctctggtctttactcagtga

SEQ ID NO: 28151 - DNA, 20 bp, Artificial
  CRISPR gRNA sequence
tggtctttactcagtgaggc

SEQ ID NO: 28152 - DNA, 20 bp, Artificial
  CRISPR gRNA sequence
gtctttactcagtgaggcct

SEQ ID NO: 28153 - DNA, 20 bp, Artificial
  CRISPR gRNA sequence
tactcagtgaggccttttct

SEQ ID NO: 28154 - DNA, 20 bp, Artificial
  CRISPR gRNA sequence
actcagtgaggccttttctt

SEQ ID NO: 28155 - DNA, 20 bp, Artificial
  CRISPR gRNA sequence
ctcagtgaggccttttcttt

SEQ ID NO: 28156 - DNA, 20 bp, Artificial
  CRISPR gRNA sequence
agtgaggccttttcttttct

SEQ ID NO: 28157 - DNA, 20 bp, Artificial
  CRISPR gRNA sequence
ttcttttctttctttccctg

SEQ ID NO: 28158 - DNA, 20 bp, Artificial
  CRISPR gRNA sequence
tcttttctttctttccctgt

SEQ ID NO: 28159 - DNA, 20 bp, Artificial
  CRISPR gRNA sequence
cttttctttctttccctgtt

SEQ ID NO: 28160 - DNA, 20 bp, Artificial
  CRISPR gRNA sequence
ttttctttctttccctgttt

SEQ ID NO: 28161 - DNA, 20 bp, Artificial
  CRISPR gRNA sequence
ttctttctttccctgtttct

SEQ ID NO: 28162 - DNA, 20 bp, Artificial
  CRISPR gRNA sequence
tctttctttccctgtttctt

SEQ ID NO: 28163 - DNA, 20 bp, Artificial
  CRISPR gRNA sequence
ctttctttccctgtttcttt

SEQ ID NO: 28164 - DNA, 20 bp, Artificial
  CRISPR gRNA sequence
tttctttccctgtttctttc

SEQ ID NO: 28165 - DNA, 20 bp, Artificial
  CRISPR gRNA sequence
tctttccctgtttctttctt

SEQ ID NO: 28166 - DNA, 20 bp, Artificial
  CRISPR gRNA sequence
ctttccctgtttctttcttt

SEQ ID NO: 28167 - DNA, 20 bp, Artificial
  CRISPR gRNA sequence
tttccctgtttctttctttc

SEQ ID NO: 28168 - DNA, 20 bp, Artificial
  CRISPR gRNA sequence
tccctgtttctttctttctt

SEQ ID NO: 28169 - DNA, 20 bp, Artificial
  CRISPR gRNA sequence
ccctgtttctttctttcttt

SEQ ID NO: 28170 - DNA, 20 bp, Artificial
  CRISPR gRNA sequence
cctgtttctttctttctttc

SEQ ID NO: 28171 - DNA, 20 bp, Artificial
  CRISPR gRNA sequence
tttctttctttctttctttc

SEQ ID NO: 28172 - DNA, 20 bp, Artificial
  CRISPR gRNA sequence
ctttctttctttctttccct

SEQ ID NO: 28173 - DNA, 20 bp, Artificial
  CRISPR gRNA sequence
tttctttctttctttccctc

SEQ ID NO: 28174 - DNA, 20 bp, Artificial
  CRISPR gRNA sequence
tctttctttctttccctcct

SEQ ID NO: 28175 - DNA, 20 bp, Artificial
  CRISPR gRNA sequence
ctttctttctttccctcctt

SEQ ID NO: 28176 - DNA, 20 bp, Artificial
  CRISPR gRNA sequence
tttctttctttccctccttt

SEQ ID NO: 28177 - DNA, 20 bp, Artificial
  CRISPR gRNA sequence
tctttctttccctcctttct

SEQ ID NO: 28178 - DNA, 20 bp, Artificial
  CRISPR gRNA sequence
ctttctttccctcctttctt

SEQ ID NO: 28179 - DNA, 20 bp, Artificial
  CRISPR gRNA sequence
tttctttccctcctttcttt

SEQ ID NO: 28180 - DNA, 20 bp, Artificial
  CRISPR gRNA sequence
tctttccctcctttctttct

SEQ ID NO: 28181 - DNA, 20 bp, Artificial
  CRISPR gRNA sequence
ctttccctcctttctttctt

SEQ ID NO: 28182 - DNA, 20 bp, Artificial
  CRISPR gRNA sequence
tttccctcctttctttcttt

SEQ ID NO: 28183 - DNA, 20 bp, Artificial
  CRISPR gRNA sequence
tccctcctttctttctttct

SEQ ID NO: 28184 - DNA, 20 bp, Artificial
  CRISPR gRNA sequence
ccctcctttctttctttctt

SEQ ID NO: 28185 - DNA, 20 bp, Artificial
  CRISPR gRNA sequence
cctcctttctttctttcttt

SEQ ID NO: 28186 - DNA, 20 bp, Artificial
  CRISPR gRNA sequence
ctttctttctttctttccct

SEQ ID NO: 28187 - DNA, 20 bp, Artificial
  CRISPR gRNA sequence
tctttctttctttccctttc

SEQ ID NO: 28188 - DNA, 20 bp, Artificial
  CRISPR gRNA sequence
ctttctttctttccctttct

SEQ ID NO: 28189 - DNA, 20 bp, Artificial
  CRISPR gRNA sequence
tttctttctttccctttctt

SEQ ID NO: 28190 - DNA, 20 bp, Artificial
  CRISPR gRNA sequence
tctttctttccctttctttc

SEQ ID NO: 28191 - DNA, 20 bp, Artificial
  CRISPR gRNA sequence
ctttctttccctttctttct

SEQ ID NO: 28192 - DNA, 20 bp, Artificial
  CRISPR gRNA sequence
tttctttccctttctttctt

SEQ ID NO: 28193 - DNA, 20 bp, Artificial
  CRISPR gRNA sequence
tctttccctttctttctttc

SEQ ID NO: 28194 - DNA, 20 bp, Artificial
  CRISPR gRNA sequence
ctttccctttctttctttct

SEQ ID NO: 28195 - DNA, 20 bp, Artificial
  CRISPR gRNA sequence
tttccctttctttctttctt

SEQ ID NO: 28196 - DNA, 20 bp, Artificial
  CRISPR gRNA sequence
tccctttctttctttctttt

SEQ ID NO: 28197 - DNA, 20 bp, Artificial
  CRISPR gRNA sequence
ccctttctttctttcttttt

SEQ ID NO: 28198 - DNA, 20 bp, Artificial
  CRISPR gRNA sequence
cctttctttctttctttttc

SEQ ID NO: 28199 - DNA, 20 bp, Artificial
  CRISPR gRNA sequence
tctttctttctttttccttt

SEQ ID NO: 28200 - DNA, 20 bp, Artificial
  CRISPR gRNA sequence
ctttctttctttttcctttt

SEQ ID NO: 28201 - DNA, 20 bp, Artificial
  CRISPR gRNA sequence
tttctttctttttccttttt

SEQ ID NO: 28202 - DNA, 20 bp, Artificial
  CRISPR gRNA sequence
tctttctttttccttttttc

SEQ ID NO: 28203 - DNA, 20 bp, Artificial
  CRISPR gRNA sequence
ctttctttttccttttttct

SEQ ID NO: 28204 - DNA, 20 bp, Artificial
  CRISPR gRNA sequence
tttctttttccttttttctt

SEQ ID NO: 28205 - DNA, 20 bp, Artificial
  CRISPR gRNA sequence
tctttttccttttttctttt

SEQ ID NO: 28206 - DNA, 20 bp, Artificial
  CRISPR gRNA sequence
ctttttccttttttcttttt

SEQ ID NO: 28207 - DNA, 20 bp, Artificial
  CRISPR gRNA sequence
tttttccttttttctttttc

SEQ ID NO: 28208 - DNA, 20 bp, Artificial
  CRISPR gRNA sequence
tttccttttttctttttctt

SEQ ID NO: 28209 - DNA, 20 bp, Artificial
  CRISPR gRNA sequence
ttccttttttctttttcttt

SEQ ID NO: 28210 - DNA, 20 bp, Artificial
  CRISPR gRNA sequence
tccttttttctttttctttt

SEQ ID NO: 28211 - DNA, 20 bp, Artificial
  CRISPR gRNA sequence
ccttttttctttttcttttt

SEQ ID NO: 28212 - DNA, 20 bp, Artificial
  CRISPR gRNA sequence
cttttttctttttctttttt

SEQ ID NO: 28213 - DNA, 20 bp, Artificial
  CRISPR gRNA sequence
ttttctttttctttttttga

SEQ ID NO: 28214 - DNA, 20 bp, Artificial
  CRISPR gRNA sequence
tttctttttctttttttgag

SEQ ID NO: 28215 - DNA, 20 bp, Artificial
  CRISPR gRNA sequence
ttctttttctttttttgagg

SEQ ID NO: 28216 - DNA, 20 bp, Artificial
  CRISPR gRNA sequence
tctttttctttttttgaggt

SEQ ID NO: 28217 - DNA, 20 bp, Artificial
  CRISPR gRNA sequence
ctttttctttttttgaggtg

SEQ ID NO: 28218 - DNA, 20 bp, Artificial
  CRISPR gRNA sequence
tttttctttttttgaggtgg

SEQ ID NO: 28219 - DNA, 20 bp, Artificial
  CRISPR gRNA sequence
tttctttttttgaggtggag

SEQ ID NO: 28220 - DNA, 20 bp, Artificial
  CRISPR gRNA sequence
ttctttttttgaggtggagt

SEQ ID NO: 28221 - DNA, 20 bp, Artificial
  CRISPR gRNA sequence
tctttttttgaggtggagtc

SEQ ID NO: 28222 - DNA, 20 bp, Artificial
  CRISPR gRNA sequence
ctttttttgaggtggagtct

SEQ ID NO: 28223 - DNA, 20 bp, Artificial
  CRISPR gRNA sequence
tttttttgaggtggagtctc

SEQ ID NO: 28224 - DNA, 20 bp, Artificial
  CRISPR gRNA sequence
tttttgaggtggagtctcgc

SEQ ID NO: 28225 - DNA, 20 bp, Artificial
  CRISPR gRNA sequence
ttttgaggtggagtctcgct

SEQ ID NO: 28226 - DNA, 20 bp, Artificial
  CRISPR gRNA sequence
tttgaggtggagtctcgctc

SEQ ID NO: 28227 - DNA, 20 bp, Artificial
  CRISPR gRNA sequence
ttgaggtggagtctcgctct

SEQ ID NO: 28228 - DNA, 20 bp, Artificial
  CRISPR gRNA sequence
tgaggtggagtctcgctctg

SEQ ID NO: 28229 - DNA, 20 bp, Artificial
  CRISPR gRNA sequence
gaggtggagtctcgctctgt

SEQ ID NO: 28230 - DNA, 20 bp, Artificial
  CRISPR gRNA sequence
aggtggagtctcgctctgtc

SEQ ID NO: 28231 - DNA, 20 bp, Artificial
  CRISPR gRNA sequence
gctctgtcacccaggctgga

SEQ ID NO: 28232 - DNA, 20 bp, Artificial
  CRISPR gRNA sequence
tgtcacccaggctggagtgc

SEQ ID NO: 28233 - DNA, 20 bp, Artificial
  CRISPR gRNA sequence
tcacccaggctggagtgcag

SEQ ID NO: 28234 - DNA, 20 bp, Artificial
  CRISPR gRNA sequence
gagtgcagtggcacaatctc

SEQ ID NO: 28235 - DNA, 20 bp, Artificial
  CRISPR gRNA sequence
gactcactgcaacctcctcc

SEQ ID NO: 28236 - DNA, 20 bp, Artificial
  CRISPR gRNA sequence
actgcaacctcctcctccca

SEQ ID NO: 28237 - DNA, 20 bp, Artificial
  CRISPR gRNA sequence
caacctcctcctcccaagtc

SEQ ID NO: 28238 - DNA, 20 bp, Artificial
  CRISPR gRNA sequence
ctcctcccaagtccaagtga

SEQ ID NO: 28239 - DNA, 20 bp, Artificial
  CRISPR gRNA sequence
ctcccaagtccaagtgattc

SEQ ID NO: 28240 - DNA, 20 bp, Artificial
  CRISPR gRNA sequence
ccaagtccaagtgattctct

SEQ ID NO: 28241 - DNA, 20 bp, Artificial
  CRISPR gRNA sequence
tcttgcctcagcctcccgag

SEQ ID NO: 28242 - DNA, 20 bp, Artificial
  CRISPR gRNA sequence
ttgcctcagcctcccgagta

SEQ ID NO: 28243 - DNA, 20 bp, Artificial
  CRISPR gRNA sequence
gcctcagcctcccgagtagc

SEQ ID NO: 28244 - DNA, 20 bp, Artificial
  CRISPR gRNA sequence
cctcagcctcccgagtagct

SEQ ID NO: 28245 - DNA, 20 bp, Artificial
  CRISPR gRNA sequence
agcctcccgagtagctggga

SEQ ID NO: 28246 - DNA, 20 bp, Artificial
  CRISPR gRNA sequence
ccgagtagctgggactacag

SEQ ID NO: 28247 - DNA, 20 bp, Artificial
  CRISPR gRNA sequence
ggactacaggcacatgtcac

SEQ ID NO: 28248 - DNA, 20 bp, Artificial
  CRISPR gRNA sequence
caggcacatgtcaccacatc

SEQ ID NO: 28249 - DNA, 20 bp, Artificial
  CRISPR gRNA sequence
gctaattttttgtattttta

SEQ ID NO: 28250 - DNA, 20 bp, Artificial
  CRISPR gRNA sequence
attttttgtatttttagtag

SEQ ID NO: 28251 - DNA, 20 bp, Artificial
  CRISPR gRNA sequence
tttgtatttttagtagagac

SEQ ID NO: 28252 - DNA, 20 bp, Artificial
  CRISPR gRNA sequence
ttgtatttttagtagagacg

SEQ ID NO: 28253 - DNA, 20 bp, Artificial
  CRISPR gRNA sequence
tgtatttttagtagagacgg

SEQ ID NO: 28254 - DNA, 20 bp, Artificial
  CRISPR gRNA sequence
gtatttttagtagagacggg

SEQ ID NO: 28255 - DNA, 20 bp, Artificial
  CRISPR gRNA sequence
tatttttagtagagacgggg

SEQ ID NO: 28256 - DNA, 20 bp, Artificial
  CRISPR gRNA sequence
ttagtagagacggggtttca

SEQ ID NO: 28257 - DNA, 20 bp, Artificial
  CRISPR gRNA sequence
tagtagagacggggtttcac

SEQ ID NO: 28258 - DNA, 20 bp, Artificial
  CRISPR gRNA sequence
agtagagacggggtttcacc

SEQ ID NO: 28259 - DNA, 20 bp, Artificial
  CRISPR gRNA sequence
gtagagacggggtttcaccg

SEQ ID NO: 28260 - DNA, 20 bp, Artificial
  CRISPR gRNA sequence
caccgtgttagccaggatgg

SEQ ID NO: 28261 - DNA, 20 bp, Artificial
  CRISPR gRNA sequence
accgtgttagccaggatggt

SEQ ID NO: 28262 - DNA, 20 bp, Artificial
  CRISPR gRNA sequence
gccaggatggtctcaatctt

SEQ ID NO: 28263 - DNA, 20 bp, Artificial
  CRISPR gRNA sequence
aatcttctgacctcgtgatc

SEQ ID NO: 28264 - DNA, 20 bp, Artificial
  CRISPR gRNA sequence
ctgacctcgtgatcccccca

SEQ ID NO: 28265 - DNA, 20 bp, Artificial
  CRISPR gRNA sequence
tgacctcgtgatccccccac

SEQ ID NO: 28266 - DNA, 20 bp, Artificial
  CRISPR gRNA sequence
acctcgtgatccccccacct

SEQ ID NO: 28267 - DNA, 20 bp, Artificial
  CRISPR gRNA sequence
gtgatccccccacctcggcc

SEQ ID NO: 28268 - DNA, 20 bp, Artificial
  CRISPR gRNA sequence
ggcctcccaaagtgctggga

SEQ ID NO: 28269 - DNA, 20 bp, Artificial
  CRISPR gRNA sequence
ccaaagtgctgggattacag

SEQ ID NO: 28270 - DNA, 20 bp, Artificial
  CRISPR gRNA sequence
ggattacaggcgtgagccac

SEQ ID NO: 28271 - DNA, 20 bp, Artificial
  CRISPR gRNA sequence
caggcgtgagccaccacacc

SEQ ID NO: 28272 - DNA, 20 bp, Artificial
  CRISPR gRNA sequence
agtgaggtcttttctgaccc

SEQ ID NO: 28273 - DNA, 20 bp, Artificial
  CRISPR gRNA sequence
ttctgaccctcacagttaaa

SEQ ID NO: 28274 - DNA, 20 bp, Artificial
  CRISPR gRNA sequence
tctgaccctcacagttaaaa

SEQ ID NO: 28275 - DNA, 20 bp, Artificial
  CRISPR gRNA sequence
ctgaccctcacagttaaaaa

SEQ ID NO: 28276 - DNA, 20 bp, Artificial
  CRISPR gRNA sequence
tgaccctcacagttaaaaat

SEQ ID NO: 28277 - DNA, 20 bp, Artificial
  CRISPR gRNA sequence
accctcacagttaaaaataa

SEQ ID NO: 28278 - DNA, 20 bp, Artificial
  CRISPR gRNA sequence
acagttaaaaataaaactct

SEQ ID NO: 28279 - DNA, 20 bp, Artificial
  CRISPR gRNA sequence
aaaataaaactctggccagg

SEQ ID NO: 28280 - DNA, 20 bp, Artificial
  CRISPR gRNA sequence
tggccaggcgcagtggctta

SEQ ID NO: 28281 - DNA, 20 bp, Artificial
  CRISPR gRNA sequence
gccaggcgcagtggcttatg

SEQ ID NO: 28282 - DNA, 20 bp, Artificial
  CRISPR gRNA sequence
atgcctgtaatcccagcact

SEQ ID NO: 28283 - DNA, 20 bp, Artificial
  CRISPR gRNA sequence
tgcctgtaatcccagcactt

SEQ ID NO: 28284 - DNA, 20 bp, Artificial
  CRISPR gRNA sequence
taatcccagcactttgggag

SEQ ID NO: 28285 - DNA, 20 bp, Artificial
  CRISPR gRNA sequence
tgggaggccgaggcaggtgg

SEQ ID NO: 28286 - DNA, 20 bp, Artificial
  CRISPR gRNA sequence
gggaggccgaggcaggtgga

SEQ ID NO: 28287 - DNA, 20 bp, Artificial
  CRISPR gRNA sequence
ggaggccgaggcaggtggat

SEQ ID NO: 28288 - DNA, 20 bp, Artificial
  CRISPR gRNA sequence
gagaccagcctggccaacat

SEQ ID NO: 28289 - DNA, 20 bp, Artificial
  CRISPR gRNA sequence
agaccagcctggccaacata

SEQ ID NO: 28290 - DNA, 20 bp, Artificial
  CRISPR gRNA sequence
gccaacatagtgaaacccca

SEQ ID NO: 28291 - DNA, 20 bp, Artificial
  CRISPR gRNA sequence
tactaaatatacaaaacaaa

SEQ ID NO: 28292 - DNA, 20 bp, Artificial
  CRISPR gRNA sequence
ctaaatatacaaaacaaatt

SEQ ID NO: 28293 - DNA, 20 bp, Artificial
  CRISPR gRNA sequence
aatatacaaaacaaattagc

SEQ ID NO: 28294 - DNA, 20 bp, Artificial
  CRISPR gRNA sequence
gctgggcatggtggcaggtg

SEQ ID NO: 28295 - DNA, 20 bp, Artificial
  CRISPR gRNA sequence
ggcatggtggcaggtgcctg

SEQ ID NO: 28296 - DNA, 20 bp, Artificial
  CRISPR gRNA sequence
tagtcacagctacttgggag

SEQ ID NO: 28297 - DNA, 20 bp, Artificial
  CRISPR gRNA sequence
cttgggaggctgaggcagga

SEQ ID NO: 28298 - DNA, 20 bp, Artificial
  CRISPR gRNA sequence
gggaggctgaggcaggagaa

SEQ ID NO: 28299 - DNA, 20 bp, Artificial
  CRISPR gRNA sequence
ggaggctgaggcaggagaat

SEQ ID NO: 28300 - DNA, 20 bp, Artificial
  CRISPR gRNA sequence
aggcaggagaatcatttgaa

SEQ ID NO: 28301 - DNA, 20 bp, Artificial
  CRISPR gRNA sequence
gaaaccgggaggcggaggtt

SEQ ID NO: 28302 - DNA, 20 bp, Artificial
  CRISPR gRNA sequence
aaaccgggaggcggaggttg

SEQ ID NO: 28303 - DNA, 20 bp, Artificial
  CRISPR gRNA sequence
cggtgagctgagatcacgcc

SEQ ID NO: 28304 - DNA, 20 bp, Artificial
  CRISPR gRNA sequence
agatcacgccactgcagtcc

SEQ ID NO: 28305 - DNA, 20 bp, Artificial
  CRISPR gRNA sequence
cagtccagcttggatgacag

SEQ ID NO: 28306 - DNA, 20 bp, Artificial
  CRISPR gRNA sequence
ggatgacagagtgagacccc

SEQ ID NO: 28307 - DNA, 20 bp, Artificial
  CRISPR gRNA sequence
gatgacagagtgagacccca

SEQ ID NO: 28308 - DNA, 20 bp, Artificial
  CRISPR gRNA sequence
aaaaataaataaataaataa

SEQ ID NO: 28309 - DNA, 20 bp, Artificial
  CRISPR gRNA sequence
cattcccctcatggttaaaa

SEQ ID NO: 28310 - DNA, 20 bp, Artificial
  CRISPR gRNA sequence
ccctcatggttaaaaaaaaa

SEQ ID NO: 28311 - DNA, 20 bp, Artificial
  CRISPR gRNA sequence
atggttaaaaaaaaaactcc

SEQ ID NO: 28312 - DNA, 20 bp, Artificial
  CRISPR gRNA sequence
aaaaaaaaactccatccccc

SEQ ID NO: 28313 - DNA, 20 bp, Artificial
  CRISPR gRNA sequence
catccccctcaccactgtat

SEQ ID NO: 28314 - DNA, 20 bp, Artificial
  CRISPR gRNA sequence
accactgtatatttccatat

SEQ ID NO: 28315 - DNA, 20 bp, Artificial
  CRISPR gRNA sequence
tatatttccatatgattcat

SEQ ID NO: 28316 - DNA, 20 bp, Artificial
  CRISPR gRNA sequence
ccatatgattcattgtctca

SEQ ID NO: 28317 - DNA, 20 bp, Artificial
  CRISPR gRNA sequence
catatgattcattgtctcag

SEQ ID NO: 28318 - DNA, 20 bp, Artificial
  CRISPR gRNA sequence
attgtctcagacatcagctt

SEQ ID NO: 28319 - DNA, 20 bp, Artificial
  CRISPR gRNA sequence
tctcagacatcagcttgctt

SEQ ID NO: 28320 - DNA, 20 bp, Artificial
  CRISPR gRNA sequence
agacatcagcttgctttccg

SEQ ID NO: 28321 - DNA, 20 bp, Artificial
  CRISPR gRNA sequence
gctttccgatttctttgatt

SEQ ID NO: 28322 - DNA, 20 bp, Artificial
  CRISPR gRNA sequence
ctttccgatttctttgatta

SEQ ID NO: 28323 - DNA, 20 bp, Artificial
  CRISPR gRNA sequence
tccgatttctttgattatct

SEQ ID NO: 28324 - DNA, 20 bp, Artificial
  CRISPR gRNA sequence
ccgatttctttgattatctg

SEQ ID NO: 28325 - DNA, 20 bp, Artificial
  CRISPR gRNA sequence
cgatttctttgattatctgt

SEQ ID NO: 28326 - DNA, 20 bp, Artificial
  CRISPR gRNA sequence
ctttgattatctgtctatct

SEQ ID NO: 28327 - DNA, 20 bp, Artificial
  CRISPR gRNA sequence
tttgattatctgtctatctt

SEQ ID NO: 28328 - DNA, 20 bp, Artificial
  CRISPR gRNA sequence
tgattatctgtctatcttcc

SEQ ID NO: 28329 - DNA, 20 bp, Artificial
  CRISPR gRNA sequence
gattatctgtctatcttccc

SEQ ID NO: 28330 - DNA, 20 bp, Artificial
  CRISPR gRNA sequence
attatctgtctatcttcccc

SEQ ID NO: 28331 - DNA, 20 bp, Artificial
  CRISPR gRNA sequence
tctgtctatcttcccccctg

SEQ ID NO: 28332 - DNA, 20 bp, Artificial
  CRISPR gRNA sequence
tctatcttcccccctggaat

SEQ ID NO: 28333 - DNA, 20 bp, Artificial
  CRISPR gRNA sequence
tcttcccccctggaatgtca

SEQ ID NO: 28334 - DNA, 20 bp, Artificial
  CRISPR gRNA sequence
cccccctggaatgtcagcac

SEQ ID NO: 28335 - DNA, 20 bp, Artificial
  CRISPR gRNA sequence
ccccctggaatgtcagcacc

SEQ ID NO: 28336 - DNA, 20 bp, Artificial
  CRISPR gRNA sequence
gaatgtcagcacccagaagg

SEQ ID NO: 28337 - DNA, 20 bp, Artificial
  CRISPR gRNA sequence
tcgtctgtttggcccacaac

SEQ ID NO: 28338 - DNA, 20 bp, Artificial
  CRISPR gRNA sequence
cgtctgtttggcccacaact

SEQ ID NO: 28339 - DNA, 20 bp, Artificial
  CRISPR gRNA sequence
gtctgtttggcccacaactt

SEQ ID NO: 28340 - DNA, 20 bp, Artificial
  CRISPR gRNA sequence
tttggcccacaactttcctc

SEQ ID NO: 28341 - DNA, 20 bp, Artificial
  CRISPR gRNA sequence
ggcccacaactttcctccct

SEQ ID NO: 28342 - DNA, 20 bp, Artificial
  CRISPR gRNA sequence
gcccacaactttcctccctg

SEQ ID NO: 28343 - DNA, 20 bp, Artificial
  CRISPR gRNA sequence
tcctccctgggcctggcaca

SEQ ID NO: 28344 - DNA, 20 bp, Artificial
  CRISPR gRNA sequence
cctccctgggcctggcacat

SEQ ID NO: 28345 - DNA, 20 bp, Artificial
  CRISPR gRNA sequence
ctccctgggcctggcacata

SEQ ID NO: 28346 - DNA, 20 bp, Artificial
  CRISPR gRNA sequence
cctgggcctggcacatagta

SEQ ID NO: 28347 - DNA, 20 bp, Artificial
  CRISPR gRNA sequence
ggcctggcacatagtaggca

SEQ ID NO: 28348 - DNA, 20 bp, Artificial
  CRISPR gRNA sequence
gcacatagtaggcaagcggt

SEQ ID NO: 28349 - DNA, 20 bp, Artificial
  CRISPR gRNA sequence
aacaacgaatgccttaatcc

SEQ ID NO: 28350 - DNA, 20 bp, Artificial
  CRISPR gRNA sequence
acaacgaatgccttaatcca

SEQ ID NO: 28351 - DNA, 20 bp, Artificial
  CRISPR gRNA sequence
aatccaagaacccccataag

SEQ ID NO: 28352 - DNA, 20 bp, Artificial
  CRISPR gRNA sequence
atccaagaacccccataaga

SEQ ID NO: 28353 - DNA, 20 bp, Artificial
  CRISPR gRNA sequence
gggtgaaatatttgaggaga

SEQ ID NO: 28354 - DNA, 20 bp, Artificial
  CRISPR gRNA sequence
gaggagatcaagacttaagg

SEQ ID NO: 28355 - DNA, 20 bp, Artificial
  CRISPR gRNA sequence
aggagatcaagacttaaggg

SEQ ID NO: 28356 - DNA, 20 bp, Artificial
  CRISPR gRNA sequence
aagggtgaagggatttgcca

SEQ ID NO: 28357 - DNA, 20 bp, Artificial
  CRISPR gRNA sequence
agggtgaagggatttgccaa

SEQ ID NO: 28358 - DNA, 20 bp, Artificial
  CRISPR gRNA sequence
gccaaggcctttagcaggga

SEQ ID NO: 28359 - DNA, 20 bp, Artificial
  CRISPR gRNA sequence
ccaaggcctttagcagggag

SEQ ID NO: 28360 - DNA, 20 bp, Artificial
  CRISPR gRNA sequence
tagcagggagccaaatgcca

SEQ ID NO: 28361 - DNA, 20 bp, Artificial
  CRISPR gRNA sequence
agcagggagccaaatgccag

SEQ ID NO: 28362 - DNA, 20 bp, Artificial
  CRISPR gRNA sequence
gcagggagccaaatgccaga

SEQ ID NO: 28363 - DNA, 20 bp, Artificial
  CRISPR gRNA sequence
gagtcaaactctgatcctgt

SEQ ID NO: 28364 - DNA, 20 bp, Artificial
  CRISPR gRNA sequence
tgatcctgtggccttttgct

SEQ ID NO: 28365 - DNA, 20 bp, Artificial
  CRISPR gRNA sequence
atcctgtggccttttgctga

SEQ ID NO: 28366 - DNA, 20 bp, Artificial
  CRISPR gRNA sequence
tggccttttgctgaggccag

SEQ ID NO: 28367 - DNA, 20 bp, Artificial
  CRISPR gRNA sequence
ttgctgaggccagtgttctc

SEQ ID NO: 28368 - DNA, 20 bp, Artificial
  CRISPR gRNA sequence
tgctgaggccagtgttctca

SEQ ID NO: 28369 - DNA, 20 bp, Artificial
  CRISPR gRNA sequence
gctgaggccagtgttctcag

SEQ ID NO: 28370 - DNA, 20 bp, Artificial
  CRISPR gRNA sequence
ctgaggccagtgttctcaga

SEQ ID NO: 28371 - DNA, 20 bp, Artificial
  CRISPR gRNA sequence
aggccagtgttctcagactt

SEQ ID NO: 28372 - DNA, 20 bp, Artificial
  CRISPR gRNA sequence
tcagacttcaggatttcaga

SEQ ID NO: 28373 - DNA, 20 bp, Artificial
  CRISPR gRNA sequence
agacttcaggatttcagagg

SEQ ID NO: 28374 - DNA, 20 bp, Artificial
  CRISPR gRNA sequence
caggatttcagaggccgaga

SEQ ID NO: 28375 - DNA, 20 bp, Artificial
  CRISPR gRNA sequence
aggatttcagaggccgagaa

SEQ ID NO: 28376 - DNA, 20 bp, Artificial
  CRISPR gRNA sequence
cagaggccgagaacatttcg

SEQ ID NO: 28377 - DNA, 20 bp, Artificial
  CRISPR gRNA sequence
agaggccgagaacatttcgg

SEQ ID NO: 28378 - DNA, 20 bp, Artificial
  CRISPR gRNA sequence
cggaatgaattcgagtgacc

SEQ ID NO: 28379 - DNA, 20 bp, Artificial
  CRISPR gRNA sequence
ggaatgaattcgagtgaccg

SEQ ID NO: 28380 - DNA, 20 bp, Artificial
  CRISPR gRNA sequence
gagtgaccgtgcgcggttac

SEQ ID NO: 28381 - DNA, 20 bp, Artificial
  CRISPR gRNA sequence
ctgttttttaatgtttatca

SEQ ID NO: 28382 - DNA, 20 bp, Artificial
  CRISPR gRNA sequence
ttttttaatgtttatcaagg

SEQ ID NO: 28383 - DNA, 20 bp, Artificial
  CRISPR gRNA sequence
tttaatgtttatcaaggatg

SEQ ID NO: 28384 - DNA, 20 bp, Artificial
  CRISPR gRNA sequence
ttaatgtttatcaaggatgc

SEQ ID NO: 28385 - DNA, 20 bp, Artificial
  CRISPR gRNA sequence
taatgtttatcaaggatgct

SEQ ID NO: 28386 - DNA, 20 bp, Artificial
  CRISPR gRNA sequence
aatgtttatcaaggatgctc

SEQ ID NO: 28387 - DNA, 20 bp, Artificial
  CRISPR gRNA sequence
atgtttatcaaggatgctca

SEQ ID NO: 28388 - DNA, 20 bp, Artificial
  CRISPR gRNA sequence
atcaaggatgctcattcaaa

SEQ ID NO: 28389 - DNA, 20 bp, Artificial
  CRISPR gRNA sequence
tcaaggatgctcattcaaac

SEQ ID NO: 28390 - DNA, 20 bp, Artificial
  CRISPR gRNA sequence
attcaaacaaacaaataaca

SEQ ID NO: 28391 - DNA, 20 bp, Artificial
  CRISPR gRNA sequence
aaacaaacaaataacaacaa

SEQ ID NO: 28392 - DNA, 20 bp, Artificial
  CRISPR gRNA sequence
ctggcaccataattttacca

SEQ ID NO: 28393 - DNA, 20 bp, Artificial
  CRISPR gRNA sequence
gcaccataattttaccaaag

SEQ ID NO: 28394 - DNA, 20 bp, Artificial
  CRISPR gRNA sequence
taccaaagaatgatcattct

SEQ ID NO: 28395 - DNA, 20 bp, Artificial
  CRISPR gRNA sequence
accaaagaatgatcattcta

SEQ ID NO: 28396 - DNA, 20 bp, Artificial
  CRISPR gRNA sequence
ccaaagaatgatcattctaa

SEQ ID NO: 28397 - DNA, 20 bp, Artificial
  CRISPR gRNA sequence
taatattgaaaaagttcaaa

SEQ ID NO: 28398 - DNA, 20 bp, Artificial
  CRISPR gRNA sequence
atattgaaaaagttcaaagg

SEQ ID NO: 28399 - DNA, 20 bp, Artificial
  CRISPR gRNA sequence
aaaaagttcaaaggacataa

SEQ ID NO: 28400 - DNA, 20 bp, Artificial
  CRISPR gRNA sequence
aaaggacataattgcagaat

SEQ ID NO: 28401 - DNA, 20 bp, Artificial
  CRISPR gRNA sequence
cagaataaaagacagctctt

SEQ ID NO: 28402 - DNA, 20 bp, Artificial
  CRISPR gRNA sequence
tttatatggaatgcatttaa

SEQ ID NO: 28403 - DNA, 20 bp, Artificial
  CRISPR gRNA sequence
tatatggaatgcatttaacc

SEQ ID NO: 28404 - DNA, 20 bp, Artificial
  CRISPR gRNA sequence
atatggaatgcatttaacca

SEQ ID NO: 28405 - DNA, 20 bp, Artificial
  CRISPR gRNA sequence
tatggaatgcatttaaccat

SEQ ID NO: 28406 - DNA, 20 bp, Artificial
  CRISPR gRNA sequence
aaccatatttttaaactaaa

SEQ ID NO: 28407 - DNA, 20 bp, Artificial
  CRISPR gRNA sequence
accatatttttaaactaaac

SEQ ID NO: 28408 - DNA, 20 bp, Artificial
  CRISPR gRNA sequence
ttaaactaaacggcccttcg

SEQ ID NO: 28409 - DNA, 20 bp, Artificial
  CRISPR gRNA sequence
taaactaaacggcccttcgt

SEQ ID NO: 28410 - DNA, 20 bp, Artificial
  CRISPR gRNA sequence
aaactaaacggcccttcgtt

SEQ ID NO: 28411 - DNA, 20 bp, Artificial
  CRISPR gRNA sequence
aactaaacggcccttcgttg

SEQ ID NO: 28412 - DNA, 20 bp, Artificial
  CRISPR gRNA sequence
aacggcccttcgttgtcctt

SEQ ID NO: 28413 - DNA, 20 bp, Artificial
  CRISPR gRNA sequence
cgttgtccttatttttctca

SEQ ID NO: 28414 - DNA, 20 bp, Artificial
  CRISPR gRNA sequence
gttgtccttatttttctcat

SEQ ID NO: 28415 - DNA, 20 bp, Artificial
  CRISPR gRNA sequence
tccttatttttctcatcccc

SEQ ID NO: 28416 - DNA, 20 bp, Artificial
  CRISPR gRNA sequence
atttttctcatccccttgaa

SEQ ID NO: 28417 - DNA, 20 bp, Artificial
  CRISPR gRNA sequence
tttttctcatccccttgaag

SEQ ID NO: 28418 - DNA, 20 bp, Artificial
  CRISPR gRNA sequence
ttctcatccccttgaagtct

SEQ ID NO: 28419 - DNA, 20 bp, Artificial
  CRISPR gRNA sequence
tctcatccccttgaagtctg

SEQ ID NO: 28420 - DNA, 20 bp, Artificial
  CRISPR gRNA sequence
ctcatccccttgaagtctgc

SEQ ID NO: 28421 - DNA, 20 bp, Artificial
  CRISPR gRNA sequence
tcatccccttgaagtctgct

SEQ ID NO: 28422 - DNA, 20 bp, Artificial
  CRISPR gRNA sequence
atccccttgaagtctgctct

SEQ ID NO: 28423 - DNA, 20 bp, Artificial
  CRISPR gRNA sequence
gaagtctgctctaaatgttg

SEQ ID NO: 28424 - DNA, 20 bp, Artificial
  CRISPR gRNA sequence
aagtctgctctaaatgttga

SEQ ID NO: 28425 - DNA, 20 bp, Artificial
  CRISPR gRNA sequence
ctctaaatgttgatccaggc

SEQ ID NO: 28426 - DNA, 20 bp, Artificial
  CRISPR gRNA sequence
taaatgttgatccaggctgt

(The sequence listing continues in the following parts.)

What is claimed is:

1. An isolated T cell comprising reduced expression of MHC-I and MHC-II human leukocyte antigens (HLA) relative to a wild-type cell of the same cell type and increased expression of a tolerogenic factor relative to the wild-type cell of the same cell type,
    wherein the MHC-I human leukocyte antigens are HLA-A, HLA-B, and HLA-C,
    wherein the MHC-II human leukocyte antigens are HLA-DP, HLA-DQ, and HLA-DR, and
    wherein the tolerogenic factor is CD47.

2. The isolated T cell of claim 1, wherein the reduced expression of the MHC-I human leukocyte antigens results from the MHC-I human leukocyte antigens being deleted from at least one allele of the isolated T cell.

3. The isolated T cell of claim 1, wherein the reduced expression of the MHC-II human leukocyte antigens results from one or more indels being introduced into class II major histocompatibility complex transactivator (CIITA).

4. The isolated T cell of claim 1, further comprising reduced expression of CIITA.

5. The isolated T cell of claim 1, wherein the tolerogenic factor is inserted into a safe harbor locus of at least one allele of the isolated T cell.

6. The isolated T cell of claim 5, wherein the safe harbor locus comprises an AAVS1 locus.

7. The isolated T cell of claim 1, wherein the tolerogenic factor inhibits immune rejection.

8. The isolated T cell of claim 1, wherein the isolated T cell does not express HLA-A, HLA-B, and HLA-C.

9. The isolated T cell of claim 1, wherein the isolated T cell does not express HLA-DP, HLA-DQ, and HLA-DR.

10. The isolated T cell of claim 1, wherein the isolated T cell does not express CIITA.

11. The isolated T cell of claim 1, wherein the isolated T cell further comprises an additional tolerogenic factor selected from the group consisting of HLA-G and PD-L1.

12. The T isolated cell of claim 1, wherein the isolated T cell is a primary T cell.

13. An isolated T cell that does not express HLA-A, HLA-B, HLA-C, HLA-DP, HLA-DQ, and HLA-DR and expresses CD47.

14. The isolated T cell of claim 13, wherein the isolated T cell is a CIITA$^{indel/indel}$, HLA-A–, HLA-B$^{-/-}$, and HLA-C$^{-/-}$ isolated T cell.

15. The isolated T cell of claim 1, wherein the reduced expression of the MHC-I human leukocyte antigens results from one or more indels being introduced into β-2 microglobulin (B2M).

16. The isolated T cell of claim 1, further comprising reduced expression of B2M.

17. The isolated T cell of claim 1, wherein the isolated T cell does not express B2M.

18. The isolated T cell of claim 13, wherein the isolated T cell is a B2M$^{-/-}$, CIITA$^{-/-}$ isolated T cell.

19. The isolated T cell of claim 13, wherein the isolated T cell is a primary T cell.

* * * * *